United States Patent 9,328,346 (POLYCOMB-ASSOCIATED NON-CODING RNAS) - sequence listing, part 158

SEQ ID NO: 192917 - RNA, 352780 nt, Homo sapiens
ugggagggcaaguaacgcagucuuuauuuacaccacaagauaacacguugcgugaugugguacagaauacuggacuccagugaaguggaaagaaggugaccgucagaagaggauaucauuggucggugaaaauccacccacacaaaacaagacaagaaugagaaaaccaaacacaaaaccuccaacuccacugagcaaaagaaagaaccaucgggcacguccagacaauccaagagaaacggauuaaauuacagaggugaaugguggccacggccagugcgcagcucacggcgggcgcgaacaggcaucagguagguuacagugucguuacaacuugguuuucuaccacauuccguaagaagcucuugggugaguaagguucaagcccccuguauagauagauagauagauagauagauagauagauuauauauguuugucauucucaucaauuggaaaauagcgccuccacuauggagcacacacggcaaaaaaaacaaacaaaaacuguucgcuuucuuuuucuuucaauagcagacuuuuaaucaaugccagagacaaagugaggccgagcuaagaacacgcucagcuucguuacaaugaagaaaugguuuccuuucgaugcaaaguauaauuguaaaccacagugcucgcacaguucacgacugcuuaaagugaaaucuuagccauacaucaccuaaaaguaauuaaaaagucaacacagcugugcggaaaaggggacucuuucgaguccgcccaguucucaaucagaauaaaccgucacaaggccagugagggcgggcggcgcucgccuggcccguggaaggagauaaaaggaaacaaacaaaacaaaacaaaacaaaauuccuccaaaucaacucgagagagacaggcaguucacugugaauucugaguaguuucccuaaaacacuguuuccacauaaauacaauaaacucuauuauugguaugucacaagugcuagauaaacuuuuuuucuuaauaugacaaauguuuaaguaguccuuuuuauuuuucuuacaauaaaaaguacaauuucuuaagaauaaguucaauaagacgcaaacuuccccgcccuccucuccuucaagguuuuguuuuacagaaaaauuuccaucuuuuguaucugcaaaugucaugagaggggaacagaaaggcauuuuucuucuuccccaaagcugccgaguuuggcgugcaaaaucuguauacaauauaaagucaugccggucguacaguccaugcaaccuccagguguaggaaacuuaaaaaaauauauucauauauauuuauaucuauauauuuauauauguaucaaugcccauaaaacacgugggcccaaagucuacaaaaagaagaauggaaugagcacguggcugugaccaguaaagaaggaauguucugaucaaaaagaaaaacaacaaaguccauugcuagugcugcaaaaaucaaacuugcuuuugugucagaccauuacgaaaugguccuuccccuugcaaacagauuuucaaaagaaguaaagaaaaacugaaacaccuugacaaaguggcccuccagaaccagagcccugggacgcuggggaggggcggccagucccagcgggccacggccuccgggacagccgccugcugguggggcgugggcacgugggcacgcugcggcacggcgggaagccgcgagggcagggcagacgccaagaggcccaguggcgucaucaggguuucccucaaagggauauaaagugcucgcuugcugacucccagccagugcccccaaggccuuugcaaaggaagaaaaaggcuaaagguccaaggacccacagggagaacacaugaaggaacccucccugacguggucccgccugcagacgccgaggcagauccucugccaucugcccuggacgcuugcuguggagaagagccgagugugucuucaaagaaaaggcuacacaguaaugcucucagcacauuugugaagcuggagugagcugacagaugaaacgugccucccccugccaggccuuugcagagggcgucuccauuugaaugagauuagaauuaaguccccccacugauaaccuggccacugagcaguccauguuaucccaucaucugcuuaaaaaaaaaaagugagaugaugcauuccuccccauaagccacggcgggguaagagggcagguggcaggauccccagagggcuaugcagagaaugaggccaaggaggccagaagagccugcuagcugggcccugccacugcucugugccaugaauggggaauggaccagcuccucuugccaaucugggcuucagagcaaagaguggccaccagggaggggaaagucaaacaagucccaagaccguucugccugcucucaaaccacugucucagagcugaccaucagcagcccagugaccaagugaauccaagaaucugcacucauuuggucaaaaguuugaguuaauuucagaagcuacccuguaaacuuuaccaaacuccgaaacucggcucugggucccuccugagcacggugugucugaacuucugcccccaagucugaacccaauauacacuuuggaaugaaacugguggcuucaugugcuggaaaauaaguuaccaguaaaacgugacugucaguuacuguugaagagaaaaagaguaaagacuggcuguccuggucaggcaaucauacccucccugcagguucaccaggcaacaagggucccuggguuccuugcagccacaggcuccaaaauccagggcuggccacguggcugcaguggaaaaacccaaguggguaaagagccccacgugugccccaugcauugcugacaugcucaaaaggucuuuggaaaacucaaguuagaauucuauccugacgauguggucagagaaguuuaaacaugaguuucauuaaugcugacugcccccggcaucuggcaagccucccaggguggccgggcauccuaagcaacccucccugcccuugccacggaggggaaaaacacaccaccccucguaauacuacuaguguugaaaguuaaaaagagccccugggcuucuuuauacagcuccuaggacagaccaggaaagacacaaucguuggugucacuccgaaaagaccuacggucccuccucucacuuucugaaaauagaaucugacagcaacaauucuguacgcugcagaaaacucaucguacaaaaauaaaaacaaaaauaauuaaaaaccuuugaaagguaaaaaaaaauguacaagcaagaauucagaaaggaaaaagauuuagacauuauuaccauucagaaaauugcuaaauggugaggaaaaauguaaaauucauaaaacaaugcuuauucaggaucuuuuugugaaaaaauucauacaaaaaucaacagcaaauuuauauucuuugcuauaaaaacucauuagguacauaugugcaugaaggcuuggagacgggagcgguucuguuagaaaauaauuaaaaugaaaguacaaacuuguaggguaguugcccaguggcgaauguguuggcgaucugaaaucuagccaaucuggagcuugagaaaacaugaauuucaaucaaucaggaucccuuuccauaagcaccuugagagcaaauucacaagccauccauuugcagggaccuucgcaaucugcauucauuuuauauauauauauauacuuuuucuauaaaugcauuauaaauauuuuaucaagauuucauaagaaucaaguaaguuucuuagcuuggaauacauuggaauauauauuauacauauauauauuuauuuauaccuaaaauuuaagcaauacuucaugcuacuugcuuuuaauaaaaagcauuccgaucguaacacugcaagugugccuaccacaugcuucacgaccagauggagaugcucaaucguaugugacgugugagaacacuuuggauucguuuaaaauuuguuggacuucaaaaccuccaacgggauuugccacuuuuuuggaacuaccuccauuuuucuuaaacagcaauaaagcaaaacagggaccgccgggcugcagccccuggccccggagaugacggcuggugcccgugcuugaggcgucaggccagcucgcggugccagcacugccaggcucggcuggccacaggaaacugucccaccgauuccugcuguuuguuuuuucuuaaggcauuguuccucagacuucagaaaacccagccacaaaaauccaccagagcaauaaaaaaaaaggcacaaacucgcaucuuccgauggcuuuugagaaacucaagccagcucccccagcucacauuccuguuucuguccaguuuuguuuucuuuaaaggucccucugucccccacccgggugcagaccccccgccgcacaccgcuaugguucacagaggcgggccacagccguagaaaacguccucuuuaaaaaaaaauaagcuacaagaugagucgagugguuuacacagagacuguggaguuguggguaauaaacuuuaagcaccaguuuuaaucaaguuuguuuuguauuauuagaucuuugauauuuguuuucugugccucgugucaacugaauucggcagcucggccgccuguugccacaggcuccuuucuuccacggcgucccuugcgggacccgccagagugugcuuggcuuccgcguguccgugugucugcgcgucgccggcgucugucccguguucccugugaggcugccacgcccaggcgugcaugugcgucucgagaccugugggccugggcggcagaaaggcuucccguggcuguugcacgcugggugucccugggugcuccaagagagccccacggugggacgcaggcgugacacgggaaaguuucuuggcugagcuucaagacagagacagacagacaagagaacagcagcuucgagggagugcuacaggggcggcuccucuuccaugggcuccucaucuggucuguggaucccgcaagagaaggagaugggggcguggggcaggugcaccacagagaggagagaacagaacguggguuaaaggcugugugcugccccacccgccagccuagcccuggccuggcagccccggguccaucuguucaggaucuaaugcuccucaugcgucucuaaggggcuuuggcacuggaaggagggggccacacuggccugucucuagucuguugggcagggcaugugccauaaagguucugacccugaauagugugucagugggcacaguggggcugggugagccugcaggcgggcggcagggcaggugcucaccucuuuucggcgggcuucacgcccacggacagcgaggccauggcggugaccgucucggcuucuucguucucgcaagucugagccucgaucagagaacgccccgcuguggagguugugcgcugcaggcagcgccaguacuugccuggggugguggggugaggaaagucgcucagugacuacaacuuagcaggaugcacugaggcccgggaagguccugcgggacccugagccucaaaccagauugaucccuuaugauuuuaaaagcacccgucuuugaagagacacgaagcagaagacugcauggcuacaaacucacaaagacccaaaaaaucucuggaaauguuuccccauugugaguggcucgagucccuccaggagcaggcccaccuaggacugcagagggaggcuccuguaggccuggcuuuccacgcucacgggccccuuucugcccuggguggccagggcagggggcugccagccugcuggguugagccuuccuaucucugggagcaggugagcugggggauugucgcuggggcugaggggucuucugccugggcccucacagaggcuggggguggagggguacugcgucaggcgcaaggggguguauguggagggcugggccuggcccagggucagcuucagggcucugaagccaggacucccucacacagggaaacggggagcugagcucuggacuaccccugcuucuguggacagucucaaccaucugggucaucucaaaggcaagacaagcugggcuugcgacaaugacagggugugggaggcgccucugagauaggcugcgugccacgcccuugcacccaggaccugcugcuugagggucggugccagaacucagagggccuacacccugccucucugcagggccaaggguucuuugaggucaggacgugggcuucucugguccagggaagaggccggaguccccaggguacaggcucacagccauggcccccgcugcuagcuggggaccuagagcaagugacuccacacugagacugucugggccuugauucucuagacuuacaaauugggcugauggaaccaucccagcaggccgggggaaauccagucgggguuaaaugugagucucuaccagcucaagaaaugcagcugaaagcaaggccuucugcugcaggccuggggaagcagccggcagugggauggagaagagcuggggguauagggggacagggaugggguguggugcagucccacccccaggggcguguccccugugagcacccagccaggcaacuuacuguggaucuccaugacuuucuccauggaacggacagcguuugcauugggucuuugcuguaaaaccuuuucugggagaggaucaagcuggaagaaaaugcauaagaauauaaagacugccaauauaauccacacgugcguuagacggguguuccgagacugcaacuguuuccugagcacagagacccuuguggggugcauuugcccacagaguagaaaaaaauaacuuuaaaaagccaaaugugccgugguauuuauaauuuuuuuguaaaaguggauuuuuuuuuaggacgcuauaagauauuuguggguuccuacaaguagcaggaagaaagacaguccccaggaguggggcuggcaccugcacgugaacuugguaucugccaucgacgccacaggguuccaugagggggagugacgcuuacuucaucacuuuucuuuccuuugucuuuuauuaauaaguaagaaugucugaauauccccugaucuugguuuucuuccagggcagcggaagguggggucgggggagaugaaauggaagaaguagucagaucucucagagggaauccuucacaccgaguuuuucccuaaguacuggcagcagauaaaagcagggaagaaguuuacaagucaaugacagggcaacagggcaaagcauuugcaacacaacaauuaaaaaugguugacuggccgggcgugguggcucacgccuguaaucccaguacuuugggaggccgaggcggguggaucacuugaggucaggcguuccagaccagccugggcaacguggugaaacucugucucuacuaaaaauacaaaacuuagccagguauggcggugggcaccuguagucccagcuacucgggaggcugaggcaugagaaucacuugaauccaggaggcggaggcuguagugagccaagauugugccaccgcacuccagccugggcaacagagugagacccugucucaaaaaaaaaaaaaaaaagguugaaauggauuauaaaaauauagaaauacaacaguucaagaaccuuuaaauaacuggaagagcccacaaaaccaggggaaaccugcugggucuggaacaaagcuggaccugagucagaaggccaaagcacccauguccccagguguccuggagccagccuugcuggggcuggaaagaccacugucaggacaggacgggugagcgaggacagacgcacgacgacgugucaaacagaggccaugggaaggagcguuuggguuuuaacucuggcuucuggguagaggugaaaagacaaagugacccugagaauuugccugcuucuagacacugggaguggacagcuacuaucgacaguggcagcuccgccaggccagggcgccaggcagaaaccacagcagggccucuuuggaggcacacauacccacagcaggcuucaaaugagcacagccgguuaacuuccaggaagcaugaguucccaaacacaaaaaccccaaacaacacggaagugagucagcacgagccugggucaggagggaugaugagcgagguucccaaucccauucuccaaugaagggaagcaggcuccuuggagaacagcucgguccaaggcuggggcggggaaaauacaagacacgagagccuggagcaccucguggugcugggaaaucaggacgugccugaaggucaagggacggggccaucacaggacaugcagggccagucugaaaggugccccagggccagagcaggaaccagcugggcagcaaaaucaacaccgugguauugaagcaugacccaaaguguaagaaagacagauacacaggaguucaccgggauaugaauaaauaacgaaauacacacacaggggagcagagacaacuccuugagcauuucaaauaaugcacguaucuacuccccucuccaggagguggggcuuaaggccucuccaacucugucccccugagugugcacugcacugugacuuucuuccaaauaauacauuuggaaaggcgguaaaagcguaacccgaugguggaaggacccggcaaacaucacucucagcaaaugaucaaggucagugagccgugcuggcagcacaucugacaagcgaauggcauuucgauccuaugaucuuccuccccaaagcacagaaccaggagaagaaacucaaacaugaacugaagggcagucugcaaaaucucuggccagugcuccuugaaaaaccaugaaagacugagaaaaaagacacgaaaugacuaaaugugacgugugauccuggacgggacccuaaaauggagaaagggcaguugugguaaagcuggugacauccaaauacauucuggaguuaauagucauggaccagcauugguuucuaaguugugacaaacgacucauaucgaaguaagauguucacaguagaagacguuuucugaggggggauaugaggaacuuguacacgaucucuacaauguuucuguaaaucucagacuauccaaaaauaaaaaguuuauuaacuuuuaauaaguuuuaauugauuagauccuuaaagaucgcaguuacugaaaugaucaguuauaaauuauaaaaaguaaauauagugaguauguauuaaaaauaaaugacauuucuguaugaugaaacaaccagagauuuaugaacgugacauggaagaugugagacccaagccaggggcaaaaaaacccaggaaugcacaccuagguacaucagaguaaaacugcagaacaucaaaaacaaaaagaaaauucuaaaagcugcuagagaaaacagaaucuucaaagagguagccauuagccacacaccaacuccuuaacagcaauggaggcaagcagacaguggcuuaaaaucuuaagccaaucaaugugucaagagcaaauccuugucaacccagaauuguuuauccagugaaacuaucauccaagaacaagggugagauaaagaccugccuccucacaaacgcgagcuggggaaguugaccacaugaguguuuucccaagggacacucuaguggauguauuauacuuaaggcaguaugaaaauaauccuagaagacagugugagaaaugagaaggaaugaugagccaagaaaaugacauaaguacaggaaagccuggaugaacagggaugacauagagcaauaauaauggugucuuaucagugaaaucaaacaaaagaaagaaggaaaugaaacaccagucagugauauaaccugggauggggcacugaggcuagggcugccagauuuaguaaaacaaaaacaaacaaaaccauucacggcccugguuaaauuucagugucugauaaacaaguaguuuugcaguggaaggauacccaccugggugcucugugucuacucuggcacccuaauuggggcuggcccaguccgggcuuugguuugcauggaggugggagugaggaugcugacuguguugacaauacaugcuccaauuguuaaagaugacgaaugaaaaacaagaaaauagguugcauaucuuuggacucaguagagggaacaaauggaaugcaggaaacccucaauuaccccaagagaaggcgagaaaagagaaaaaggaaagagccacagaaacuggggacaaacaaugaauaagaugcuaagaaggcaucugaaaaaagggaucaaacuaacagcaaaugacccacguuuccacuuaaagcacagaccacaggauaggacgugaaaauaauauauugcccaggcuuuugcuguuuauaggagacacaucugaaacuucaggggaaggcuaaaagucccaaaggaaaacugacgcuaggcaggcaaaccuggccaaagggcagcuggggucacagcuccaauaucuggcacaaaagauguaagggaaaggccauuacuggauauacagguuauugugauaagacuucaauucaucacgaaagggcauaaugaugucaaaugucuauauuuaguaaagcagcuuuaaaaugucuaaguaaaaaugggugcaauggaaagaagacaagaauaugugugucccaccaucgugggagacuuugccaugucuuucucagauccagcagacaaucgucggucaggaaaaccaaagcgugaacaauacaauuagcaaguucuguuuaaugaacacaaacagaacucugggaaacagacggagaggacacauuaucccaaacacauguggaaugucucugcaggcugaccacgcacuggcccguaaagcaagucgccacaaaaaaauaaaugccaaccacacuuccuuuucuuaccacagugcaauuuguuagaaauugauagcaaaaagagaaccaugaguccuuauguuuggaaauuagaaaacacaccaacucauggcucaaagaagaaaucauaacagacaucaggaaaugcugagaauuaaaaaguaaugaaaagugcuaccuaucacgaugugagaugcggcuggaugccauguuggagccauuuacagcccuaacugcacacaucaggaaagacuaaaaauaaauauccaauguaagaaguuagccagagaacacagugguccuaaagcaagaaggaaagaagauagaugggaaagcagacaaauucugaaaagaaaaaaggaugcugcaguugaaaacugauucucggaagugcuugaguaaacugacaggcuccggcaggacugacggaggaaacccaaguucggggggguacacagggacaaccccagggaugaaagggggccccggcuacaggcagagcagagacgugaaaggcaggaaacuggggacacuuaacucuugccaagaaaucugaagaaauucugguugaaauggagacauuucugguaaaauguaacuucucaaaauuaagaaggaauaggaaacuucaauagaccuauaaccauuaaagucacugaaucuguaauuuaaaauuuucacccaaaguaaaccugcggccuaggagaguucucccagucaaggaacagauuauccugauccuaccuccacuccuccagaggacagggagaacacuccuagggagccagcuaccacccaccagccuggagcacagcucuccugggggccuuggacccauccaccagccugcaggacaguccucuggggggccuuggacccaccuaccagccugcaggacaguccucugggggaccuuggacccacccaccagccugcaggagagcucuccgggggcccuuggauccacccacguccgucacacucguaguucucgagagugaccguggacugugcugggcaacacagccugagaugugaaggacacgggcuggccagccuggcucugucccaguccuccgccgguggaaacagggcacccuucagugcuucagcucagugugucacauggcacucgggguacaaaauucaggacaggcuguuuccuagaggagcgcacugaugggacuccauccacuggggcauuucugagccuugggggacuggcucauggugcccugggcuucugccguccccugcugccugucuguaaguaguaaaucugcugcacagaauguguguguggguguugucucccuggacucacacaggcuggucaccaauguguggagaaccugcuucacaccaccgcucucuccuucucucccucuguccaucugucuaauucaccccacuaagaacaaauagggaaaagacaauccaauagaaaaacggguugacaugaacuucacaaggagggaaagcccagguggccaauaggcagaugcggggcugcucugccguggcggucaugaggaagggacccuggagcccugcagaggggccaguuuuacccccguccagcuggcaaaggucaagggcaacaaugccaagugcugcugaggucuggucacgccacugcugaagacaguuuuaacccuuaaaaagccgcuugauguuaucuccuaaaggugaacaaacacauccugggccaucuccccuccuggacguuuaccggagacacggccaccuagguguauuggggacuugcccggaaguucagcguaacucugucugucacaagcaaacccggagcagcccgcaccugccccggcccgggcccgugugggaugcacgcaggcuccuuuacagagggggccccagggaagggggagcgcugagaugucccuuacaucccaacacccagguaacagggcccagagggacggccccgcuguguguggccacagcuccuucaacucugaaggccacgaggcugggcucugucuugcugaaagucggccaggaaggcuuuggcagcccggauggaaagaggagcaagcgggacacacgacguggacccugugcgcgccacaaucggcugcaugcagauaaaacauucaccguuggcacggggggagugugacugagugugagugugugguguguguaagcauucauguguaugaaugugcgugacagcaugugcuugugggguaugugugcguguguggugugugugugcacgugagacuguguggugcauucaugaguaugcacgugcagaugugagacuggugcuucugugggugugcagauguguggugugugcaugcacaagagggcauaccuguguggugcaugugaugugugagacugugguaccugugugggugugcguguguguggugugugcaugcacaagaggguguguggugugugcacgugugacuggugccugugugggugugcguauguguggugugugcgugcaugagagggugcacgugugugcacgugugacuggugcuugcgugggugugcauguguggugugcaugagcaaggaugcacgugcaugugagacuguggugccuaugugugguguguguguacaagaggguggccauguggggugucagugugagaggaagagugacuggaagcaggcagccagcucucagguuaauccaacucagucccucacacacacuugguuuucguuacuuuguuagagcuguuucacaaccacaccuuucacaaagcaucaggacauaacuaauaagcuaaacucccgggggaaaaccuuuuccacacgacaccacccuccugcuccacgaaugucuuccacgaauccuggaguggguuaaaugagaugguggcauuuuaacccugaaaugccccaugacuaaaguagaaaauuggcccaagcaaaaaccugcuuugggcauggucucagacaggagagacgguccuuuccuaaccucccgggggcacgggccugggccacagauccccguggccgucuggugcagggucuuugauggaaguuggcuggaggcccgacucggugcugcgcccacacgacuccacggcccaucuacacugcaacaugcaacacucguagggaacuuuucacugcccauagucacuggcaguugcagauaacugaacauggaaacuauuaaauaaaaugguugcugggaacagcacaggccuccagaccuacgcgcugaagacagaggggucgcucugauagcggggacgccaaggccccucugcgcuuccugucccgcacacccuauaacucagccacuucugcagcaacaggguccccgcaggccacugccgucacagcuggcggccccgccugugugugccagaucgccuggcacacuguauaucaaccuucaucaaaggcugccgggcagaggggcggggcccaggccaacucuugugcauuaaagagacuuuuaaagagaccuugauaaaacuagugcuuccuccuuuuugacguguuuaaguaaaagaacauuuucuuguuagaagcgcaaacacgcaucaggaagcaagaacaggccacggcugaaagcgaaguucccuauuguuauuuaaaauaacuagccagaagaaccauaaggcuucgggaugguagaauauauacgucaguugccuuuuaacuggagcaaaaagggggaaaagacuguuugaugugaagaaaggaccuguaaagugcuuuggacauuuuaaacagcagcccggucuuuuauccagccugucgcuggccagcucacccgcugcagggaugccaccuggaucuuugaucuacuugugauuuauguuaacaugaacaccaucccugaccagcaaagauggccagaaggcagggcguguccugguaccugcagccacugcccauguccccucucggcaccccucuggcuggcgcaggccccugcgauggcccaggcugcaggucccaaggggcuccccuuggcgaugcaagguccugaccccgccaaggcccugaccuuggccauugccugcugucgcuccuccggcuaagucuugugcccuuggggcuuggcacacauggggucucgcauacuccaggucugcugucccggggucacgcacccaggggucuugcucuguagugggucauggaaccguucccaucccccauccucccaagccgggccguggcccugcagucuuuuuuuguuuuuuuuuuuaggcggagucucgcucucucgcccaggcuggagugugguggcgcgaucucggcucacugcaggcuccgccucccggguucacgccauucuccugccucagccucccgaguagcugggacuacaggcgcccgccacugcccccgacuaauuuuuuuuuuguauuuuuaguagagacgggguuucaccauguuagccaggauggucucgaucuccugaccucgugauccgcccgccucggccucccaaagugcugggauuacaggcgugagccacugcgcccggccagcccuggucuuuaaggcagcacugucagcugucggcggaggugugcaaggggacguaugcgcccaccccucagaagauccagggguuucaguggggcccaacagaccaccucaggccuggccaugcgucccucucuccccuuuccccuucugccucgugcucuuggcuuggccagcccagccucccccacaccugcgagagcccaacuguccucccgugaggugccugcacuucugggcucucacugacccccagggucacccugcccuuggcguccucuacuucuucaagccaccgaaccucccuccugucugggagaccacuggccagugcccacuucccugaccgccagcucccuggcuucccaagucugggucaaggccccaugggccccauggcagccuuugggugagccgaggcucagcgcugccgguccugggccucccucagcggcugcgcauggucaccggggcaaggcacugagcccugccgaucaucugcaggccucacccacggcccuuagaucaggagucacugcagagagacggagccucguagguucuaaggaagcugccccucucccucuaauggcaagggcuggaggaacacacagcugacgcgcaccgcccuggcuucccuggccuggaaaagcuccccuugcugugccgggcaguuugugucaccuggagauauugcuggugugcuuggccuucaggccugugucugaaugagaccuuuccuggaaaauaaagcagguuugucucagagugaaucuuucaaaauuuaggauuacagugcuggccuuucugggaaagccauggcagcagcccugcugggggcgggggaggggcccggaggaugcccugugcugcucccacuucuggcgcagggggagaccccugacuggagugccccuggcuggaggcgggaccugcagucccaggucccaccuccgccgucucugaugcugccccucacaucggccucaacagaaggggagggaggaagguucuggugcuguggcggccuggggcccuagaaaggugggggucuugacugcucacaauaagacccugcucucaagagcagacccaggucaggaacguacggcuuccucggcuaaagcagcacccaguuagcagcgaguuaccaaccguuuggaaagcaaccugcuucccagggacagacggcagaggugguggaggugggaacuggcugugaccagugggguuccucucauaaugggguuugcacugggaagaagacacccuuuuguucuaacgcucacaaugagaauuccagcacccacgcccaugugcaggaggcguccucugcgaggugcccugugugcuggccaccucgaggcccacugcgcaugcugaggccacucacagacagugggccagagaguggacccucccucugcauuuuccagaacaaugcgaacgaugccugcacaccagaccccgcgagcgccgugcuuaacuacagggguccguggccuccugugcggccugacguuuccccaccgcucgugaccucgagugccucugggcgcugcccuuaguugcacggcacccggaccguccuggagugagcagggccagcuuuccaucgggggaggcuugcacagaguguccugggauggcugcagucccugccaucccucugcccgccccacaaugccaggccagagcgccugucaguaagagccaucagacaccagaacccaggggcgugcaaggcaccuguaagugugugaccgccugucuggugaacagagggccugggaccagcaccuuggucuggagcacccacaggcaggcaaaagccagcacugacccgagggcaucugagcugcugucccacugguuccccaaacauaagggacuggggagauuuuuuuguaaagacaggugaggucggaugguagagugcugccuuuuccuugagcugaaaaugaggaugcugcuuccagagaagucccccagagugggggcugagcaucaaaugggggugaaaaugcagguuuccugcaaaccgcugagcaccaggacacccccacuaaagugcccugucaccccgacucuacugagacuguccucaggacugccgggcuggggagggcagucccagagggcacaggaggcagacucccacccugcccccuggcaaggccucugcaucuggugugcuggagccucaggcacugcccugcccuccgcuuccuguggucaagugaucuggacacauggcccuugagucccccacgugccagcuggcuguucuccggaccugcacuggacacccagcgcaggcagccaggcagagcucugcguggggaagccaccgacugagucgugucuuggggaucuggacucacacccaaaacccuguagacggguucagaggcucaggaagagcaggugugggaaacucagaaugaaagguaccccuccacuuugugucacacacuucagacacucuuggagguggauaugacauugguagcuguggcacugccuccuccucccaucucacuggcccacgccugguggaggcccugcugggagcagggaggcccgggccccagcgucaugcuggaauggaacgcugcagguggcgcucucaccccgagcccguggaacauucuuuuucucugcccaggucucagaggccagcuguacagaccacagcgucucugacucccuccggcgguguugguagggacacagcagggagcccugucccugggggcucagagcagcagacaggccugcugggcagaagagccccagccugccuuggggccacugaccgaaacccacaugaggacucccuagagaagcugacuguccacagaggaaacgaagagagaaagaaaaagaaaaccucuggucacagugugcuccacguaauggagagagggacccugaacugaaagggugcagucgcaccgcagaggacccugagccaucuucucacgacaagagggcuccuuccaguccugcccccugcaccucuuccagccaucgucacgguucugccacauuuagagcuaugcggggguggggggcaggugcaaggcggagcugcaagcauccacguggucagagacccacuggcuuuuucaugcucuggggcucucgggcagccaggccacaaccccgagccugucaguguggagcauccuguggggucucuggggucuuccuaccucguuucccagcaaggcagaaacacaugcuuccgaggcgucgcaaauggcggucaggucguggccucccucgagggccaggacaauccggccgccagccaggcccaucagcugcuucgucagguacccgaagccugcaacgggaaacgggagacugcagugugaacgggggaggaccgcagccagcacagcccagaaacgcgucucauggcaucguaagaagacugggggcuggggugucgagacacauggccaggccggguuucguuuaauaaauucgcugaagaguuucggcuuuggauuuccucuuugaucuguuugagaggaggaauuauggcuucaaugcuuugauuuuuaaucagcaaaucaucugcuuuaggggacgagggcagccagccccacccagaggcugcaggccaccugcccuucggcccccgcagaggggcuauggccaugcucuuguggccguggcccagcgggcucugguuaucugacaugcuccaaacauguauguguacacaugugcacaggcugcaugugcuccugaagcguucucccacguccaggucugagcguuuggcuuugaucaagagccacagucccgccacugcacccacaucacucaccccaggagggaaugccugguggaugaggguaaucaccacccucagccaggccaggccggugcugauuagagagcccggaaccacgcgccgcuaauuaguggccccgaucaugggcuggcgaggccguaacuucccaaagccucgguucaucccaucugauggaaacagugacaggggcuucgaggcagcugugcggacugaggaggaagcugaggaugugguggccgcggugcuccgggccgggugcuguggggcguugggcacaguggaagcucuuugcccucugucuggucacuuugcuggccacuaggcugcacggccugguggacugugggaggccccaggggagcacagccaccgagggcugccucaggucuccugggugagccacacccuccccacgcaaggaccugagagacgggccccuccuuggccgccugugccgacaggaguggggagggccauacacuguggacgcuggggccuugagggcaucaccagggcuaggaccaaggccacaggaugcuugggccucgggaggcucuccaggauccucggggacuccagggugggggaggcggccaggccuuugugugcgccagguuuucaucuccuugugaguugcugaggcacagcaggagcacugcugggcagucccuccucccauccugacagcauggccccuaacgcugauccugagaggacacacacauccugggcucccucauccaacucugaacucaacugugcccccagcaacuucccuuuacaguuccaaggagcaccgccugccagagaagcggcauggggcacaucucagcucuuggugggaccaggaccugccccuggagguggccugcaggucccuaggcacccgcaucccagagagggagccucgugugcccuaggcccuuccugggcaaagagugcccgaggugccugggucugagcucccgcugccugcucugggcucucuggggccucccaaauggacugguucccaguacggucagaaccuuggucauuaguaaaaaggugcccuuccuuaucucguuauuaaaaaggggaccugacacgcggaacacagcggaucauggacaugagcagaaccggcuccucagucauaugcagaaccacuuacaucuggcggagagguuguagcccccaagaggggugggguggcccuccacggcaucgaagccugaugacaccagcaccacauccggggcaaacucgcuggcgaucggcaugaccaccguucugcaaaggacaggagaaggcguuacugggucagcugaaagagggacgggacggucacaaaaccccaagguucccucuggcauugauaaugccugccccgcacccccucggccacuggcgggcugagggcuccacacagcaggcuggaaucuggcgaccacgcuuaauuagaagggaaucaacccacgugugauccaggcucauuucacaucuucacagugcaagccagcaagccccacgacacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcuuggugagagggagucacggugcaagccagcaagccccacugcacuugcugggugagagggagucacggugcaagccagcaagccccacgacacuugcuuagugagagugagucacggugcaagccagcaagccccacgacacuugcuuagugagagugagucacggugcaagccagcaagccccacgacacuugcuuggugagagggagucacggugcaagccagcaagccccacugcacuugcuuggugagagugagucacagugcaagccagcaagccccacugcacuugcuuggugagagugagucacagugcaagccagcaagccccacugcacuugcuuggugagagugagucacggugcaagccagcaagccccacugcacuugcuuggugagagugagucacggugcaagccagcaagccccacugcacuugcuuggugagagggagucacagugcaagccagcaagccccacugcacuugcuuggugagagggagucacggugcaagccagcaagccccacugcacuugcuuagugagagugagagcauugcuguuucuugguaugcuguuuucuguauaauuucuguaacccccaugggacaagcugcauuaaccugggggagugaagccagcucccugucccacuaacaccccuccuuggccccgugcccacccacccuggcccugucccguccucucuguccugguccucccugcccauccucucuucugagacugggucagcuccacucgccccaucaggcugcucuugcugcgacaaugcacuuuccacagcucccacugaagacacgugcagucacccacugccccuagugcugggacugaguguggccgagagggcggagagcccuugccagcccugcugggggagcccacguguuccuuacucacccuggaacaccaacacacacagguguaagggaauuacaacacaagacacuuaagaaucuuuaaagggaaaacugaugacaaauguaagagaauucacuggaaaagacagaaccacugagaaauucuuuaaauuauauuagggaaauaaggaaaguauucuauuuggaaaggggaaaaagcacuccuuaacacaaaagaacuuaucagucuuuagucuaaugaucuuaucagugugugcuaugaauccaugcguaugcuaugaauccauaugugugcucuccgugaguagggaaguucagcaguuucaugucuccuuuaggcugccgccuucgauccugaguuaaucaccaccacugacuuucaaagucuccuucacucccucugugggugaggggagcagaaucagggccucccuuuccuggcggacagcaaggaccucaugagacagguggucuggugucuuccugcaaugacggcccaggugcaaggggccugugcaggugaggacgguggaacagaaguggagccuuuaaaaaggggcuucaaaaaguucguggaaaaauugaauuaaaagauaaaaaauauaaacuuuauuucucaagcuccaucaaguccaagacacuuuugcaauggugaccgcagccauuuagucccucccgaaaggacugaguguccugggaaucuaaccaugucaaugcagucucuguuguuuuuuuuuuuuuuuuuuacauuaaaugaagaaaaauaagugcccuuuacagguuuuucuaagauuaggaaagaagaagcagccaacucaggacuggaagguggaugccuaaugguuucucuucaaagcucuugcaaagguuuucuaguuuaauggagugagcagaagcauuguuguggaggacucuugguggcggcggagggaggggugcugggcacgguggcucacgccaguaaucccagcacuuugggaggcugaggugggcagaucaccugaggucaggaguuugagaccagccuggccaacauggugaaaccccaucuccacuaaaaauacaaaaauccgggugugguggcaugcaccuauaaucccagcuacucgggaggcugacgugagagaaucgcuugaacccaggaggcagagguugcagugagucaagaucaugccacugaacuccggccuggcugauaagagcaaaacuccaccucagaaaacaaaaaaagacucucgggggaaacucucccagugauuuucugugaaagugcugaggaacuuucucaaaacacucucacaauaagcagguguuaucauucuuugguccuccagaacaggcaacaugccuugggcauuccccaaaccugcugucaugaccuuuacuccugcuugaccagccugcuacugcugugacugggccaccucuggcucucgguagccggugcugugguugugccuugucuucaggaugguccugggaaagccgugcuccaucuccuguuaugacacucaggacccugaguccaccuguugaacauuuccaccgaaagcucugcuccugucggcagcugaucuggacgcugugguuuuggugcccacugacuggaaagucugcucaacuuuaauucugcaggcagaguuguguaagcugagccgguugagacgcccauggugucaacuguugcuucugcuguuaauuguggguccucuacaauuagggcaugaacuggaugaauuuuuuccucacaaauugauguggauggucugcagcugggggcuucaucuucaacaccauugcacauuccuucuuaaaaugagucauccauuuguaaacugcugauuucuuuggggcauuguccccauaaacuuuucauaaaguaucaaugauuucaccacucuuccuacccaagcuucacuguaaacuugcuguuuguucuggcuucaguuuuagcagaauucacguugcucugagaagggcucuuuucaaacugacguuuuauccuuggugccucaaacuagauccuguccagauauaacacguuagugcgaauuuauuuuggugcagaaacauuuugaaacccaugcaguuuuuuucaaaauaugcauuuucuacgaacuuuuaaaagucuccugguauuuccaccaugaagccuaguuugcacgauucccacuugugcugugagcucuggggguccccucaccaagcccuugugugaguagguccauguuuuaggguuucaccaccgccuacuuccuggagcugcucagcccagccuguccugcaccgaagcacacuucuguguccccacggccuccccagcacacgcgugugggccaagugcaucacccgaugggcgccucccuucauauggauuuucagaggccccucccugggggcagccaaaaaugcacucaccgggcccagugucccuucccaccaccaaggaccuuccagaaacaucacggcagacggcagcagggcuggcccuaaaacuuuuucauucagcuuuuauuacaaaugaaauuccccacugaugucacugaaaguaucaacuuugaccagaagaaacaaaaaugcugaaaauucaaugugaccccuuuucggggaugaccgcagaucagaaucuuauugaaaaguuccucugauuucuggugguggagggacacaacccccaagggcuuaaacaccaggugaagaucccgcgggcuacucucuagagggccagcagucaugagucccaucagggacgcugaggcaacgggagggcccaucucaaugcugggagcacgcggugccugauccuggugccccgcgucccaugagcaagcucagacgggagaagagugaugcgugggacuguguggcuucagccuguucaagucagugcugacaaacucugcccuccaaacaugcgucaaauccacaccuaggcaccuugcccgccaagaaacucacuucuggaacuuagaugggagucacaggagacccuggguggcuucugagcagucugcuucuguucuuuuuucugaagagagccaguccacacaauuuccccuagaccugccucugcggcagcuguagaaagugcuuuccaaggacacaggagcugugccccgagggccaucguuaggggcugaggaaacaaggugaaucuagacaggggcagcgagcuuccugccacgggucagauaggaggcaccugaccucagucugugggccacacggucucugccaggaccacgugaugcugcccuuguggugcccaagacaggacagacagugcaucggcgugcgagcgucccugugcucugauaacacugugccaagagcacaggcggcaggacuuggcccaccagcuggaguugcccaaaccucugcucugguccuguccauacaacuucuguaacauucuuccaugcaugauucuggucccagagugagagguuucuucucaccuacugggaccccaccacaaagcauggcgauuucgcaaacaugguguacaacacaggaaacaccgcacuggccucagagcgugcguggaguuggugucggcacucccgccgcagggcugggaggggagaaaucagucuagucaguggcaggauggagagaaugccuuggaauccaggaguccuuugacucuugcuggacccagggcccugcccuggacacuggaaggcacuggccccacaguccuuucugaccgacauuccgaggcuuccuccauggcucugaccaaccuaaugggcagcaggacugaggggggccgcaggacugagggggccgcaggacugaggggggcagcaggacugaggggagcagcaggacugaggggggcagcaggacugaguggggaagcaggacugagggggccacaggacugaggggggccgcaggacugagggggccgcccucugcuuucaacuguccacaucaucccaaggagacucgcuucuaauuauuuuaauaaaguucuugucauaaaaccuuuuucuuuggacagaaaaacacauuuccagccaugcuuuugguguggauuuuaaagccaagaccuuuuucaaugagaaccacaggcguuuuguguggacgcuguguccuuggcgaggcacucugacugcugcuuugcagcgagcgcacguggaggcuuuacuuccccacuuugaagugcugcugagcuauuuuacuucuaaucccccuccaaaaagaaguccugugaaaaucgccguuaaaugaaguucauaccaagagagucucugcugucuaggcuuggugugugguguugccucaaagccagucaaaacaaaaugggaaagaugagcccaggcucgugggcacuggcacgucggccacacgugaggcugcguggggcacagucggaugcacgugcccacacacucauuuucauuuuacugggcucaacacccucuagguugugaucccaaacaccugcuagacauaagaaggucagaacgugaggugcaugagugcaccuucagcacccguuuguggcgcgacuaagaaacgucccuucuccuccaugggacaugacuucuuugccuguaaaaaggaagcugagcauggcacucccugugucuucaggacugugcuuacccuccacgacuuuccuacaagaggaagcugaaggaaugucccuguuuaauagaugcugcaaaaaaugggaaacuggacucacauuuuauucccagaauuaaacuuuuaauaaagaacucagucucggccgggcacgguggcucacacauguaaucccagcacuuugggaggccgaggcaggcggaucaugaggucaggagaucgagaccauccuggcuaacacggugaaacccggucucuacuaaaaaauacaaaaaguuagcugggcgugguggcgggugccuguagucccagcuacucaggaagcugaggcaggagaauggcaugaaccugggaggaggagcuugcagugagccgagaucgcgccacugcacuccagccugggcgacagaaugagacuccgucucaaaaaaaaaaaaaaaaaaaaaaaaaaaaagaacucagucucuaaaaaaauaagauugagauguuugccgugggccucucaagccaucacuuuaaggagaguauuuccaugaggucacuuuuggccuuucuuggggcaaccugaggggagagaggggugggcucgcaguuucccaaggcaguaggcccacugaucguccacugaucgucagcucaagaggcaggagaaauggguggaaagaggggaucuuuagagaagguggacaaaugccuguaaggugcaccccuggggccggcaagcccagggaagccaugacuguggugcccagagggugccugugcccgugaggcacguacagagggaaacguggugcuaaggggagagagcggcuucuccucgcgguggccucugcauuuagggaggucccgugugaagccguggggugccacgcauccccuucccguggccucaauguggcuucucuggcaccuucguuaccgacacagcacugcacccuucacucggucaucagccaaccugcaccugcagccugaagacgacaucuccccucagcuucccagggaauagagcugggcugggacagcagacaggugccagccacuccccuugguuucccgggaaacaaagcugggccgggauagcaggugggugcuggccacuuuccucggcuucccagggagacagagcuggguugggacagcaggcgggugccagccacuccccucagcuuccugggaaacagagcugggcugggauagcaguagcaggcgcgugccagcgaacucuccuuggcuuccugggagacaaagcugggccaggauagcaguagcaggcgggugccagccacuccccucagcuuccggggaaacaaagcugggccgggauagcaguagcaggcgggugccgggccacucuccugggcuucccaggggaacagagcuggguuggguuggaacagcaggcggguguuggccacgccccucggcuucccagggggaacagagcuggaccgggacagcaggcagggugccggccacucugcuuccucgaaaggccaucgcucgugcagccucccagcugugcucugcgcaaggggcugugucacggggcacgucuagcucuaaaccaccacauaccaucaaauuauggccuguacauaccauccucaaaagccacaacugcaucuaaaugcaauaauucacuuaacagcuggguuucaacaucuggaaagaaaugaccuuccaguucauuccccuaguaggacccuaaacaaaacucaccacaccuuccgucaacacaagccucagagcaaaccgagcuuauggggccaagaggcugcaguccuguggccacccacagccggcaagccucuggggacuccgugggaacugggcucagggcuggcacgccaugcuugaguuucuggcugccguucugccccaauaaaugcccuggggcaucguccacacaaacuggcuccucacuggcucucccuacuaaggggccuccagguggagaugcucccaaccacccacuuggauggacacuuucucacuuuuuccugaaaacagacugaagcaaaagcguccccacugaacccucauccacccccaccugaaccuucucccgcuggaucucugcccagcacccuucagccuccucuaagccagcaccucgagaccucaccaagugcccucucccccaaaaucagccccuacuccccucaaucccaucucacuucaaccucuuugagauggccccaccucaccagccuguggcccugucccaaucucugccgcuguuuucugggcuuguccacuggcccccagauccuacccuggaaugcucuuugccagguccaagucugucaccuaagcugccacaagacgggccuguccaacaugcagagcuggccgugaugcuucuucauuccacagucagaggccccgauagagccccugccaucagggccaaggucuggcucuguggaugcagcccaggugagcggguuugcaccaucgggcucuguuccuucgggacggcccuucucccauaaugucccgugccaggcucguucuuccaggacucagcugggggcuugccuccuccagaaacuuccuuggccccaccaagugggcagguccccugaggucuuaccgggccugccuagagcuuguccucccagucccccgcuauccuccagggcaggcacugugccggcuccacuguucgcuucuuacagggccggccccacaggcgagcgaaggcuggcgcaggacgagcucucucagcucugaggcuguagcuuauaugcuuuugcuucuuuuugcuucucagauaaauuucuacauaggaaaauacuuggaugcacuuaaagagacauaauugcuuuuagaaaagaagguggcacggucuguaugaaaacuucauaacccugacuuccucaggcaagaaacccagggaccagcguggugugugcagcgggugccacucagcaauggugaaaacagcagacaucaggcgcugcgacuccuaaaacacaccugucuacaaaaggcagcaacagcagcaacacagcaacacagcuuacggaaggaacgaacauucaagagccucagccuucccgucuuacuugaaaguuuggggaaagugaaauagcuuugcccaguugcucaauuucaaggcuaaugccaauucgugaagcuaucacaguuauugcuugagaagauccaguuucagagacaucuuugauaaacuucguaauaucacaguggaaucuaagcuacgaaccacgggcaucuggauguggcgcucaucccugacggaagaguccccauguccccgcgcacaggugagggauggguuacagagcaccaucuucaucgucaucgucaucucccuacaagcccccacccccagcggcucagacuuuacucagcaacuucaaagccgcgucuggcaccgggacugguuugaauuaagguucccuuuucuccuacgagucuccgggccugaggagaaagugccggcugcuucuggauuucauuaggggcaauuuucuuaucuuuucuucgucuuaggcuugauccccugaaaaugcaauguggcaggcaacgggucugaauaacaaggugcugccuggaaggcaugcauuguccccggggggcccccgugggggagaagagcagaagaaaggggaaaaccaauuucugacccuucuuccccaucaucggaugcccagggaaccauaaauuguaaacuucaaagugcuauuuuacauuaaaaucaauaaaaaaaaaacccugaaacaauuuuccuuuucaaagaugcuauuuaagcuuuaaaaaguucacuugauaagguauuaucacggacacacuuggcaggagauuaaagcacacgccaagagcaacucagaaaggcacguucauccuaaaggcuggcugggccggccggggccuggggagggggagugacccugacggcagacgcccauugcugcuuugggccugggcuugcccgccagcagggaugccacggggugaggguuucaccccaggacccaagagccgaaggcaccacugagaaacgccuauggggugaggguggcuccaucaaaaccuggccugggaccacugaccugaaagagggcagcacccccuuucuccccguccaccaggaaagcccugccuucucucucugcacgggaauuuggccacagugggcccugggucccccggguggcaccaguguucacucaggcaggaaguccaucaggcagcaugcacaccucuuaugguggccagagacuuugcuuucagagaagccuccaaggggggccaguucucuggggugacaacuaagugaggggcaacgggagcacauuccaugagcagauggugacacgcccacgccagggguccgauuucauaugagcucauuuucggaagugguacacauugggggacguccuucucucuuaaauuaggcagggcaucugucaacauuacauuaaaucugaucaagaguaagaagaaacaucaaaaucaaaccgaugagaucaggggaaaagugguucagguacagaucagggcagguccacugaggagcagaugaacucccaccggcacagcccgggcucacugccggagcagccaagcagccugggcuccgucagauggggucuguucccucugggaaccacugagugccuggggaggggggcccacguguccugggccagggccuuuauguuaccagaucucaacaaccuuuccaaggagggcaacggaccccaguuagagaagagugagcagacacugagaggggucucgugacuuauucaccguccccagaaagcaugugguagaguccacacaagacguuuacacauguccuugugaagggccucaccugccggagacgugcauacucaggugcacacgaagacaugugcaugcaaagacacacaagcacacguguguguacucauauacagaugugcacacacacacagagauauacacacaaagacgugcaugcaaagacacacaagcacacguguguacucauauacagaugugcacacacagcgauauacacacaaagacaugugcaugcaaagacaagcacauggguguguccucagagauaugcacacacacguauacugcaugcacacagacaugcauccacacccacacagauguguguaacacacauaggcauggacacacaccugcagacaugcacauggcuguagacaccugcacaagcacugagagacaugcacacagaugaacacccacccacacagacacacacacagaugaacgaacacccacccacacagacacacacacacagaugaacaccgacccacacaaacacacacacgcacguggacacacacauaugcagacgugcacucacauccauacacagacacaugcacacacgucacaaagacacgucugcacacgugcguuuuauauguauguaaaucagaacaagaccauggagacagagaaagagaaaagcgcugaagacuguauggggcuuugacaccauacugacagcguuuucuaacagagacacggcaugucaggcucagccacgcuaauaaaacccuucuccucacguggcucugggaaccgaugugggcugugggcugcugcccuggacgcccgucacuccaccacggcaggugaagcugccauuuuaaaacgaugacaagaaaaccugcgcugcucagcaucccauuuugggucacaggaaugaccccaaucuggccuagaccaaaggagaaggaaccgcuugaugacaaaagcaaacacugcgucuuuaaacggcgcgcccugcggcuaaaugcugaagggucacagccacacgaaggaaaugggagggagggcgacaacugccuuugauuuuuaggaauaaauaaagaagaaauacuuauuuccauuggacaucacaucacaggagguuugcggaagaagaauuaggagaucaugagacccugcaggucuuugccuucguuucucaugaacauaacacucugcacaaaagucccugccucugucuccaucacucucucaccaucgacccaaagugagcuccugguuuuauuucaugcacaaaagggagcacuaagagcugaugguaagaagauagucgccaagauuccacgcuuggcacugaagaaugaacugagacagcuccuccggaccccacagccccguucagccacagaccaguuucagacacgcucaucuccaacaagugcuuccuggaaugugugcacagaggaaaagcugcuacuucaggugucaugugaagccgggaggcucaccugaaggccgccaaguacucagcgucucccauggggggguccaggccgccggugaaagccauguugacguugaaacccacgccgggcccugugcccaccuguggccagaaggagagaaacacacgucauggaccccgagcgggaccugucugacaggaacgccugaugcagguggcaccgggaugggcucggccuuggugggccccuggggagagcccacguguccugaucuccuggugcauauucauuaagacgcgugugaaggggccccacugacaggggcacacugacaucagcaagggggcccuuuuccuggcugcuguaggcucucgccgacccugcccuuggcacaccaaggcccugcacugacauuucugcggacccgccgcccuguguugugugccguguguuacaucagggaaucagaccugggucucucugggcagaaagugucuccgaugagccugucauuuccuacuuccucuaaaaaaauaauauccagaggcagacggagcgucuuccuggaugaaagcccugcuguuggagccucuguucagagugggcaggcucugaacggggaccuggggcguugucaaggagccgcugggccugccguuccuggggccgccaugcagccccgcgccgggcaaaggacaguggacagagccccuugccggaggguguccuguggaagacaguggccugggcccugcccggaggaaaacgggcaccacacaccuccuccuucacaaacaccucugucugccuggaugggaaccagaaacaauauccagccucucauuuguacuucagacaaaacacaggccaccugugcacacgcgauacgaugcaggcugacgucugacugaaguuacugucugggcuuaagugagcacgaaggccgcacucacugcugccgggcagcuguggaccgucugccccgugcccccacagcggcuccccgcagucccccuuuccccccagaggcccuuauauaccccaccuaccucaucaggagccccgcugccugggaagaaguucccaucgucguagcgguggagggacauguacaggacgcuggggucgcuguagaaagccugcugggucccguuuccauggugcacguccuuaaagagcagggacaacuacuucagggcugaggcagguauuggaggguggccuccccugagggccguccccaaccccaguugugcuuagugacaacggcuccugcucaggaaugacauuacccuccagcugggcccguacccggcaggcgcgauucuggggcugugugggucagggcuacguggugcagggucgcagggguucuaagggccaauguucgcgucugcagcacuguuucccucgcccuuagcgccauggcacaauccugacuccagcagccgauggggcuggaguucagccaggccuagaggccaccauuucccagacgaagccaucugaucaauuuccuacaccugccgugucucugacaagugagccacuuccucagccucugucaggaaggaggucacuggcuguggccugcccgcuugcaggcacgugggaggugccaauuccaugccaggcagggcguucggcaggagacaagucccagguguccgugagugacaggcacacacaguacgggguccaggccccugugcccaaauggcaagcaccguuucuuaaucacaaaacccacaggucagaugcagcagagagcacaggcagccuggggcuuuacugaccguggcuguucugccccgggccacagggcagguggucaccaggaugggcgggcgaggggguggccccgcugagaacagcugugugccugagaagacagcaugcagcccugauguucccagcacgagaacuugcugcuccguuaucugugcucaucacagaaaaggcggaagggcagcuacaggugaggagcgauggacaagaaccuuccaccccacagaguagguaaucgcugugaagacgcacauggaggcuuucccgacauguggcuucacacugagaugacccuguccgcaugguguguacaugggcaauaucacagcucagcgcgcagggagcacgccacacagggucuacgcagccugucugcguguccuagcgcuucacucuuuuggggauggguccccagucuuuagccaucagcgaccucacacugcucucuucccaggcacuccuaccugcucccuuaggaggagcugagggagggcucccggcucgcagguccuugggugugggggacccgcugcucugccgcauccccugaccugccucuccgaaacagcauggcuguccuggcugugccauauuguuucuuuacccaaacucagaaggacuucuccaauucaaaucauaacccuaccugacagggccugcuuuuuucccuuaaaaauuaugaaauaaaucauaaauaccaaagagaacacuaaauauguauauaucuggcuuuaaaaagaguaauaagaugaauaucuugaauauuaauuuccgguauaagaaugaguauaccuauucguggaauucagauucggacaucauauagcauuauuuaaaaagagaugacucuuuugggggcaguggcaccccccauuccagcaggaccaggugcccacacagcagcaggaaggcacgggcuucacuggggugacugagaagcagacugccgccuucgaccagggugaggguccucccaggcucccaggccacacacgcaaaguagauguggacacagccuccuccccaacaccugucuuccaagaagaucucgucgaggguggcccuggccgcugccgucacccacaggcacauuuuuagacacgccaggaccccauucgccagggucggcugacggaagcuguacaaugacuuguagcagguuuggggcuuuacuucuccgcaucuuugagaccguuuccagaaaccuaagcuucccacauccaagagcccagcuccucuguccacacgcugcuguccgcucggggacggcaaaggagcaaccugagcugcgcuggccaaggcggcucugcuuacccaguccacgaugaggaucuugcucacgcucaaccucugcugcagaagcuuggcugccacggccacggaguugaaguagcaaaagccccugcgggagagaacugacgcuggagacgaagcgcaggugggcgguggccaguuucuccacggcccgccagagagccacucgggguccacgcagaccuaagaggucucugugagugcagagcuccugaauacgucgcagggaacccucagugaugccggagaaucgguuaacagacagacacguacacaccccacaugcagacacacucacacgcgugcgcgcgcacacacacacacacacacacacagcucccaaacaagccacuggggaaucuuagccaaugccauagggucggcuaaccgacacggacaugcacacaccccacacagacacacacaccacagacagagacacacacacaccccccacagacacacacaccacagacagagacacacguacaccccacacagacacacacaccacagagacacacccucccacacagacacacacaccaugcaacacgcccuacacacauacaugccccacagauacgcccauacaccacagacacacaccccacacacacuccacacagacacacaccccacacacaccccacaccccacagauagagacacacacaccaugcaaacgcccuacacacauauaugccccacagauacgcccauacccaccccccccacguagacacacaugcacagauacacaugaacaccccauacagaaacacucacacacacacaaaccacagacacauacaagcacacacacacauauacacauaagcauauaccuaucacacacauccacaguuccauacugagacagacagacacacacacacacacacacacacacacacacucuccugcuuggaggucccccacgcuccucugguagggaacccuauuucacauguuaccaacauuucccucaucuucaccuggaacccuuccucucaggagcugccgccacgccccaggagacauggcagccguucaucucaguugcuuccugcugaccuuccuauauuccaauacauaaauuaccuuuaauuuuagagagucuuacucaagagaccaagaaaacaagcuaugaaagugauucaaauaacaacgaaaaccuucuugaucucaaauucccuuuguccgaaugaccacagaaacggagaaacacuaguuguuuuguuuucagaauccgggcuggcauggggaagcccacacgccccaggacauccuagacgcugagcuccugcagcggcucacggggagcacagcgaagagcugcaacaaaacacaauucguuugucuccucugagguuuauuauuuggaauauccaacaacucagguucaaauuagaaaagaaacuucagagaaaugaaacaaacaggaagccuggugcccaagugacuguucugggauguggagcaaacacgugguuuucagguaaagcuacaaagauuccaacaagcaucccucccuggcgguuacaaucuccucccuguacacgaaggacacucugcucuaacacgcggaucugacuaucucucacguacaaucuccucccuguacaugaaggagacucugcucuaacacgcggaucugacuaucucucacguacaaucuccucccuguacacgaaggagacucugcucuaacaugcggaucugacuaucucucacguacagucuccucccuguacacgaaggagacucugcucuaacacgcggaucugacuaucucgcacguacagucucuucccuguacacgaaggagacucugcucuaacacgcggaucugacuaucucucacguacagucuccucccugcacaugaaggagacucugcucuaacacgcggaucugacuaucucgcacguagucucuucccuguacacgaaggagacucugcucuaacacgcggaucugacuaucucgcacguacagucucuucccuguacacgaaggagacucugcucuaacacgcggaucugacuaucucucacguacagucuccucccugcacaugaaggagacucugcucuaacacgcggaucugacuaucucgcacguagucucuucccuguacacgaaggagacucugcucuaacacgcggaucugacuaucucgcacguacagucuccucccuguacaugaaggagaaucugcucuaacacgcggaucugacuaucucucacguacagucuccuccccguacaugaaggagaaucugcucuaacacgcggaucugacugucucucacguacaaucucuucccugcacacgaaggagacucugcucuaacauguggaucugacuaucucucacguacagucuccucccuguacgugaaggagauucugcucuaacacgcggaucugacuaucucucacguccugccggccccuccguggacgccugacuucccaggggugacagggaggcccuuucccgggccccugcgguucugucuuguucugacugcuuccuggccacagccugauagugaacuuguaucugcacuuguucuugcguugccaucugacaaacugcugcuccaacucuccaaggcagagcccuaugccaccuccuccucaccgaagcuggcaagaucaggcacgccuucuccaucuccagagcauggggagacgcucuuucuagcaccaccccuccucacuagagcggcuaccgucccaggagacagcaugcucuuugacgggauagaucauucauucaccacccaggcugcaaggcacuccacagacagcugcgggucuguccugccacuggcucuggacacacagggauggauccgggaggacccacaccccacacucgccacccugcccagauccucagcuguauggaccgucggcagucucugaaagacccgaaacagcaucaggauagcugccugcauggacguggcucuguggcuugcugcgucaguaccaggcauucggcaggcagcuaaaaggccaugcgcaaaaugaccugaguccucuagacaagcaagugcugcagugacucacuugagggugagugguguuuccucucccaaguguugacaacuacucaacaaccagaggcuucucuggacuaaccuccacagacccuuucccauccuuuccucugaucugucuccgucauaaccgagcagugaugcucgcagacuuuggcaucugcacuccacacccaggagcuggagccaagccggcaugcggcacauccuggguggccagcaaacagcagcccagcuccccgcagucacucacacacccacccagcccuaagggagggaaggaagaccuggguuccccugcugugcggggcugcggcguguacucacaugggcgugcucuccuccgcaugguguccaggggggcggaccacagcaaagccauucugcaggugacaccagacagccaggagagagcaacaaaagacacacuuuguagccacgggaaaaugguugcacacucaacuuuuagcagaguugggcuacacaggaggacaguuucuugcugcacccuggccacagugauggggacaggaugcagggccagcugggagccuuuccgggaagccugggcccuucuccuaaagaggucugggggcuacuaaugguucccccgaaacgcagucacuaggauaacaggugggugccugcccacucucagaacugucggugaggcguggugcccuuggcucaggggucggggugauguggaaaggaugugcucacuccccgucggcucgggaccaggacccgcuagguggccacuggaggaagaugaagcagaaggggccccacucaaggacuuggccgcggggcagagacguugugucccagcuuggccuucacgugacugccucuguccuuacugcaguucagcucucaggauggcgggcaagugggcagcccacgaaacagcuccucucacacugggcagaaacgcuguccucugccccaucacuucugcgucaaaaauccaucugcaaaccacucuguaguugcugccauaaaaauggauuccaguccucuccuggucucaccagcaacaggacacuguguggucaaggucuguaaugaagccucaaaaaaagugccggccaaccaugagugacaaugccauggacggggugagccggacgccgcagggaccaggcucaggaaggggcgagggcagcccaugagguggcggcaaacgcucucaagaggcccuggccucccugcguuucugcacucagugcuuccgaguguaggcugcagaccccucggucccgaccccugcugagggucuguaguccacguaguccugaggcucuauguacucuuuucacugcccugacaccugcgccgauggugcugaagcaccggaggguagacggcgggcagggaacagcaccagggcgugugugugugugugagcagcuucucuuaacaaugugcucgaugaagcaguauucagacauuuuaguagaucuccgcccucaaacacguccuuuuaacaucccgaguaaagagacgggaaggaagcgugagaaacugugagcuuuccagugaaaauuacaaguuuggaacacacggcucugccccugugagccugcuggcucucucacuacuuauaagacuucuggugagaugggggugauauuaaugguuucaaaaauuaaugacuuuuuugauacuguaugggucagaauauggaagauccauguaacuccgugaagcuaaguuuccaaaugaccaacgcacggugcuaccaaucacccaugaacgaaggaucgauuugaucuccaagaagggcuaaugguucaguuaaacaaaacggagggggaggaggccacgauuugauuucagauccacacugcagcuaauuuucaagacacuaccacuugcugaauuuuugguauacugucaaagaauacccacaauuagaauaccucugaaaagucuauuaaaauccugcucccauuuccaauuacguaucuguguggggccaggauuccuucauguacuucaacaugucccaagaaugacgccgggcaggugugagaaccagcugcuguccacaggcaagacauuagugcuauuuuuauuuuuuuauuacuuuuuaauuuuuuaguuuuuuuugagacggagucucacucugucacccaggcuggagugcaauggcgugacucggcucgccgcaaccuccaccucccagguucaagcgauucgccagccucagccucccaaguagcugggauuauaggcaugcgccaccaugcccagcuaauuuuuguauuucaguagagaaggaguuucgccaaguuagccaagcugcucuugaacuccugaccucaggugaucccccugccuuggccucccaaagugcugggauuacaggugugagccacugugcccggucgcuauuuuuaaauuaauaaacauuuugaaaauuucucaguuguaaucucuaauagagucaauauuguggauauaacucauguaaacagaagcucuuuggagcuuuuuuuuuuuuuuuaagaguauaaauuuuuaagaguauaaaggguucuuaagacccaaaucauugagaaucucuguacuaugcacauacccuaucacaaaugugggcaaugucucuuugauucaauagcgaggcugugcugacagagugggguccacgccuccccaucacagccgccucccagccugaugagagggagacggagugggcggccccuccccacacugggaaucuauggcaggccuccuggagggccaccacuguccaggccccgacugaccuucagcuccccuguggccaccuugaagaccagcucuaccacgcagcccacagccaggcgggcugcccccgccgagugcaccucguuccauauggugucacuguccaccuguggaaacaacaccccacagugaggucacccucccaggccaccgucaucaccagcccuggcugggcagagcagcucagguuccgugggcucugcuucugaaaccccagggccuaccagagccagggcagcugcagcccacguucagccuucaaucuuuuuaagacaugccaaaaaguuuaaacaggaaaauacaagagaauuuaccagaagaaagaugcauguguccugaccuguucugaggcauccuccuuucccucaauugcuucaguauacuuccaucuaaaaguaaugaugucaaggugaucuauuuccuuuuuuuuuuuuuuuuuuuuaacuggaacuguaguuaagagaguuauucagcuugaguaucucugaucugagaaucugaaauccgaaauacuacaaaagcauuuuguaggcugaggcgggaagaucacuugagcccaggaggucgaggccgcagugagccaugaaugcaccucugcacuccagucuggguaacacagugaggcucugucuccaaaaaggaaaaaaaaaaaacuggaaacuuuuugagcgcuuacgugacgcucaaaggaaaugcacucuggagcauucuggauuucagauuuuuggauuagggaugcugaacugguaaguacaaugcaaauauuccaaaaucugaaaaacaccaaacucugaaauacuucuggccccaagcauuucggauaagggauagucgaccugucaaauaauuagcagcaaaaugaaauguaaggggaaucacgaccagucucuuccaauagugacuuucuccugugccgaguuuaacuggaagcuccacauguugaccagcguagcuaagcgggacuggccgugugggcgggugaggagagcugcccugcucugcccuagugacgguacacggcucugccuggacaccagcaagucagcccgcuggccuuuuccacuucagacagaaaacguguuucacacaaacacgucaacaauccccgauuguguguuggcucauuuauuuauuuaggcacaccagaaauuucuuacagcccuggcucaauucaggaggaaagucgacagacagagaccuggacagccaguucugcacagagcagucuccuaugggagucuggccaggggagggagguguuaagaugaaauacacagcccuugggcuggccccagggaaccugagcaucuguccccaagugugucccuugccugcaagcugcugugggguaacacaccggggacuugggggugcccagcccgguggaggucuuagaagccgugucauagguugcucagcuuccacacggugcugaccagggcgauugcagguccauugcaggacgccuccuucucaaacugagccccucugagcgccgagugcuuuggggcuccuaagcaggagccaggcguguccacccugccucucccuuccccagaccaggcccucgagggcuccuguccaccaccaggcagacuugccacuugauagacaccgcucauuauguggggagggaggauuucuuuccaggcggucuugaagcuucaucaucaaagcaaggugaguuaaaaugcauuuucaaggggcugaagacauuuccugaaguguauucggugaugguuuucuuuucaaaaaauuagccagaugugggccgggcgcaguggcucaugccuguaaucccagcacuuugggaggcugaggugggcggaucacaaggucaggagaucgagaccauccuggcuaacacggugaaaccccgucucuacuaaaaauacaaaaaaaaaaaaaaaaauuagccaggugccguggugggcgccuguagucccagcuacacgggaggcuagggcaggagaauggcgugaacccgggaggcggagcuugcagugagccgagaucgcgccacugcacuccagccugggcgacagagccagacuccgucucaaaaacaaacaaacaaaaauuagccagaugugguggccugggccuguaguccccacaacucaggacgcugaggcgggaagaucacuugagcccaggaggucgaggcugcaguuagccaugaaugcaccgcugcacuccagucuggguaacagacugaagcucugucuccaaagaggaaaaaaaaaaaaaaaaaaauccaaggugacaucgcaggagugagagcugggcagggcaagauucugccaccugcucugugucagccagcagaggcggggucccagacaggccaggccccgaggcugccccuguggggacagcacccagagaugguuucucuccaacauacaaugaacuaggcuuugggauuaggccaacacugcagggagcggaggguguacuacacccguguucugaagggucuucuggggauucugcacaccuggggugccaaggagcugcucggucuaccaggugccugugucugugcccccucccaugggacccugggguucagaagcuucuggagucuugcacagagugaaggacaaagccccagccaaacugcaggaccccaguccccagagaacucaagagacccuccuucgccugcuucaggaccacggcuccagcucccagggaccagccuggagcuccaggccucuugcagggagccuggcucaggcgugcagcgccaccacugagcaauagccuggcucagggcaggcggccgcaacugcuaaugcaggaaggagcaaauggcucacucuguguuucguuucuuuuuuuuuuuguuuucuuuuccuuucuuucucucucucucgcuucucuccucuccuuuucucucucuuucgcaauaaagacaggaaaaaggcggggggaaacauggagaaagcuucccacggauaaucccauggagucuaaaagggacaugccgagggcuggcagggcugggaggccuuugggaagcucagaggagccgcggggagccgggcguacgagagcaggccaggacuccgcugggcgaggccgagcagggacaccagcuccucacccaguugaaacuugcggucacuggagaggagcaacgcaggagcugaucugguuugaaaaagaggucaaagcacuuuacagcucccauuucccagcgccgaggaguggugaguuuuccguguuccaagccccacuguucugccuccgggagaguuugcagcugcuuucggggaagguggcuggcucugcucaccugcucugcccucccugacaagagcaccugcugugugcccacacuucggcucccgaggucuacuuugcuccuccugacaccccaggaggcuggccccuccuggcucuggaggagacaugaggcucaggagagcugcaucugugccagcgacagcaggugcaucccacaccagggcaggggucugcaccggccuccugucugucuucuuccuuuuggaaaacaaugggaagaaaacacauccugccgguggcuguaccucaggaagccccacggccugcacuguucccugcccaugccaacaggcuacccucucugcccgcguccacguggggagcuuuuccaucagcaucugcacacccagacgugagggugcagcucucaucugcugugccucagaucuggauuuaacacuugggaggggcugcugggcucacccccucagcucugagucugcacuuagcuuucauuugcaaaugauaaauucugccuugcacaggcgugcuggcugcagggcagugcaaauucaauccuuuucaagucuggccaaaaacaugccccaaauuaagagauugcagccuauuuacaauacaaaauaaaauaacucuaggagggcuugguggugguaugaauaaaugccguuuauucucuuucugacgggauaauuuucaaagcagugauuuuuauaaaaacucaggaagaaaacaauuuuguuucauuuccauaacagaauccagaccuugagcuucacccugcgaucagugauuacacacacacugcaccguuucggcugcagcggcuccugcuguccaccggcucccguccucccugccuguaaccgucuguggugauucgcggcacugcaggaccaugauggcccggaucugcucggacgcuccgccucagcuucucauggccgcccucgcuauugccaccccugcccaggcugcaucaaggaggucaggggccaggggagaacucuuuuguuauugagaaguuugauugcaagaccugacccuuccuguguggacggaugggcagaugcccagacuggaaaguccuugugaacuuaugcgcccaggccagguccauaucaucagcucguagaagccagcacagcccagugauucauaugcccaggccagguccauaucaucaguucguagaagcuggcacagaccagugauucauaugcccaggccagguccauaucaucagcucacagaagccagcacagcccagcgaguagcccuacagacuccacguggcccaugaguaucacggucacugcacugggagccccaccuguagcuucggguggaaacuagguacagaauacagaagcacgcauccuacccgcaccauacucguggccugaugugagcagauuacugccacagacuucgaaggggaugagaugcuggcugcauacaggauccuguuucuuaaagcgagagccacugcaccccagagccccagccaccugcgccagacaaccuuccccagagaaaggugcccgagucggcgaucaaaacgcucucggcucacacggccuuugaagccgcacaugggcagccccugcguauggaaaacaccuggcagcaauuauucacuuugagggaagcaaggcugcgauuucugugaccacugggacucgagaagaaacaggacauuauuuacacauuaaaggaacacuuaccccaacaccaccgcaagggagccggacgaacacggaggcgagcgagccugugggggggagggagacggucagagaggccaagggcacgcggccaaggugcucgacaggcccugggcgcacuccggggucuucaguggcacuugggcauuugugggacaacgaggggccacugcucccccuugugacacccuguggcccugcugcagggucagugucuggcccuuagaggugccuugacuccugugagggcugagcugggucacagacccugguggggacaccucaaauuguuguggcaucagccugucaggggcccaggagaggcaccaagccacuggggagcacgagguaccccuggugggcgucugccugcagcccgugccccugaggggcuguaucuaacagcaaauccugcuccaggaccccgagccuggcuccucagugagcuccuagggcuugucuagcagcccccucccauggcaaacaaggggcaagucccgggauuaaacauggguccugaggccucuuagacccugagauccucgggaauguaugcagcgacagccccucccugcgacacaggcggagcguguacagcugacugagggcuccaaggacgcugcagcugcacgccaggccuccucccauggaaaucggggcccucgaaacccccaccccacugcucuggcacccgcgccugcuccggcagugaaagugcucccaggacaggggugcugucuuuuuccuguuugacccagugcuggcugaaugcacgucaccagcuuaaaacccaucuguggaggacaagagacccccacuaaccaggggcgggaccuaccauuccuagcggcugccugggccccaaucccucacucuccgcagcccccggccccuuccugggcuggagcuggagugacaucucacaugcuccagggagacuggcuugauguaacaggcuccuuuauccaacgugggaccccacuuucuggccucagcugggcuguaccccccgcuguggggcuccucucccauucucagccugcuccagaacaguagccuccacucugugugcucugguccacgcuccuagggcuggcugccgggggccauaggaaggaguuggccauagguccauuagggccugucugccucuugccuggagggcuugccggcccgguuagcacgagaggaacccuuccucagggaacagcgugccuggcugggaagagcaacugcgauggccccaagcugcaggagaguggcuggcacagacgagaagcuaaacagaggccugcuugccuuagcccacggaugcccgcacccccuacggacgcccacaccccaccgacagaugccugcaaccccccccgacaccugcaaccuccccacagacgccugcaccaucaccccaccacggacgacugcacccccaucaccccaccacggaugacugcacccuccccauggaugcccgccccccgccccgcccccauggacacccacaccccccauggacgccaguaccccccacggaugcccacgccccccacagacgccuacaccccccacgaacaccugcaccccccacgaacaccugcaccccccacggaugccagcaccucccauggaugccagcaucccccacugaugcccaccccccccauggacgccagcaccccccacagacacccaccccaccccacggacaccagcaccccccacggacauccacacggacaccagcaccccccacagacacccacaugucccacagacagccacagccaggcccuagugugaggcccgaugcacagagcugacucaggcucuucucacucuguggaggucacagaucugcaucaaggccggaggcuuguagaauggccacguccacggcccggggcuggggagcugccaugccaacagggagcagggcaggaggcaggaggcagggggcagcagcugcagccacuuucagaaggggcucaggggcucccaggccccccaggcaaagggaggauaggcccggcccccaucugcuaggagggcccggccagcugaggggcgcaggcgccaugcagaugcugugacguuuuccagacaaaggccuacgugcucggaggagccagccugugucggagggagcccgcgcuccucuccaccuggccuggcuccaagggcagggucugugcccgccuugucccuccucccugccugggcuguacaaggcauugagccagcaggggcuucagucggcccuggcucucccugcagcgcucagcaggcaugccucggccucuggguccuggcccucacgcccacugagggcagcagcaccagcaugccuccccuuccugggcgcuguccugggccuacuuccuccguguccauggcucacggacccgccacugccuggagucguggcuccugacccugguucccguguccacaugucagcguggcacaugggacaacaucagcuaacacuucucgccugaaccucaugguggucagcccucauccccgcaggcauguuggcccugcucuccucugugccuuggugacagcaaguaguggacguggggcugaccaugcggggaagcggccugcacgccggaccccuuugggaggugcuggggcugggcaggagcuggcgggauguggugggcaagagagcuagugcgcagguggaacgagacugaaaaaggaggagggcgugggugccaaggugccaagccaccugcuguccugcuugcugcccgucgucuguaguggggucaccuaaugccaaccucaccacagugggcgggugcugccuuggaagggcggucauggccuuggugaguggcugaguagcuggggcugggaguggcuccgugggccacguccuuccaucacugacuacuccaacgcacgggaaagacacugccagaaacuagggagcucguuuuccaaauaaugcacgcgcucagcuauaugaauucacaguagacacacguguccagguaucugcaagagacugaaucucuuugaaaucauagccaaccaugucuacauuaaaaccacaagucauccgacuguuuugaguuugcucauuaucuagcaaagaccaaaacaacaaagaaaaaguacacgauuaugcauccaaaugcaugcguauaggaauggaguuauaggcagaguuuuggugacaguugugaggagcccagcggccuccugugguuuggagccacaaucaccaagcccaggccacgaaacguuccagccuggugacagggccugaagcucugcaaacgaccagccuuacuacuugucuguuugccgcgggcuggcagacaggcguucugugccuggggcagggaaggcucggcuccagccauccucucgcugcugcuccugcucccuggcugggaggaggcccucgcugugccaagucauuuuccugccgcacccuacccugagcaucaccggcacccacucgccaggggcccagcucugcccggaugcagcacccugccagcugacaugagcagaugagccacgugacuuucagugacgccuagggcagcggccagccugccucaggcccacgagccaauucagccacgccuuauguguggcaucucaccacaucagaaaggaaauaugaaggcccuugcacacggcuuagcggcuuguggauuccauuaaaagaggaaagaaaaaaaaucacacaguaguguuuaaacaccucauuaggguuauguucacaaaacucaagauaaucaucagcuauuaccaugucugaaauacuuagacugaugauaaugaaguuucuggguuaggacaauugucggaaauucaaaaaucgaucuugaguugugagaagguaaugggagaggcauccucacaggaaugugaacagauuuuaaagcacaaagcuuuccaggaaagaacaagaaauagaaugaucaaccuuccuguaaacaaaagaaacugacuagaaugguugccuucggagaacaggaauggugcaaagggaugcugcagagacacuucaauaaagaaaccaaaaacaagaaaggggucuuccuuuuugaucaucucucuuaaacuuuguuugaaacuagcuuagaaaccuaagcaaggugguggagcuaagccugccuucauccuucugcugguggagcugguccugccuccauccuccgcccacugaauuccacagguuugaaagacugaaggugguaggggauggaccaacagccgguccuuugaaaauggaugaaggugucaggagcagccgccauucugaaaggcguggaggugggcgcacagaacugcgugugugcaggacacggccugaugagcugaugcuuugaggcugcucagcaacucccacgccugcugaagccccugcuguggcagccccggugacaucgaggcaaagaucuuguccccucauggggcccacaggcagccccucccaugcuggagaacccggccagaagcugagguguuacauggggaggcagugacguuuccugguaaggacuggagaauccugagggacagcacacucuagccucagugccucgaugcauggccuuuguccacccagcucccggacagaaagccgccugcccucucugccgcccuugcccucuagggcucccuuccccagccccagcggugcuccccgccuccgcuagguacuccacaauccaugcgccaucuucuccccaaggagcgcgugcccccuuccuagggguagcugcaucagcuucucccugcagggcgaucucagacuuccuggccgccacccucucacagaccacccaguagaggccggccuccaugaugggccucccaauguucuuuugcccugggacagcguguccuccgguggcuuccugaggaagaacagcuggagggugaaagcucuggcccuugcaugccuggaaugccucugugccaccuuccuacucacccggcaguuuggcgggacacaaacuucaggagggcaaugaggcgcccuuaaaacuggcauggccgcaggccccauggagucugcaggugcccuggcucucaccugucccugcauucugaggcucugcuguuucucccuaagagggucuuucuuaccccuggugggucccugcagcccagagacucugccuuuggccuggggccuucugaauuccagacaccuccuccuggccucugccuucccugggaacuccugcuguuuggacccugcacacugcagugagcuuuggccuucuucuccaucaucucacuucccaguuucccagagcugucacguuuugcuccaguuucugggagaugacaucaccguaucuuccagucugaggaggauuuucuuuuucugcggucagguguuuaauuuuugucuucucugaacguucugugcuuuccccuuuuccacugaacuuguccacguuacguggauguggcauccucucugagggugcuaauggcagcuggguuagugccucacacugucugcccccagccuccuuccccuguguggcuccagcuccaggucccuguccagccguuccucgggcccuggguccuccuugguuguccgcuccuaagggggaagugccaacggcuggguggaagcucugggcccacagggggugauuagccgugagugccagcauaagggaucucaggggcuauuuguugggaaccccugaugucagcuucuuuggggcuggucaaauccacagaggggucuccugucugcuuggacgguaaaggucagcaugcuggcagcccaguggggagggguaggggcuuggcauccaugcccucaucuagagcagcugucuccaguccaggaagccccugucuuccaccgucccuuccagagggacgguggaagggugcuguaccccuucuagagcagcagcaggcgaagccgcuguguagggagucggggcccagaggccuuuccaccagcuuuggcccaggcccuugacugagugccucccugaguccauagccucugcaguugcugagccugagcugucggagucuguggggugggucgguggcccuuguccccggcacuagcucaggauccaccucgugaaccugcucagccacaccccggcccaccugcuuccuacugcuguucacucccuucucacuuuccccaaacuugaggcuucuguccuuuuagaagccuccauaccacagggcaggggggacuccggaagcagcgugaccgccaccccaggccagagcccaugcguguccucacagcccuacuggcuccauggucugugaccccgucuguaccuacagggcauccaguacagaaggugcccucggcgaguggaugaaggcgugagcgagugagugagugaacgcaugaaggacuaggagugcaggucucugugaggcugagucugccgggcacaggccuggcacggaggacaccuccugcaacgugugcccugccaaaugcagucaacgagccaggcacggcccacccucuccuugccccugcaaccccugcguucaugguuccuaguucucccucucugccuuccuaggguccugcucagggaagagccaauaugcucuucccagggcaaaggcacagaagauggggaagaaaaccagugggcagugacuguccugguucaggguggcugggaggcagggaaagacguuaucgaggaacaaagggagcccugggaucccccauccccagguccguguucugugcccugggauccccuggcccucggucuggguucugugcccuggaagcccccgacccugggucuggguucuguguccugggagcccccggccccggguccggguucugugcccuggacacccccggccccgggucuggguucugugcccugggagcccccggccccgggucuguguucugugcccuggacgcuccccgcccagggucuggguucuguguccugggagcccccagcccuggguccacguucugugcccuggaagcccccggccccggguccacguucugugcccuggaagcccccggccccggguccacguucugugcccuggaagcccccggcccgggguccacguucugugcccuggaagcccccggcccggggucuggguucugcgcccuggaagcccccggccccacgucuggguucuguggccugggaacacuggaagccccauggagcuggcugggaguucaccugccucugcugaagaucccuguggaaagccucucaccagcuccccgggcagaggaugcccauuagaaaguucucuccaugaggcuaaaauuccccuccaccaccugugcaggugcuuucagccagagccaagacaccagcagccuuucaccccuaagcaguggacacucccuaggccuccuccuggucuugcucugaugggccuuaaagcggagcucaaaacaacuucaggcucccugcagggcagggcgggcagcaugcuggcuguguuccuaaucagccucucaaaccuaaacucugauucaagaugcuucuaaaccaacgguucucagcccaguuuuuacacaaacacaccugcuaccuggcacguucaucaacaaccaguggcuugugaacagagggugaaagguucccuuucaggcccuuuaccuuauaaccuggcaggcgacacccacaggugccccagacacaagggguugagagcuggaaacacaaccucaggggacuucaaacccaauaugggaggaaaggaagguccugaaauaccuagaaguuucuuacuguccaguuucugccgguugaggggguucgugccauacaggagggugugggcuuccgagugcaccgucuguagcuccuccaggguggccuugcguccgcggaugcacuguggggacaggcgagaggacacucacacguucugcagaagcugcugcuucagcuccacagacagaaacuccaacugaaaccauugcccaaaaggaaacuuaauuugauacaaaaacaagcauguuauuugguuacugcaaaagaagaagcaacaucacccaacgugauauuuuaaaauauuuaagaaauauuuuagagggcuuacacuuaauuauagcuuugaaaaaacacuuuaaaagauaauuccagccuucaaugcauuacccuucacugucgcacgaaugacuuggcaucaaauuauuacuuugcuuuccagcugccagggucuggucuuaaaauagaggugagcugcugagcucccucacguucaagggaaaccccagccgcgcucccggagucucugagccccaggaugaagcagccuuccuuggaccgcccggggccacagcugccagggucuggcaucuguccuggauggcuagcuggcauccggcugcgucucucugagguuuggaaauucuucagauugagaucccugggcuaauucagauuuucuccagaaauucacaggaaaauuaguguucuuuaguugagcuacauuuauuuagccuuuuaaaggggacgauggcuuuggacaugagauucgaguuaacauuucacauggaaauggcucucagaggguuaggccaccacaggaugagucagacgccacucagguggccccgguuguggcuguuaccugcuucccccaggccugagcaggaucugcucucucccucccgacugcagcccugccccagcauccgcugagcuccugcaggccucgguguccacccuguaugugagaccuguggugggcgaagcucgagggcucucuaugccagcccagcaccuggggcuccucucagaccaccaggagccguagcacacagccuuccugcaggacgcauugcaccuggggguccuguccaugcaggguggaggaagaaggggcggagccaagaacucaguccccgcccacaggggagagaccuccagagggcaggugcgcugggcagggacggaugcucugcggguucucuucucaugaacaacaauuccacaaaaccgggcuuccucuaugaaggucucuuguuuaacaaagaaaagaugugacacggcuuccggugguaaaaaacgacucuauggucccauccacauaaccuagugcugcuucuacuuuggggacauaagucacaugucccuggaaagccaggcaggagggacguacucucuggguaggggucagggugcaguuggggcccugggcggcugcgggggcuucuaauuuauuuuauuuuauuuuuuuugaaacggaguuucgcucguugcccaggcuggagugcaauggcgcaaucuuggcucacuguaaccuccaucucccggguucaagugauucuccugccucagccuccugaguagcugggauuauaggugcccaccaucacaccuggcuaauuuuuguauuuuuaucagacauggaguuuugccauguuguuccaggcuggucuugaacuccugaccucaugugauccacccgccacggccucccaaagugcugguauuacaggagugagccaccgcaccuggccagggcuucucauuucuaaugacuucaggaagcccacauguguguacaggcacaggcagcuguggccagggccaaguucccucuggacagacgggccuaggcagcccacgcuugggaagguccccguaggggaccacaggcugugcccugcggugccaagaggcaggucauguaguguggacuuugggugaaagaacggcaggguagccauguguguccuccccacucaaaagcgacccacuggauaagagacugaauugcagaaagagagaucugacguuagaccacaaaugaaauucacaaauuaaaguugauguuagaauaaggcaaagaagaaaaguagaaaaacccucuccuuacaaacacaugaaauggacacagaaaagacacaggaucaaagccccaaaagcucugcgacaccgcgacggcuggggcugcaggugcgcgacaccgcaagggcucgggcugugcgugcgggacaccgcgauggcucaggcuguagcgugcaauauugugacggcucagacugagcaccugagaggcuuuuccagagccacucugggagcgguggugaugguggccccuuccugcuuucuugggaggcugaccucguuauuucugucucccuuuaauuccuaggauaagacagaaggagucuuugcuccuuacagcaaacacaggcuuggggcagggugcaaaucccagugguggcccuggucucuguggcaucugacuuccagcccacccacuucuccucuccuuccuggacaccgugccuggaggcaggacaaaccaagcugggcaagcaaauuggccaggagcuguucuggcucccgggaagccucugcaggagggcggggcccgcacacacacauggcuauacucagaggacccccgacugcucagaacgugugaggcagcuucccaaggccugcucuggagugaggcagggagcgagacagcugcacugggagccacgucuugcugggccggccugccaguaucgacagggucccaagcuugcagaaaguaucucccagcccacucucauccuuccucaccacgcgaagccaacucagcagugugaggggagggccucaccccccaggccuccaggcagucgucuacccagagaaggggugcugacucugaggcccugcccucgggccugggcuucggucuugcuguggccuccaagugguccgcggacuggggaagucacagccccauccaccccaucuucuccuaucggguacccacucuaaccaugccccguacccauggccccucugcucggccaucucaggaggccagugaccccuggcaggcuggcacuggaagucuggugggugacgucacgucccccugggcugaguuagcacacugcucgcucugaaccuggaggggcacccgcacuggagagcugccccacgugugggagcaaggcacugcuguccagggaguauggccuccaccgccucuguggcugucucccagccaccugucuuucuccagcucuccucucccugagauccugccaggcucaggucuugucccacagccccaacaccuggggacccucugccagccccuggcccagucguggcuggcaccuucacccauggugcugaggacaggcagaggagccgagggcgggcggaggagcugagggcgggcggaggagcgggcuguuucuuccagggucuuugcuuucucacuccucccucccuugcuugcauuugcuuugcuuuucuggcugagagacccucucccaauccccuggccucagcggaaccuccugggggugggggcacauguaggggagggacaaggaagcagguuauggagcucuggaagccucaggaggccuugggcaguccccagaaggggcagcaggacagcugucugguccuguggagggaagggacguggggaaggaguuuccugcagccagugucugcugggcaaugcugcccuccaguggcacagccguccugaccagaucccugaagcaggugccaagagccucuacaguggcuccuccccgccuuccuccucccuccucccagagggcacugcaggagaggguccugggccugacuuuuagagaauuccccccugaaaauuauguaucaccaauaaaacugguaaaggaaacgggggguaagaugaggcacagauuaaaaguucacaaauaucccagcuucuaaaggagggcaggcgaaccugcagggcgggacccugcagaaacuaagccaggagaccagaggcccuccgugccacgccagcuccacgugcucacucaucucugccacagccacuugggcccugggcugucggguguccaggacuguuggagggguggguguggauguuccuguccacccugugcgcuaucuguaggauggugggauuccugguguggggaguggacauagcaggucucuacuggugggcccuggcauggguggggccuugugcgacccugcacaguguugccagccccucucuacagacaaagaaauggaaauuuguccaaggucaccagcucccagacgggagucucuucucuuccugcccucgcuaucagcagggccuggccacacccuccucccugucaagagcucaagauccccugugacagcugccuccagggugaagagcaccagcugggacagccucaccaaagugcggcccccguccugcccucagguguuaaucggcugauccuucuugccuccuugggccugggaguccacugcagccagauucggggcagggcucugguuccuaucaggaggcggggccgggcccuccuuguaugagaacaagugaggccgcugccaucgccuggcggccagggaaacugaggcacagccagagcugcagcauccccgaagccuccucgugugacucagccacauaagggagcugaauucaaaccaggccagggcccugccugcagcuccauucccuucacgacccacugccucgccagcaccuuaacucugaggagggccccaagggccugaggucucccuguguucucgaagaagcuuuucaaaaucuuaaaaaaagagaaaauuauuuuaacaaaaagccaacaggccugaucugagauauaaucggaucuccccguggcuccuuccuggcagcccugggggagcauggugggaacugguuuccuuggggaagugacccggaggcagaaagcaacagcccuggaccuugagaagagccugcuaggugggaggugggagcgaaacaucaggaaaggucacagacagaggcagcagcuuccugcagggaggguacgggacuccagggagacagccccgggcuucucagcagauagcugcccgcccaaaugcagacagugaagaugcuuguggcccuucccccggggcuguaagcccaaagaaccaccugcaaaaccaacacccugaaucacgcgggcccacgaggguccccucuaauggugcccaaagccgcagcugcccaccugccccggucggcguuaccucgcauuugccccggaggcccgucuccugcaggcgggaccagaugcucuggauccucccggcgugcucgggguggcugcugcuacucccgcaggugcacuggugcuucagcaucagcgugucauacacgaggccuggggcggggcagaggggccaagaucagcgcacauccaggggcgagccgaccacccacuggcaggcugcccccgggugguggcggaaccaccacuucccuagaaggagacggaagcugggacgguucuuuagaaaaauaccacguuugccaagacuccuugacuggccaggcccagagaacguggacgaaugcagaggccaggcgggugggagggccugccugucacucaugcucacaguaacgccccaggacccaggcagggacgugcgcagcugcccugcugcagcaggcugaggagaaaacagugaugaggaggucugcccuggguggcuggaccuugcaggggugagcucuaugugggacuugugcuggggaggacggugcugacuucuagaaggaggcgacucuagcccccuacccucaaagucugccugguccuggaccaauaguaacuccaguucugcuggacggagaacuguccaagguacuugagauuccaaagaaacaccagauucgagcucugccuuuagaaacuuccagagggacuggaacacauaugcuagaaaacacacgcaaaacccauguacacaggucuacuuaaccucugacugugaaaagaggccagccaugugcucaccacagcacugagcucagcauggacgggcccccagggugcggcagccacagaagaggcuccuggugggggccccagaaccaacugggccggcagccuggggcucugcagcaggaaaggcaaugugccugaacccguguuggaugccacccugucucagucagcauacgugggaccgcugugaaggggagaguaucugaccugucugcagaggcuagagaugcgagggaaggccagguggcccuccggggcacagcucugccccggccccuucucaccaggccuuggccccuggugacaccuggcaggagggcugccccgaggcccugccgggacaugucugugcugcacacaccuggucuuccaggacuuaacaaagggaaggccaggcugggugaacagacgccuuccgcaggcaggucacuggccaggggcaccugugcuaauguggguucauccaggcugauaagggcggggcgcacggugaagagccugggcaagcugcccagacagaccugcucuauugcuucagugugcuggcccaggaugcggcccuccccacuuguguuccuauuacugggaacacaggcagcauccccagccaaggggagcugagauucaaggugguccaguguuugcaggguccagcuacaggauacacuuggugcauauuaguucccauacuuccuggcucagccucuugugagucaggcuaacaggagucagucuccugcacuugaggaauucuggagguacuugcacaacagugcugugggaugggacuucugguaaaaaaaaaaaaaaagcaucaggguaggugcaggcuuacaggagucaaugaaacuaggacucacaaucaguacacugugugugggcauggcugugcuugggaguuuguaauggcaacacagacacauaggcaaugacggacacugccccgugaaauacguaagugugugugcagaaacaaccaguugcucacggauacaaggaauggggacugccccuacaguggaaucaucaugauaaggucacgugcgcuaauauuuacuaagcacacggcuggaacuuacgaggcagacaccugcuuuacugccuuuacagacagaaaagcuggagcguagagagauggagaagcggcaaagcccacacagcugaggguggcagagccagccaggagaccacguggcuaaaggaacgcacugcgucgcugugcacggacacgggaagauggcugagagugugagguacuaacagaaagcaucagacacaacagagucccgucucugugaaacaaauuauguuugugucuaucuguccaucuggcuaugcacagaaauagaucuggaagguuuaaagcaaauacuaacaaccugccaccacuggggaguggcauuacgggcaaacggcauuuccuguggguuucuaucauguuuuucuuuacaaugaacauguacuguuuuauaaauuuguuuaaaaaguaaucaagacaaacuaagaaaggacaccaacgaagcgggacucccugcaagucuccugggaccagccagggugggccagcuuagugggaggauucuccuugguggcggugacuggggucucccuugucugagcugcauucuuucaagaacacacuuauugcagucagcugcccaggacuuguggagugggucaucuggcugcuccugugaccuuccaugguuuucuuucugagaagcagcauuuuacuugcuggauaccuacucuggaaauuugucucugaauaugaauagcauccuucuaagaccugagagugagaaccucgcagacugcagaacacuaagccacgugaugagaaucaucugaagaaugaagccgugcuguauuuacagaacauuuuucuuagugcgucauuaacaagaaauauuagaucauaacaacaugaagagcgcuccugccucugugcuugucucagaggcaagcccugccagaagccagcccuccuucccuccucuccccugcagggguggcuggguggcggggcggcccaggacagcagucuccuccccggcucuggcuagcuccaggcagacaaguccagggcccggccccuccugccuccucagccgugguggacgccuuacuugccuccuucuugugagggaaaaccaaggaccccugcuggcagaucgccuccccggggugaggaugguaugagggauggcacagacagaggacguguggcucccacagcgugucccaggggucccgggcucugcucucguguaaucacagccccccgccagccauucacagcccugucacuggagccucagcgucaacgcuguggacgugggcgaagugugagggaguaagcggagaagcgugggcucaugauuccugagccggaccagaagcuguagguucucauggccccacgggcaugggcuguggacuguucuuggaggagaccaugggucucugggacaggaaagugggcaagugagcccgugacagguccccagcaugacagaacugaaggugugggguguagggcggggagagggccucugugacagaccugugugguccccaccauccagcguggcccucgugccugcccagccccuccucagccucugcagagcugggccgggaagagccccccgcgcugugcccacuguggcccgcguugcacccucaggcugcacaaaggccacguguuaccugucgugaaccucggcuugguggggggcuccugcacagacacggggaagguggcagacgcgggugaggacugcgcccgggacagaggccuguggccgccgaaggacacggggaugccggcggccuccauggacgccugguaguuccucagcugguggauccgcugcugcuccagcaggagggcuugcugcggggaagaaacggccguguuggcgguugcggaugucucccgccccugggcugcagggcuagggguugcccucucuugcaagucucccguccacgcacaggccauacaugggccacaaggaugccgggaggccagcugcguggagaggccuucccugugagugcccugaagccugagugggcccagagccaagaacgaggccagcacaggcucugccucccaggacggucucucuagggaaggcaggcuguccacgugggauccugccauggguuacguuaacaggauaacacagguugagucagggggucccagggaggccuggcccaguaugggguaucaaggagggcuucucugaggaggugcugagccaggagcagccuggagcaggugcaggggaguagggccuggcagguguggagagaagcucuugcuggggcggcagccuggcccucgcugguuucacugggggauaugcgaaggccauguagauguggggaccacagcguccacucugccauaccacacacauacggugagugggcacgaagcccaacccccuuguuggguuugugggucuuaguucugaccaacagcauugaaucugcaugccaaacuugggcgagaaagcaccaucggcucucagacuugaaagugccaacugggcuucaucugcagccgcuccccucccuggucucacaucccacacacccucgugcaggcuaaaagcaguaacagcccaucagcuucugggcacccaggaccuuuggggccuagagcaggccugcugguggggaugugccucucugaugagauggagcugggcugggcucuguguguggggggggcacucagccaggggccugggacacccugagggauucugggaacaggcugaggugcaaacccccauacgaggcagaguggaguggagggagcagggcagagaugaggucacagcugccaagccucuccccagacagcagcugagggagagcacagcaaccugccacccaggccgaggcacaaagaaagccgggcgccuccuugcugggagcucugcgccaauccugucuuaguuuugaugaacaaauccugugaacauggaaaaccagguaccuacaucccagcuccuguaugaaggcagagcccagcccugugcugccagcacugggggaaaccagagcuacccggccaggcuccgaucuguccugccuuuaggaaucaggcugggcgugguggcucaugccuguaaucccagcacuuggggaggcugaggcggguggaucaccugagguaaggaguucgagaccagccuggccaaaauggugaaaccccaucucuccaaaaaaacaaacaaacaaaacaaacaaacaaacaaaaaauuagccaggcgugauggugggugccuguaaucccagcuacuugggaggcugaggcagaauaauugcuugagcccaggaggcggaggcuguagugagcugagauggcaccacugcacucuagccugggcaacagagugagacucugucucacacacacacacacaaaaggaaucagagccaggagggagcagagaagaaggaagcccugagacagugggaggagcugcagcaggagcuggagcaggagccagcacccacaggcccccagucugcugcugaccaaauucagcugggauugccgugggccccacgcgguuaagugguuaauaagcaauccuccccgacgcgggcuggaggugccccgccuuauguuuaccucggcaaauugcuccguguacuacgacguuucccugauaagggguucugccuauuacucuccagagagaacagaaaauaaguguuucuaauaaucaucucaugcuuggaauauaacaagccucuuuuucucaaaguaaaggcugaucuaugagaaacuagcccuaaaaauuauuaauguaaauaguuucccauuucuuaucagccuaauaauagcacacugaauuucagaucuucaucaacuuacaaggcccgaccacaggaagaggcccccacccugggccugucggacaggaccuguggacgaguguucaccaugaagcaccgugugugugccagagaggcccggggcuuucucucucugucuuugccaagcguuaguucugcugggcuuuguaguguuuagugcccggggugcuaauuaagaaggcccagaaauuagagacaggccccccucugaacaagaaggagaaauagcacccaaugccagccacugggggaagcucgguggagaagggcuccugacccagaagccucuggagaccacugagcacugaucccguguguggcaggcuugggucuaggugcuccagguacaaggccccacacugauucauucaguggcaagcauuuaagaacuguagcugagaauuaaggggaacaguuuacugcagggcguccugcuccuggcuuccaaggugcugcuggggguggagaugcagcgucuggccacacagcuggcagucaggaagcuggggaggugcucaacggcacggccggcauggaguccagagagaagggagggaacgagccaguggcuccugcagccgaggcagcagcucugcugcuggaggauagaaucaaauccuacagagcugugguuccucggacuggcuuccugccuacagggaggaagccacuuuccugagggcacucuagcugcagauacggggcuccagcuggcugcccaaaugccuuagguauuucugcugacucagaaguuuaauguuucaauggaaauuaaccagucauucacuggccuucuucaucagucuccugugaguuugguuacugggugucagugcccugaagccuuacuggcucugggugccacaaucgcacccgucugucuggaucugcagggcugcucauuagcaccucugggucacaaaaggucuugacuucugaucaggcccugccugccuuuuugaucaauuaauaccucuaguuccuucacuucuuuaaaaagcaugcuguaucucacuaacacauggauucuguguucauuuacagccuacagacaggaaggaaauccauucucuggggccugcgcauggcuggaaagcaguuacguaaccacccacagggggcaaacaucucguaucccuaggaacggcugggacaaaauggaagccacaucaaccucccucacuggccaggacaagacaggugagacacuggacagugaccgcgcaaggaugcccugcagcccccgugaucaccacagaagaugccaccuggggaccgaggguggcugugcgugccagccuucuggugcccuccccgccugcggucaccugucugaagagcagcuccugcucacugggcuggcgcuggcccggcuccaccucccgugggggcucugccucuuccucaucgcucucaaugggcuccugcuucaccugcacgccggccugugcgugcgccuccuucugccccggcagccgguccagguagggcucguccagcagagccuggugcucacggagcuccuccuccgucuccuccggguggcucuccggcugccgggcuggcucgcuuggcuuggggaugaucugcaaggcggagguaacacaugaagcacagagagcuggguccucugagcucaucugacaggagaagggaugcugcaaaccccacccucuggggcagacaaucagggacucagggcaccuuaucacccugccacaggccagcaggcaccuuuaucucccaacaggcacuggggugccugagugccuaagaaaauaaugcccaguaggaccccagcccagggucaaggugaccuggcccagggaaggaggcugacuaacauuugggguuuacuaagcaccucuucugugucaggcaccgagaaacagaaaagaagcugcaggugucaacagagucugcagaggagagcuugagugugaaggggagaggccaaugcugaccucacagccacaacugcuaagagaaacagcccaccacccacucagcggaagacaaccacguccacaaugcucacugcccaaucccaccaacacgccacggccuccccuccugcaggaucccaccgaugugccaugaccucccuccugccggauccugggaacacuccaggaccucccuuccugcugaaucccagggaugccacggccuccccuucugcaggaucucagggacaccaugaccuccuuucuugcaggauuccaugggugcuccaugaccugccccgcuauggggccccaagaaccgcaacauccucccuccugugggacucccuagaugcccccgaccucuuuuccuguuggaucucacggacgcuucucggucucccuccccggccucucagugcggaacaggcggcaggugcuccucuccugcuccccgccugcuccuccgucuugguuuguccugggccugcuccucggcucauuuccccauucuggauuccaaguaucagcgacucccaaagguggugcugagcccaaacucgcucuuuaccuccagaccuaauggccugccagacgccucagcuuagccuagagugcccaugagccccagcacagcagguccaaugccgaacgcagggcagcuucuuccaagccucucccuucucuaggaccuguucuuggcuauugggaccucucucuggccagcuguccagucacaccccaagcucccaauucuguccgccaagcacugcccaugcauugcucacgagaaacgccucuggacggugcugcuucucuccagccucgaccuccugccuuuccugcuuugccccaccuggccucuccugccuggaugacagcauggcuccugggaggcccccaccuccagcgucaacgcuuugcaaucuucuucauguagcagugagggcacgcuuucaaacgggccaguggaccuggucacuccccugcugaaugucccccaagugcucuucugccauccugccucugcugaagagccccuccaucguguggccauguugccccugcagccucccugccacccugcucccgaccacgccgcuggcucugcaucccucaugccacacucgccuccagcccgcugcuugccuuccuuccucggccuccagccacuccaagaggcuuugugagccucccgugcaugucaccuuuuccagggucagcugaucuuccugauagggcaaugugcccuccuccagcaccccccgaccccaguccucuggcuuuucugugguugccauucauguauccaucuuuccugcagucugcaguucccaggaggguagggaccacuucugacucauccacguggcacaggcauugcucaucgcacauucacuaaaaggauggggcaaaugcaagggguguccgcguaguggggcaaaguggaacaggguguauggcugaccucaaugcgcucugggagcugugggaagccagcagggcugcagcguggaaggccagagaacaggaacacagggugccggagacgagguggggcugugggaagggcacucugggcugaaaacaagcaggugcacguucuagaagcaugcccugcugcagacaggccagagguugaaagggugaggccagccccacgucuggcuaaggcaugggagaaagaacagguuuccaugacaccaaaaaggaagcagcucuaggcccagggacagacugcauauggagaggcaagagaggguggccaggacaacuccuucguuuugggcaauggagcugccccaucacaucugggagccagaaaagggaugaaugugagcagagcaaaggcuggaguugagaacaagaggggagagagggaugcgggaaguggcaaaaaaaaaaaaaaaaaaaaaagcucaggagagagggcgggggucuggaguuagacuaggaagggcgcacagggaguuucucagaagaaggcacugacugagcugcauuccucugcagacugugaaagaacgucccacaaucccaaagucccagaucgaggggucucuccggaugcucgauucaucuguccccguggggaacggccugaagggcagauucgagggacggugggacaagccgaguuccuggcagagagaggagcuacagcgcguggaggauggaucucggcaccgcauccgacuguuuccagaaggaaacugaggugugcaaggaagacugacaccugaaaucccccgagcccuugcauuucaacacccuuagagcacugcaugcugcuccacacucacgcgaggcggccucuccagcagccugaacuacggggcacggguuggugggcacucaguguccgcuugcucccaggggucagccguaucagacgacaccgguccccacgcagcagggcugagacgcagacucacacacacacaacauggugaguuuucagccuccagagcccugcugugccucacuguggaacaucagagacuucagauugggcgggggguuuguuuuaugauugaucaucccuuaacuuucuuucuaagagcaguuuaaaguacggcaguaaaagccgagugaagaaaacgcagauccauuguuuaucucuaaaccgaaggcagcuuuucuucagaaaagcuuucaaccuggcacagggaaauggagccagguccagccgggugcaggcagcgugggugucggggcgggccggccaucggcagugugggaaccaguaggcggcguggcacguaaggaacucagcuucagaaagccaaacucgcagggaggagagugcagcgguggguggccgcgcgucgggaacaggaacgugcuguccacgggugagcgugccguugggagaggaauaaguuccgggaccugaugcacaguuugguggccccgauauucacggaccuuaccacagacacaaugagagccccgugaggccaagggggcauggaugaggucccuuguggcgaucauuucacaacgcauacaaguaucaaaucaucacgccguacgcuguaaauacaugcgacuguuuccgguuagacuuucacaaagccggggagaaacaaguucaacuaaggaaucuagcaacauuguccccauuugcucugacagguuucucagugguugaccaaaaaaagcauguguuucaacacuaguuucacuugaugauuuugaggucugugauugcuucugguuucucagucccaucuucuuccugcacacugagagccugagaggcccuguggggggcagggagaacagggagccuggcgguaccgcugucgcugugagcaggggugccaggugcagcaggggcgccgggugaagcagcgcuguuucacaggggaccucgaagauggcauccaagucuuggcuuucaggacacucaucaagagggcacccauacgcucaguuccugcagcucccccagggcccggugcagucugauguguaacgggaugugacugacugagugguguaugggagguuucuugagagcggggcccuuaucacucggugcaccggagggagagcaaagaacaaagaaucugaaagcagaacaauucccuaagaagguggcacagagcgcugaggacaaugcccuggaugaggagcaggagggauucgggaggagggagagcagcagccaggacgggccuucaggaagcaagaauguccuggaggcugcagguguggaaggaaaagcaacaggcuaaggaugaggagacagggcucagaccacaggcugaggacauggggacaggagcucagggcuaagggugcggggaccagagcucagggcugagggcgcggggaccagagcucagagcugaggguguggggaccagagcuaagggcugagggcgcgggaacuggagcuaaggggaacggagcucagggcugagaacgcagagaugggagcucagagcucagggcugagggugcggggaccagaccuaagggcugaggacacggagaugggagcucagggcugaggagguguucagggccucagagggcuccucacaaugugggcuuugcucaucaguggaugggcaggagaggcugcgggucucuccgaggggugcaugguccugccugugccacaggaaggugcuaaugagucagcgcgagggcaggggaaugccugcagagaagcgacugcacagaggcagcagggccgggcagaggcuggcacagaggcuggguccagcggcaguggggaccacccguggacaggagagugagcaggaggcaccaggacuccuggccaagugccagagaaggcaguggggaccacccguggacaggagagugagcaggaggcaccaggacuccuggccaagugccagagaagggccaccacagaggaggugcuggccccgggacggggagguggguagagggcagcucagagaggcugaaucccagcauccgguggggcccugagaaauccagcaagaaagugcagauucgagucugggauuugggagacagaucagaacuggagcaguacgcagguggaauaaagucaaagcugggagcacagaggagcuacgcagagcuggggagcugaagaaacagggaugaggccucagggaccagugguagggugucgggaagcagggaggccacagaggcucacauacagauacauacacacacagauacauauacccgcagaggcacacacagacgcacacagacacacacacacagacacagacagaugcacaaauagacagacaugcagauacauauacacaugaagagacagauacacagauacacaaauacacauaggcacaggcacacagagacaaggagaggagaccagagggccagcagaaggguggguacaaugccaggaaagggcaaggggagaaggaggaaggugggggagggaaaugggggggcggggaagggaaauagggggaggggugggggaggaaggcuaggaccuuagaggggacccuguggggcugccccaucccagcaaugaccgaaguggugugccugccuuucuuuagcagcccaggggccauucugaaguggauaaaagugauggagggcagcaaccccauagaggacacagaggcaggucccuucucuagggugggguggaggacaaggcagcugaggguggaggggagggguuccugcagcaaauggccacucccaggaagccaggcugaucgaggaaaaggguuugucuguuugccuuuuaaaggagacggcccagggaggacucgguggacacagaagcuccaagacuuuucuucugaugcuuuccuuuaaauuucuuuuuuuuuuuuuuugagacagggucuugcucuguugcccaggcuggagugcagucaugcauuaggcaguccucccaccucagccuccugaguagcuggggaguacaagcaugcaccaccuugccuggcuaauuuuuguagagacgggauuucaccagguugcccaggcuggucucgaacucuugagccaaaacgauccacccaccuuggccucccagagugcugggauuacaggugugagccaccaugcccagcuuuaaauuucaaacuuaaagaaaaacuucaagaacucuguaagaaaaucucaaacguccuuccccuaugcacagaugaauggcgguggagguagugggggucauagcgggggucagccucucuuccuggggggcuguuucaggggccccaaggccacugcaaccugccugccugaggcuuucggcagccgcgucuaccgugcugugcaucaggagaccuccccacuguuccaagggcucuuggauggcccuuccccggcuggcugcggauggcgugugcugccaggggccgcaucucuuuaguguccuuuagugacaacauucccaggucuuuuuccucccuuucacgaggaugaagccucugaagugucccccgcugccgcacgccccucggccuggaggagggaucaucuccacaccgugggccuccggcgagggcucucaggcagggccugaggaggaugucacuuuggcaguggugccacgucagagcccucugugacgcaggccaggccccuugccuuggcacugacgcaggcgccugugggucaccucccugggccauggcugcaaacaaagccugcuucucucucucucucuccuuugacauucaguucugagucucacuggcugggcugugggcuggggcugcacugcagagcuggcuuugggaggugagccggacgcgggcaaacaauugaagcagcucugugcagcccgaaggccuuggggacacugagagccccuuucaucaauucaggaagaacaaaugcaccuccauauuuggaauaauuacauuuuuaaaaagucaggcuggaguucacggccaaaaccgaacugguaaacugccaguauuuuaaaacaaucggacacacucguaauuagaccacccaaaauaugaguccaaguuuucauauucaaaaccgaggaugucaaguuaaagggaaacacacccgaggcccuccgcucugcaggaggcagguucuugugcagaguccagaaaccaugggaagaaccaccuugagaagcaaggcuucuugcuguagggguggaggacaccuuccaacgaacguccucuuuuaauagaaagagguauuucgccuggacacacaucacccacugcucgcaaaccagacauaacugaggccaaguccggacguggccagcgaacacggagggccaguuucaccugcagaguuccaagguccacucgcccucugauggugugcguucuccagaaaguuccuucaugcagcaaacccuuauaaacaccacugcauacaaggcacgggcaacagaagcugacacaguuggaaaacaucugccaccaucccgaccacaggcuggggagaggagagcagagccagcucggggucgauccuguccaccugguggaguuuucucagccaaaaggggcagcucugcaggcugcaggccucgggaaaacuagaguggcuacauauggcugcagggaacaccagggcuaggcacgggccgccucucuuucuuuuuuauucacagugauguuuccaaaacaacugcccucuaagguacaggcugaaggaggggcagaccaagccggccccagcugcaaccccaauguaggcuggagcagcgcagugggacaggaggguucacagcugccagagcugggcagaugcccucagggaacaagccccuggggacgucauccuccaagaggaagggccgggacgucaguguuaggcggcccugggcaagauucuugucuuccugggcauccugggaaaacacugucuaaacguuucaaucaacugucauucacucccguaaaucaaucagagaacaaacuccagugagaguacccgguuucuaaauccuucaagaguauacggcaugugaauagguguuuccugucuuccucaaaccuccuaccccaucacucagauaaugacauaauaaaauuaacaaaccuaaguuggcauuaggaagacggaugugaaagugcuuuugacaccugggaguaaagaugccuggcaggcgcccgacacgcccacagccugugcccuucccgucccaaugaggggauuugcugggugccccauccauuucugaugcguucccugcuguccgcugaugagggcuuggggguggaggggcaugugggguggggguggugagccuauuuugugguguccagugggcagcaggggccaggcuguggccugugcugggcaucuggucugacguggcugccacccuggagcaaggccccaaggggcccaucuccucaauccugagccugcagccccaugauggcucacacacuaggauggauuugggccacagccggcugccaucucccaggggccuuccccgacucagccccacuggaccggacaccacgcaaucaaagccuuugaccacugcgccagggcugagcugacuccucuucugggcuggaacuguggggcuugagagaaggaaauugggaccaggcaggcaggaggggcuaaugguaucaggaggucagggcugcgggaagaggcagcaguguuggugguguaggggucucuccccacggcuuuaccucugcucuugcugggauccugguauuucacuuuccaacuccugucuacgugugcuaggaaagucuaucuccuccccaguccuaaccccaauuuuucacccucaggaaaaccacagaagacccugagccuccggacagguggacaacccaggaccgguccugaaauccagggaagcaacgggggugggguggagugaggggggcacuuucacaggagagacaauaaacggagaaaugauuccgucugucgccaaaucugccaaagguuucuccacguuccccucccaucaacucauccucuuucuuccuuguaacagcuuuacugggauauaauucacauaccauccaauucacgcuuuuaaaugauaucauuuguuguuuuuaguauauuuacagagcugugcagucaucaccauaucuaauuuuggaauauuuucaccaucccuaagaagaggcgcuguuccccagaaaugcuccccaucugcccgcagcagcccaggccuggcucccacgagucuguguccugucucugugagucugucuguuggggacguuuuaugugcaugaaaucauaccacacgcggccucucgugccuggcauccugcuuccaaggcuucccgugcugccgcuugucagugucauuccacuuuauggcugaaugacauuccggcguguggccacguuauaugacauuccggcgugccggcguguggccgugcgucauuccacguuauaugacauuccagugugccggcauguggccgcacgucauuccacguuauaugacauuccggcgugccggcauguggccgcacaucauuccacguuauaugacauuccggugugccggcguguggccgcguuauaugacauuccauguuaugugacauucuggugugcuggcguguggcugcguuauaugacauuccauguuaugugacauucuggugugcuggcguguggccgcguuauaugacauuccacguuaugugacauuccggugugcuggcgugcggccgcguuauaugacauucuggugugcuggcguguggccgcguuauaugacauuccauguuaugugacauuccggugugcuggcguguggcugcguuauaugacauuccacguuaugugacauucuggugugcuggcguguggccgcguuauaugacauuccauguuaugugacauuccggugugccggcguguggccgcgcaucacaggauggacaccugggcuguucccauguaauguggcuaucacgacugauacgguuauuacgacugauacgguuuggaucugugucccugcccacaucuccugcugaagccuagcccccaauacuggaggugggaccuggcaggagguggcuggaucauguggguggauuuggcaugaacggcugaacaccgucuguuggugcuguccucacuguaaugaguggguucuggugaggucuggucgguuagaaguguguggccccucuccccaccccuugcuccugcucuugccaagugaugugcccgcucccccuucgccuaccacaguugaauguuuccucgaggacuccccagaagcagaggccaacaccacgcuuccucuacagccugcagaaccagaagccaaucagaccucuuuucuuaugaaucacgcagucugagguauuucucuacagcagugcaggaauggccugaaacagggacucagguugcugugaaugccugagugaguuuacguguagaugugugcuuucaucucuggccgcagagcuguggggccaugugguggcuguguccaaccuuuugaggaacugcuggacuauguucauagcagcucaucucaucucuuaccuuaaagaugcucuaugucaaaugccagcauuugaucaacacguaaucagcauguuaguuuuccucuucacgagcaucacagugcuagccuugccuacuaccuccuccugaaaauggacuuaucugagugacuuucaagaugucuguagguuaugcagaccucugugggcuggccggggcccagaaccagcucugacagugucccuucgacuuccugcuggaguucugcaccuguacaacugcacccgggccccccggcccuguacgcugcuuacccuguacgcugcucaugcacucaggcaggcugcaagugccggauggccugggagaugggcacuguggguugcuaguuuauuuaaagguauguuuacuaaauggccuuaggaaacccaagaaaaaaguguugcccaaguagacuauuccauucgcuggcacugaugcaccacaggcaggacgugguccaguggaacucacaugggcuggugggagagggcacugguccaacggaacucacacgggcuggugggagagggcacuggcccugcgcgucccacucccugcaggugaacuguuccugagcccaagcucccagcagcaucccuucugccccugccccugcccagcucugugcugugggccagagcaugugccuccucgguucccucuuucugccuccuggccucccuuaaggucagaaaggggccagugcugaagccugaggcugaagcgcacagcacacagccgcccuggggccugggagcgcugagccggcaaacccaccuuguucaucugcaguugcugcugcuggaacugcugcuuguguuucuccagaaacugcugaugcugcugcuggaugaccaggugcugcagagccugggcguucuggggcagcggggccgacuggguccgccccagugggcggugcugccgcagcuuguggauggagggggacacccggucugcaccaaccaaggacugugcguggaggggcagugcucccaggccugaaagauaccagucugaagauaauuggaggaagaaacagcagaggggaagaggaagaagagaggagggagagagggcuauugaguaagugauggagacaacugcgcccugugcccgccagcccaggcguucugcccuggugccccagagcuggcucgcuaacugggccccuuccagcugaggcugggggccgugagcuggugcuuugggacuauaggaaccauaauuuggaggcaauuuucuaugaaaaucaggucgacacaggaaacgucaggaguccuguguggcagguuucaaagagcaagcccuuccccagaguggcuaccacacaauuguuccugggggccacaggcccuagaaaaguggguuuuggucugaacagcacggugggaggggagagagggccaccagugugcugaggaaggcugccacgguucugggagccuccacauauuuccaaagacagccugaguugugagaaaaacaauuguccuuaggguugacaucguuuuaaggucucuucgagcacugauuuuaugcacaaagauggcguaaacauuuuaaaaaguccuuaugcauauugucaaaaccccuuucugaaaagaucuggcuaaucccugccagcgaguggaggaugcccacuucaccaacccuguauguuuugauuaaaagaauccauuuugauagaugaucuugcuuuaauuggcaucuguaucuugauuuacaaugcaaccuagugaaguacauuuuuuccuucugcaugcguucaucgagauauauauaaauuguugguuuaggucguuuaacauuuuuccaugguuuugugggcaaaaggaucuaacgaacccucuguccugcucugugaauaucuguuccucugguaaccugagugggguaaacacuaaacuaaacaaugcugcucaggauaaaaaugacccugacccgcucaagggcaucugaccgggugaaaugacaaaggaaguaaccacaccagcucuuggaggcccuggugggggacucuuuggaacucggcauccgccugaggcagccugcuguuccugcugccaggcggggcuacaugccugcugcaagggcuacgggaccuccagggauaccaagguggcccugccggcaaguggcagcuccuguccugucccucccccaggacacugaugccagggcucgcagggcagcugggugugucaucagguuuaguggaguccaagccucccagugagagccaugcugcuuagugcuucucaagucccuuugcaggggcuauuucuaaauuuaagaaauacuacgugauaugcaaacacaaaggacacauccagacagacuaaacccagcaagaccccagcaaggcugcucuucacuaccuuuucaaaaguuauucacuaguguucucuaaaccaccaucccuuuucacccaaccccacaacuuuccggaaagacauguuaucuuaaauuuuaucaucaaugcuuggcuauuaaauuacagugaauaacuaaaaauccauucagaaucauucccugaaaacguaaaaaaagaaaaagguaaaccauccuaaagaaggcauuucaggcugggcgcggugguggcuguaauccuagcacuuugagaggccgagguggguggaucaccugaggucagacuggccaacauggcaaaaccccgucucuacuaaaaauacaaaaaucagccauguaugguggcacaugccuguaaucgcagcuacucaggaggcugaggcagaagaauugcuugaaccugggaggcaagguugcagugagcccagauaaugccacugcacuucagccugggcgacaaacgagacucugucucaaaaaaaaaauaaaaaaaagaaggcauuucagaauuuuucaauuguugacguguguauuacgugggauugaacuacuucacggaggaaauaaggaagucagucacacaaagcugcuuucaggggacgcaaaggcuacguaguugcuggaaaggucucuccucggaaagcaaugggaaccugaaauacauuuuccuuagcguuguuuucccccaaagccucagugugcacaccauucagggguggaggcggugaugagcugcacaguccccugcccaggccugacccucugcagaggagaaggacacgccaacuucauaggauucagcuuccuggugugacacacgguaaggaacaagcgacucgagccagcggugugagugggggcuacacagcgcucccaggcuccuucugguccagggcucugccucccgccauccuccgcaugggcccaggaauuucccaggccaccagcuucacacggggacacaagccuacgccccauuggaacagggcuucauuuucagaacuggugugagcagagaccccugugcagaccggcccuguuccuuuuccaguugcacuccccacggaccagccccucacucucucucagccuaucucgcccacucagaauuucacucugcugccuccagggugcaaaacccagggccgccauacacagggacacccuaccccuggguauccuugaaaagcagcgcccugaccucugcauagcaaugcuauuugcuggcagggugguuuccaauuuggaucccugagaucauuaacaagagcuucugaugacagaccaugauguggucuucaggauaugcugucagggacuuuugagcauaaguccaucaggacacaauucuguggucggugacccagcugcaggggcuggcuguguggugcugggcgggguguggggcagagccuggcuccuguggucccaguggcccccugcucugggcuccuccccugggcaucuuagccaggguuuuuccagcuucugcucuuucugcccugagcacuggcagaagcccuucccugugcccagugcaagggcaacagcugacccuggcuccugagcugacccuggcuccuggugcuggacggcugugucccuauggcugccggcuccugcuccuccuggaggcacuuggggcugggccugaacugugcucaguggccagcuccccuggaaguccauacucuaacacacaaucacaauaauugcaaugacaguucccgagugagcaugcuggaaugcacccagccauccagggucuaaguuuagaacacccugcucagcaauacccaaacuaauuagugagugugcaaaugcaucacuuagacacaccccaccagguauggggauuuaagaaaaaagaaggugaaagacuggauugcucucaaguuccggacccaguuuugaagagcgggucugcacacacugggauucuguuuaggugaugaauucacaugagaugaacaauucagggugccugaguccuuagaaguccaucugguguauuccauugcuuuuucugcaaaauucuuuaaaauccuuccauugagaagcaaaccaggcaagaguuagauccaacucacaguuugcaaucccggccgcccaagggaacaaugugggugcucuggauucgcuuggaccaaucagcaucuguuugagcuucuggggauggagcugaggccaggccagggcugaggaccacagccucgcgugccaauuauaggacaugaaccacggccagcugugcucaagcccuuccugggacucgcuguuuuuuggggaaaugaggccuaaacaguagcaugccaucgcuaacacagaagccaggggcacccuccacucagcaugugacagcgggacagugggucuccacugccagcucaggaaggcuacguagccuuaagacgcugguggcaugcucuguuucaggaugcuagaaagaucugugacagggccaccuccacgaggcauacacaucucccuccaccuguccuuaagacgcugguggcaugcucuguuucaggaugcuagaaagaucugugacagggccaccuccacgaggcauacacaucucccuccaccugugcccuucccucuccgccugcaagcuccuacugagaucucagcuccgacgccacugcuccgggaagccuucccuaggcccaccugcggcacagcccuggucuccagccuucuccuccacaugccuguacuaccaagcuccuccugggucuuggggggcccugucucucggguccugacagcagauugcaugguucucaaaguccugcuucucagccacacgggcaucauaaaggacuuagcugggcuguccaggcaacaaucaugcccacaguuuugcguccaacuaaagcagcagcacagggcucugcacagacacuuuccuucuuacccgggaaugggcuccugagcuccacuccccgccucagcuaguuaugcggagacuaaucuccgaggauguaccagacacucugcaaagaucugaguccacagugaccacgugcggagugccgcacuggagcagcacaugaacagggacauagaagaggcacgcccagccugugacuggcgaggaacugcccggagcggugcggaaaggggcugacuggagguauguggcguguaggaggcagcucugggagacccuggaccauggcucaccccucuggucucugacagugaccucacccacagaggccucuguuucaaagcauuuguggcuggagggcuguucuagcuuugauauccuauacaccuaugcaccacgauuaccagcgauaaggugggucugucugugggccaggaaaacacaggcacugcuguccaggagaccaacucaagcaagaguucgucaaaaacugcaggaaagggcagaacauggaaacgaagaugcagugugauccagggaaggagcaacaaggcagggcuggggcagggauggaagccugggaugagggggcagacgaaccacaccugauggggaaaagggcccugggaaagagcccuggcucugggggcuggcugcggucugguccagcauugagccggcuggccuggcugcuguaccggacuagggaagagaaacgaggcuucuagaggaaggcuggaguuccugcucacaagcugggacuucacuccaggccagugccgcccugccaggaccuucugugacaaugagaacauucaggggacagccgugggccgugcacuggauguggugcacaugugacugagaaacugaauucuaauucugacuuauuuauuuaacagcuccccguggcugguggcuccugaccuggccaguacugcucuagacagcgugggggccuccaggccuucaaggagaguccgguggauacaggaggacagaccggaggggaggaaccugcacaggaggcuucuucccacaagaagauggggcaaucccagcggguuccaaaugagggcccugcucauggcggggcugggggagggccccugagacacugaggacggacaggggcuggcugggggagugagagagcaugggagguggcagguuaagaacaaggcaaugacuacaacaaugaugccaacaccugcaggggcacaugagugcacagcccacuuaacccucaucaggcucacgggggcggaccgcuuaguauccccacuuccuagaugggaaaacaaggcacacagagcauaagcggcuucccagggucauggagcaggagaaagcugggacagaggcggcuguguggcugcacuacgcugcacacgugacacuggcuccgaggcucccugccaggggguuugcaggaugagcugcuggcaaccuggggaggcugugcaggagagaaggggcuugcaggguuuuggagguggcggcauaggacuggaggggcuugcugggcacaggcguaaagcaaggccagagcaagcugggcaaccaugcaugggcccccugguggcacagagccugggcagggcacggugggcagguccccaugccaacgagcaagcugcaccugggaggaaaagagggaugagcgcacacagggaagaagcaacgccgaguucagugcguuucucagagaggugagacccaugcacacucgauauccagguucuaucaaaaaggcuguuuuccaaaaaccugauacacaagauuacgcaugcuauuuaaucgugcagaauaaacugauuuagagaaggaaagaagauaagugacaaacaucucugacgaagugaaucccaggaauccugaagaucaggcacauuuuacguuuuuaaagacaggcgagaaacucagguguccuucacuacccacacucgugccagcugaucuagagcauccaagagacucagacgcaaccucagauacauuccuccagagagauccgcgugccugccacuguggccgcagcucagagaggcacugugagggcugcccccucccucguuacaccacgggcuccucugcucuggacaggcagggacacgaauucaagcuucuggagaaacaaacagaaaggggcucaggcacaaaacaaagauugcgccauuuggcuucugggcaaagaaggaauaagaaggaauccucucugucuaaacagagacacaugggcagcacaaaacaagaaaacaccaaaauccaccagacuagucaagccagaggcccaagcccacccaagccagccccuagccccacgcauccugcagcgcagccuccuacaacacgccaagccccugaguuuucaccaaguucacugccagaguuucacaggugcagcucugaggguauuucagcuuucaauuggcaacaacagguuuccaggaagccaaacacaaagcuaugaagauguacaacgaugacccgcacggcaaggggguagguagcugcucccucauuuauuuauuuuugagacggagucucgcucuguugcccaggcuggagugcagugccaccaucucgggucacuauaaccucugccuuccaauuucaagcaauucuccugccucagccucccaaguagcugggauuacaggugugcgccaccacgcccagcuaauuuuuguauuuuuaguagagacgggguuucaccauguuagucaggcuggucuugaacuccugaccucacgugauccgccugccucggccucccaaacugcugggauuacaggugucagucaccguguccggccggugugcccucauuucugaagugacacuuucacauugcuguugcuauguaauuucauaaggacguucccauuuuccucuaaauuguauuuuucuaaauguaaccacucccccagacagugcacauuuguaaaaguucgcuaacacaaacugaccacaagagucgguucugggcuuccagcgcuggcucagcuugguccagacagaaacccaaaucgcaagagccgguggccucucccaaaaggugagaaaggggaagugacuucuguuuccacuccaucuaccugacucugggagugaggcauggauuuucacugcagucacgguggcuacaucacgugauggggauguguguuugggaacugugggggugggacaggcgugcauuccugucuccuccaaaggcaggcgaaggcggggcaccauccagagcgugggcagccucagagccuggcugcacccaggcccauuugugcucaccugugacgaggggugcuugugccggcggcugcuccaguaagaccaugugcugcagaagagggcugugcgcugccccuccgucccgcuccaagggcgaggugcucagguagggagugaggugggugccggggaaaagggagagccucugcuggagggcgggaagggugagucucucggcguccugcuggcccgccgugcccuggaaagcacagccaggaugcucggguggaaggacccaucaccaccaccccacaccacacggacccacgggggcugacuuaccgcagaggggccgguggcaggcaggcccagcgugauguugggcaaggauggcgauguguagaggggaaguggagcggccgagccuucucgugccacaagucugugcgccaaacucgucuggggacagaacacacgaugaccaucacagucugucacggccaaacaucagcaauauacaccaagaaaaacaacgaugaaaacaccugcacugaauucugauauaugagcguaaacguacauguaacaaaugagacagcaaugagagcaugagauuucaacacgugccacaacaugaaagcacaauucaccacuccaguuuccuccucccgauacgaguucuucuucugucaccuuguccagcaucaucucguugauuucuauucaguuugauuauuuaccacagaacaguuagaaggaaaucuaggcuaauauaguuuacaaugccguuuugcaguuucuaggauaauauaguuuacaaugcuuuuuuguaguuggcaaugucuuuccagacauaacaucaaaggcagaaaacaaaaaggaaauaacauuuaacuguacauuuaaaaauaacuauaaggguaugauuggauuguuuguuacacaaaggauaagcaccggagaggauggacaucccacacuucgcaugacgugauuauuacaaauugcaugccuguaucaaaacaucucauguaccccacaaauauauacauuauguacccacaaaaauuaaaaauaaagagaaaaucauaaaacaacugccucuacgaaaggugggcaaugaugacaauacuggccauguaugaggcagacgagggucagcacagagagcuugcaaaucaaacaacuaacagugagaaaagcacgcggugaggaccagugacggcagagcucaggaaggggaaggcgcucaggaaaacacaucauggucaucaaaaaagguauucugaaacccaacaaauuggcaaacacuuuugaaacaugguaauaccaucuuggccuagaggaacggcgaacacuguugggugaaucacaaaucaguuaguggcacccuuucugcaggacaauuuggcaaucuaugucaaaggccuucaaaaucugucuaaccuuugaugcuggagcuccacucuugggauguaacguuaagaaauaaggagauggccugaugcccaugaagccuccgcugcagggccgagcacccagcaggcauggcagagcuaugcggcuuccccgacaccuugguguuaacagaacggaggggcauugcacaccgggaugcucuggggguugggaacgaucuagcugauuacuuggacacuuguuuaugauacauuaaguuagaaaaacagguuauagaucauguaccuuuuaaagaaugggcuuggauaaagcaaacacaagccaggaguaaagauuagaaggccacacaggaagagucagcagcaacagucuccaaggacuugaacuacugugauauuuaacaucuuuuugcuuguagaaugaacguguuuugcuaaaaaggacaauaguuuaucaccacuauauccccuacacaguagcuacucaaggaaugucugcugaaugaaugggcaaacaaagagaaggaauaaaauguuguuguaaucaugcuaguuagugggguuuggcagauagaaauccccuugccagaagcuaacguuaauaaugaauagauaacagauuucauuauacucucuaccuccaugacagcaacguuuuuagcucccccagaugaaugagaaaaugccauguuugucuuucugugccuggcuuaguucacuuaacaugagggccucuaguuccaucuauguugcugcaaaugucaggguucuauccuuuuugauggcugcaugguauuccacuguguacagcaccacauuuucucugucuauucauccacugaaggacacugagguugauucgaccucuuggcuauugugaaagauccauggcuaagaccucaaaagcacaggcaacaaaaacgaaaacaggcaacugggacucugcucaacuaaaaagcuucugcacagcaaaggaagagaaucaccagagugaagagacgaccugugggaaggggaaacaugugcaagccauucauccgacaagggagcaguauccagaacaugcgggaacuccagcaacucaccagcaaaaccugaagcagccaguauaaaagugggccaaggaucugaagagacauuuccccaaagacauaugacuggccauuggggauaggaagaaacgcuucuccugacaaacacuuacacucaggcuguuccuacagaacagaaagcccggccuucucacuuaggagcaaacucacggcgcaccucgccccagaggaaacccugcaacucccuuuagauuugcucacauauuacauuguguaaggaaugauuaaagggcuacugaggaaaacauuuuuccuaggcaauuuuuuuuuugucaaaaguuaaagaauuaucaguaaguuaugcuguagaggaaaugcuuguguuaucauuugggaacaaaauaaggagacguucuaauguuugcaaaguuuucauuuccuuuguaagcaagguuuuuuuuaagcccauuucuggaacuaaaggaggcuucugagaauuuguuccuuggagaugccgacugguccaccugagaaaucgcagggcguucuggcaucugcugccucggggccgagcccugcgggaggcauucugaggcuggcgcccccggaccgcaucucagcaugugcucagagggaaaguccgcgggccugaggucagagcauccaggcacgcguguaaauaacagcagcagcggccacagaggagcuguccccuuacgcaccugggcgacuuccucucacucucugagcccugccuccucccuguagaggaggugccggcacacugggcuucccuggccuguagaggaggaggugccggcacucugggccucccuggcacuguagaggaggaggugcccggcacacugggcuucccuggguccagggggccuucaagguacaguaguguuucuagggaccccagggugaacagaaaaggcagugcugagagccaggcugggaggccccugcuccccccacauccucauccacucgagacacccccucugacgggcaagcucacuacacucugcaccacgugagaacggagagccagccccuggccaugaagcacagguguucucacagacccguccaacucuagagauacugaaacccagaaagggcgccugggugugauccaacaugcaaaggcugcccgugcccacucuaaugaacaucugauguggaacaugaacaauggcaccucuugguauuuccuguaacuccuucuacauguucuauuaauuuccaguagcuucauuuacguaucgugauuucuaaaaauuaacacagaacuggaaugaugcagacccacccaaacaaggcacuguuccaauauuaacuaccauguacauaagugccucauuuuaaauaaaaacauguaucuaggaccacaaucaacaagaugcaaccaguguuaaccucagggcaggaaguaauuucuagguugcauuauaaggcuuauuacugguagaccucagcuaugaccacagccauacagaggacuguuaaaacuucuaaucaucuaaauaaguacugaaguuggcaggcugaagaagacagguaauaaaagaaaucgauguaugaaguagaaagaguaagagaaauuggggauuaagcagccuggagacaaagggcaaaauucguucugagcaguaauucuagucucuaaaaauguuuauacauaaacggucuugaaauuugaaaugaaaaugcuaaacacucaugccucuguaucccagcuaagauuugccaauccuuuggaagggcaggauucauuucuaaauauuuaagaaggaaagucaauaacuauauuuaauaaauuauagccuucuguaaguuggagagaauucagaaagaaccucccacucaguagaacucugccccaugaagcagacacagcauuuccagcucaacucaucagaaaacucacugcuaaagcguaccccucccaccccugcccugcagucaggcccacccaggcccagggcaccacucagccugcgggacugccucucucugccucucucuucuuccccgugcucuggggguggccucuccuugucaguggggcauuguguggaguguggggcagguccuugcugccugccugguucugucccugggccuggcacaaggcgcucgggacacgugugggauaaaggcagggggcgcaaaggagcucaaggaacacggagcgagguccucggaccugcugcccuggaaagccuccgaguauggucagugugcgacucggccagccugggcgccacuccucccugccuugccacucagcuccugcgucucugacaucuuucccaccuagggacuccaagcguccccugacuccucucuagcuugccaaugucccucccagacuguggcaccacuuggggucugaugaaggcaggggaccaggggugcugagcucugcggucugagaugccugguucccgugaugccuggaaaaguuccccgcucuguggcuuuggccggcccugccaugcugaccacgggugacgcuccagucggcccugacacauaguuuguuggccgacaucguguuguguauuucucaauacaaaauaaaaaauguuaagucucacuuagcaacuauacccacgugcccacggccucucagccacccucagagcacuggcgaccacagcgagcugggcagcagggauccuguccaccuagagcaccugccaugcgugggcuugugcugggacaccaucuagugacaucugcucuggaagaggucaggagaaaggaccaggcucagggcuguccccgacgugccuggaacuagcguguucauaaugaaaggagaugucugugaugagaggaaggcaggagaguaaccuccaacugcguccuuuuuaggauggcucacaggccacuuucccucaccccaaauuggaaggugaagagugaagggcaagugcaaaguggggucauuucaagcucauccgucccgaguccgacucuagccguaggacacaggacaaacgcuucgcacugaccuccgccgggaugcuggggacggcgggcgcgauaccguucuccgcgcugacgcucccggagcuguuguugggugagcuggguccggagccuggggcgcugcugcacgcggagucugcggaggcagaaauacccuggugaguguuacuccaugcggagggagggccgugcugaccuguggcccgaaugcccggugccuuccacggaccugcucguuagcuugcgacaggcagaagucccaacaaaaagaacauggccaugguuucaaaaaagaaaguaugaugcugauuucugauuuuccaguuuugccacugacuucacuuuuucuaggacauguacguuaccaauuuuauaccucguuugauuuucaagacaauuuuaaacaccaaaaagauaaauccuuaaacacuuauuagugaccuaacaacagaagaccagaaaaugcagaagcuaagugacuuugaaaagcaaaaggucagcuuuccugugcucacuauaaaaagcuuaguucaaaauaaagcaaccuacuauuaguguucacucugagcugaauccucucauuuucccuacauagcagcaagcauccaggggaaaauauagccagugucuccugagaucuauccgugcuacuggaaaacacacgcucggacagucuuagaggaucuuuaaccaucggugcggcuugacccugguuaaugagaccagguuccgcucugacugaaugugacuuccaaaaggggccacguccaauccaaagaucccuucaccucugaaggggucugcugcuauuuugggcacacacauccaccgugggaggccgcugaggcucucgauauucacacaaggauuuguuuggcuugucauauguuuaguuuaacggcauuuuaacaauggcaucaucugguuaaagcuuuccaaagaaaacacaaugugacccauuugccucgagaacucuaggcgucugcuguucagcaacgacucugggugcucagaaccucgccccaaccuauaugcgcagcgcauacaggucagaaggaagggacauggugggggcccuggaggggagguuaagggauguuuuccccaagcagccccucaacggagccauccccagcaaagccuccuccacggucugcuugcugcccgcguccuccuggagcccacgaggacgcaggugcccacucaugcugacucacgugguauccacgccugcuggagguggugacucugcaaauauagccccgagccacagugaggaggaugaggagggugggggaacagguaaagccacccacagcucccccaaccuggcagaccugauuccaaacuuugccuuuauuagcucauccaucucucagucacuguuugaggaaggugccauuaugaccccguuucccagaagaggagauggaggcauggagcagcaacaucacucgucccaggccacguggcuugagggaacugucaugggcgucugcauaccagaguuaacccagcuggguggugaaggcgcaccuccucuguugaccacgcugcccaccaggaacacccugggaacaucuugcccucaacagcagggcagucuaaaccucccaagggcaaaccaggguguccacccagaagcccuacaccagccgcuccccauggcucuuggagcucaaaagaguguggggucagcucacuguccugggcauugagcaugaauacaggacugggucccgacccuaccccauccucuuucuuucccuggcccucucacccucucacuuccaccagacacuaacuccagagguaggcuucucccgcugccgaggccauguuauuugcacugugagugggcauucugagaaugccaccugggcugagccaguguuugcauuucacucaagaaagcaggacccgccuucuccaggccccuccaacucucccaucucugccccaccugcagcccaccguagcccacccuagaccccugcucucugaugucaagcugucuccagcuacacaccaagauccagcagaucuucccuguaaugggugccucccagcugugucgucagauaaauacccucacgcaugugccuggggaguccggacaacuuuuuggggcgguaaaaauuauauguguaacuuuccacccacuuuuaacucaacgagguuaauuuuauuuuuuugcauucuacuuccaggaauaggucuaagaaaauucauauaaaugcauaaucuucauaguauuacuuagaucagcaaaacgggaacaccauuggaggugcucaaaaggcguguggcugaaauugaguggagagggaugcaggauggcgcaggaagauggugagaacucagcugugaggaaggcgcagaacaugggcugcgggaaggcgugcagagugagagaacucaggugugaggaaggcacagaacacgggcugcgggaaugugcagagugagcaggauucacucuggacagagugcguaugggaaugcauuuucuucuuugugcucuacaguagacacccaauuaauuagugacugagaaaaagcagaguauccaccuggcucucuuucugccaagaaccgcgacugccuccaccgcuccauaugggaccacccugccuaauaccugucuucuggaaaucggcuccacuccuccgugugggaccaccccgccuagaacuccuaauaccugucuucugaaaaucagcuccacucagagcagccuccccaucguggcagcucccugguaccagugccggccaggagaugcacaacccucugccucucugccccagccccacucacccgccaagucccagugcaaaugccaccuucugcagagcucugcuggcuuagaguggcuugugcugaucucccaacuccuaggugccucggcacgggcucccuuuaugccacagcucagcacugaucacgcccugccacgcauggcuccugggugagcucagcacugaucacgcccugccacgcauggcuccugggugagcucggcacugaucaugcccugucacacaugacuccugggugagcuuagcacugaucaagcccugucacacauggcuccugggugagcucagcauugaucacgcccugucacacaugacuccugggugagcucagcacugaucaugcccugucacacaugacuccugggugagcucagcacugaucacgcccugccgcauggcuccugggugagcucagcaaugaucgugcccugucacacaugacuccugggugagcucagcacugaucacgcccugugacgcauggcuccugggugagcucagcacugaucaggcccugucacacaugacuccugggugagcucagcacugaucacgcccugucacgcauggcuccuggauggucucacgugugaugugcugcuugcucaaauuacaucacaagcuccuuccagggaaggacucugucucacuauuuuugcgcccagcccagugcugacucaaaaacagcacucaguagucacugggugacaacaggaacaccagcuuuaacacucagaagaagcuugcugaagacuccgucucacccacugcacacuuuaaaaaaaaaacaacaaaaaaacgcaaagguucacguguccauuagagcuggccaagcaaggcacugcucauaggaaaaaaggcugcauuggaguuugaaagcuuuuaacucacaugauuccucguuucaacugaaucuuccccagucagcuagacuuagugaaacuuuagaucauaacauuucuugauggcuguagaaaaggucuguguguacuauaauggccagaggaaagaaaccuacaucagaaaugacacauauggaguuccccugggcaugaagaugucagauacuuuuuaauagaaauccacaaauauucagacccagacccuuacaccgugguuaggaacuccucaaguagagaggggacagggcacgagaaacaggcagggcccuguauuuagcggguaggucuggcucucaccucacugcugaagcagagucccugugugaugccaaugcucgcacacacggggcauggcaccaggagccccuccccggcuucccuaggucaacagccugcucaguggaacugugccuuucacagaccaccuaccaugagccuuggccuucaaguugaacacuuucuguugugcaaacauguccgcugccuccccucuauccaggccaugcccaagcagcuccuuuauccuggugcugugauuucaggagugguggggugagggguguacccugguggugguugggaaugggugguccucuggauggggauguacccucaagaggggcgggugagccuucaggaugggggucugcucggucuuguccuucugcguguccaccacuagauggggccaaccgugacacgucacuagggccaagcugaagcaacuucacuccuugcuucccucccugcucaguugaugggugcucuggcgugggaagacguuaaaaugccccggugguucagacacugcucaggggcagcggaacagggcagagcaugcgauucaccacuacuagggugggacugguuaagacccaccuucagaggagccucaacucaagcuccugacugcaucucccgcagugccaagcuggggcacccuugugcaccucagcccaccuagaaccagcucugagucacuaaugccaggagcagggcccggcuuagacaugccggagucaucaaaccugguccccugggccuggcacuuccagcgccaugggaacaggaccacacuggggguugacagcgugaggcagacacguggguuuucagaagcuccugagagaaaucgccuauggcaggaaggccuggcagagagggcagcggggcggguguaccugcucagccgacauaccugugacauccaacggacgcuuuuuuagagcagugaccacuggcccgucuuuccugcguaacagggggcugcuccgucuuucggccacuuucugcuuuagccuggaccguaauuucagauucgguucagaagcugcacaaaaaggagaugucauuacagccaggcagacaccacuggcucaagguuauccuguuggugguuuuuuaaaaauacgcacucuggugaguaaauauuugcucaacacugcuguguugcugcaggggagagcgcagggagcucacgaagcaggggauucuaaaucccauucaucagucccaaauaaugaauaaaacgaaucuggugcuuuggauaaauuucuguggccacagcauuaugcaagcgcuggcacugucuucacagaaucaggccaccacuguuuaccaggagauggaaacaggacugacaagcugauuuacugggcguggcaggaggcugcugaggugugaagucacuuaauggcgaugucucguaacuaaugcucuucuagauaauacaccccuaucuucauagcuguguugcucuaaaaucagagaaagacugacagggaugugaggcugggcccagggaugugaggaugguguccacguugcacacuuucuugcucgcccaugcaucgccccagcugugucagucagugaggccuccagagcgugaggcugcuauccccaccccgaccuggggaggcucagcagagcccaucccaacaucugcgccggcuucaccuuucaucugaccacagggugaagguacugggcgugggucgguuucugugaacagcucugccuguguggacagagccauuugcgaaucuacaccuuucagcccaccgugguccccaacucaucugcaucuggaacccaaaccuccggcgcgaggcccgccuugggaagcacuagggaucuaaaggcagcgaccggagucaaagaaauccccaaacccacccgggagagguuaucggcuuucagaguccagaacagagccaagaauaccgccacggagacgugugucacacaagccuuugaguucugagguuuuacuuggcuacuuucaagauucuaccacuuggagauuugcacauuagggagauuuuaccucuucuuaaagaaucagcacuccugcuguucuuaaucuuucuggaacaggcagugcaccgccuccagagcaacaaggaaugagacggaguuucuccuggaagcaggacugauguggcugggcgauggggaccaacaugacuucacucuuugggacgugcagacagcccaggaccuucuccacuuuggaaaaggcuucgagucagggacaguuuuucugcaggucuuggaaggaugugggagaagcaagcucccuaaaacagccuucccagagaaaccagagaggcgcugugagaagguaccagacucuaagccucugcagggagcgaggccucugugcuguggcacgggggaccuggaugacgacagaugacggauucagccacaagccggccucuccacgggcuacugacgagggcacacuucugugccuaacacaaccgaccgaggcaagcguagauucacaagcuccacuucuauuuccacgcuggguuucuugccauuauucaaaagacaaaacaaaaccaaaaaaaacaagccaaaaaacccaacugaugacuaggcaagaaaacaguaccucuucucucaccaccagaucuccacugaaacccacaugggcucugcagggauuccccgggccugggacaggagccacuucugagaggcaggggcugugugugcccacagaagagcacagggucccuggcccugugugaaaggucuuccucaguggcugcccugccacauagagugggacacguggcaucgggaggcgggcaugacauggucacuccaggcuaccauggacuggcugugguacugcagcccagugcaccgccucccccaggcccugugggggucaucacgcugccaccaggucaucagucaggcggcagauccuccacagcccugccgggcacuccagacucuuugugcaagagacucuugaggagagucccaugguggcugcuucaccccaccccuucccuccacuccccuccccuucccuccucuccccuuccacaggccucugcuccacgccccucccaaggcugcccugaccccccacagccccacugcccccaucacagccccacugcccugucuuccucacagcagccuucucaccaucuggaauucuucuguccccucaccuguuuacccccugccucccagccugcacaccugccugggcucccugauucuagccgacugcacgucccuggucgacucugccugcaggguggcugcagcugaccaggaggcuccaggacaccaugccagcacugccagggacagcauggcaugaggcuggggcccuccgcucgucccugccccgugggcuauucagcacucugacucccccgcagaaccuaucagacaagcaggguuuuggaugcggggcucggggaggggauugagcagcagcacguggaccaggagagaagggggaugcuggagaccacccggggcacaugaaguggccuuccuggggagaacagagaagcccuagggggcagaaggcagccgggggagccgcauaccacgaggaccggcucacugccugcuuucaggguggccagccuuccugcuuccugcccucccucauuacuuccaggccgggcaucucauagauugacuuaagacauagggaccuacaauaucagcccuucaaaugcaugugucuuaaagcuugcacaaugccuguaacuccaauaauucugccaaaggcagccaaaguggaagaugcagguaagccggcaccuggugacugugagggucgaggcugcacguguacuggcucagugcagcagccccuucaccgcccucgcgggccuuccacucauuccaggcacgauguggccagguggaggaacugcagaaacuggaucccaccccuaagagggcugcagguacauugacagaaccaaagcaucaggccggaggccucauggaagaguugcucccaccaagcgugggugagggcaggaaggaugccaacuguacuuccaaaugcagugucugcuccuuagggaacagggagcaggugggauuguuucuccugaagccaaucaaguaaaugacuaauuaaggcgauacaacauuccaaucacaaccuuaaaauucaacgcagugcccaaugccuagcaggugccuucauccuucugccagaagcaauucugauggagacacaggcuggcuccuccaacuuaaacauccugagagucagcugcaggugaagcggcucucagagccggaacgcuuuaacucuuaggggccggguuuacagaggggacaggcgugcaccuggcaccaguguggagggcgguuucuuugugggccugaugcaauguccagcggccagcgaggaaagaacccauugauguagcaucagagaaugcacgcaauaucgccgugggacagggcgggcaggcagaacugcagagagaaggaggcaccugcuuccagcugcucugcccugaaauccuaaagugacaccaaaggaaauauuaaagaggauaaagacaagaggacaaaaacuaaagugcagaaggaaggggcuggagaaaaaguugagaauugucagaagggggaauaaaaggauaaaaagaugaaaaaugggagugcaaaggucguacaacaaauuacuggaaacgccaggagaagagagaaucagcaggguggagaaaucaugagcagcaauuccaggccuacuuguccagcugaagaggagcuggacacggaggccaagaaucccccaccugcgggaucccaaacugcuucagagcucuggggacaaaggcucggccuugagaacaguuuuguacuuggcaacagccacaucgagggcaagacgaugaccugaaaacccugcaggaaacccgucccaaccaacugaucauccaagagugcgacagaauaaagugauuuaccagcaaaugaggacuccaaaaacucaugcuccaugcacgacuucuccaagagccacuggaagacgugcaugaccaagauggcgaggccgcagaaaggaggccacggagcccgggagaggaggcgggggccaggccgggagagcagaccguucacacgcaccgggcaguggggccagaagcaccaggcggccugcugugcagaggagggucuccuaggucugcugaaaugugggccugaauugauagcaggcaggugugaaacuaagcaaaugaaaaaaaugaucaacuuccggaaaaauuucuacgaggugaaugcaguccagguggacucugguucugcugugaacgugacacacgcuguaauaacgcaggcgggacaggcagucagggacggccguucuccuaucaugaacaucaugggggucuauguaaauguacguuuauuuacuucggugaaaauaaaaagauaauucuggccgggcauggaggcucaugccuguaaucccagcacuuugggaggcugaggcagguggaucaccugaagucaggaguuugagaccagcguggccaacauggugaaacccgucucuacuaaaaauacaaaaauuagccaggugugguaguggcaccuguagucccagcuacucaggaggcugaagcaggagaauccccugaacccaggaggcggagguugucucacuugggcgacagagcgacguuccguuucaaaauaaauaaauaaauaaauaaauaaaaagauaauucuaaaagacaaaugacagacuggaaucuaacuucuguaauacaugaaaacacagcauugcaaacaacauauaaacaguacuuacaaaggaacaagcaaagacgaugccccacagaagaacaggugaacgcacugccgcuaagcaaccuccauucagcacugauggaaccgccucacgugcccugcguggcuccagaugcugggcacaggguggcucugaagacagagccugcucagggcagccccgcugcccagcuccggggcaccagccacccucgacuuugaagcacguugcucacgugcuccuggggagggggcaagcacacagccaugcccgcccuugacugacggugacggcacugcucacucaaacaccaacaggcucgccaucuucaccacuggccacauugccuagaaugaacugcaacaccaucccgccugcucguggaggggguggggaaaauggacucucaggcugcuggggaggggguaucauuugcucaauguuuuggaauauacauacucugaaccagcagcuccauuuucaggaaccuuuccuacagaaauacuaacacagugaggaaaggugcucaaaguugcuggcaaaaugguaaccagaaaacaguccaacuuauaucuaugucuuagacuacuugagagaaaggcguugagcuucauacguaaaaauggaauaauggccaccauauaauauuaauuaaaaauaaagguagaggagaaaacgcaaaauggguauuuuuguuaacaagacaacucagauacauacagaaacacagguacacacacagacacacagauacacacacagaaacacagauacacagacauacagauacacacacagaaacauagauacacacacagguacauacacagauauacacacagauacacagaaacacagauacagaaacagauacacagaaacagacacacacacagaaacacagauacacaaacacagaaacgcacacagauauacagaaacacagauacacaccccacacacagaaacacagacacacacacagauacauagaaacacagauacacacacagguacacacacagauauacacacagguacauaaacacagauacagcagcaggaagucucaccacgcugcaccuccucaaguauauaccacaccuucacauacagcagcaggaagucucaccgcgcugcaccuccugaaguauguaccacaccuucacauacagcagcaggaagucucaccacacugcaccuccugaaguauguaccacaccuucacauacagcagcaggaagucucaccacgcugcaccuccugaaguauguaccacaccuucacauacagcagcaggaagucucacuacgcugcaccuccugaaguauauaccgcaccuccugaaguauauaccacaccuucacauacagcagcaggaagucucaccaugcugcaccuccguauguaccacaccuucacauacagcagcaggaagucucaccacacugcaccuccugaaguauguacuacauuacaccuuuacauacagcagcaggaagugugggcacugcccauuucuuccuggucccaccccucuccagcaguuucugcaaacugcauuagaacaagggacagcaagcaauggucagaggcaaacagagagccccuucccaaacucagggaugaaugugaggguggaaaacacacucuguccuauuucacaguacccugagccuacucuacacacagauaagaacaaacacuuguaacuuuauucaggucacuaguacacagggcgaaagccaugagccuauugaugagcugugggacuugacuaaugaaagaaccaugaagccaugaaguggaugcccaccgccccaccuugcagaccugcggacacaacgggaggucaucuagucugcccaggauauggugucgugggcgccagccuggccacaggcccugugcucuuccucaccaagcgggacagcuuccccccaaaauggaggaaaacccacccuaucugcacaucuaagcaauggauggauguuucccaugggcagccgugaccuugagugacugguuucagaaggccccaggugaggagggcagagcuagaugaacacuuuucaagccugaccauggaggcaagugcagagggagcccaggaccuuugacugacugcccagauccaugauccauacaggggccaacagaauucggucccuaggaccagcccagccuccucccaauucacacccaacuguggggaccaagcccuaccaggcaggcuagagaaugccggaacaaggcugaaguuaccaacuucucaccaaacgugagcucugggauuuugcuuccuuaaaagagccaggacaauccauggcagugccacagcccaggccagcagccgggccccaacacaugcuggggagaguguuugcugcuaggaccaugugcccagggacacaugaggaugcuggacaaggagugcuguggagugcacgguuuucagugcucaggcccaagaagcugcugacaaaugggaacgaacugugcuggcuggacaacaguuaguuaguuguuuuggccuccuuucaucuaucagcagucacaugaggggaaaauuuaagagucauuauaaaaaauacacggugacuaauaucuuuaagaagaucacgaugaagauguuacuggggaaaacuaagaucccucaacaucaucaaaaugacaaaacguugcuugcuuuuaaaaguggaaaagccuccauuccucagcgugaacauggacucaaaggcucuguuuaaaugcaguuucuggugaagccaucugacacccacacagugcaggaaagauccagcguccuauguccaugacagugauccacacaguucugucucuucugacuauauuuaaaaauacacauuuggcggcuucacaagucugcagaaacccaaagucagggugacacuugaggcugcacagacaugggaagggaccaggcaccucacccugggccgaaaucuggcgggaggugaagaccucugaaguggagacaccccugcugccaaucucccaggaaaggggcggggccucuggcaggaagagcuggaccugaggcccuggguagaggucucugacucucaagcccagcgguggaggcuccuccugggagauggcacucaggugaaggcaagccaggagcgaggagaugagcccugaaaagccaacagagcaagaugggcccuucuggccagauuuuggguauaaaucuugguguucccauccuugugguccuucucuaaguggaggugaguggcuccugcugguuucuaccugaacuguaggcauggaggcaaggagguggggggaugcugggucuggcaguuaccagucauuggauggagaaaaaaaucaaaaacacccuaacagcguagagaaacaagagcagaaaacaccucgaucugguccuacucgaaggacuuugcaaauauuaauuaauucacaucucaugauagcuccaggagagaagcaauuuaaagguacauuucacagaugacgaaacugaggcacagagagguucaagagcuuccccaggucccaagguggcgggugaaggagcuggguagaaacucaggcaccugguccugcccacaggugcaggcgaugugaaugcccagaauaugcccaagcuccgaauaggagucacugcauugcuuucaccagggaggucagacguuugagcugguacaggcguuaccugucagcagagccagcaaaggacaugcaaaaaaugcauggggugacgacaaaauucacaagacagugacaaagcuuuucacauguucacaggucauacaauugcccuuuagagaugcagaaaugggcaaacugugugccgggucaggauaaguuaauguaaaaucaaaaucauauaauuauuuaagucuacaucacaauuauuaaagacuauuucaguucauucaaggaacuucauaacuaaaauuuaaugacguguuucauauuaccaauuacugcagaaaagcacagauauaacuuacuuagaaugagcgaugucauguguuugaaaguagaugucaagggugauacaggguguguaacuacacacuauucucuuaagugguuuaaacguuuucucggaaaucuuuauguuauuauuauuaaugugguagugaugacuuuuuaaaaaacugauaaugcaaucaaaucuuaauuaaguucuucuggagcacuauguauucuaaauaacauuucccggagugugaaaacagaauucucucuuccguucucaagaaagcagggaguuggaggguggugcuaucacaagguuagaagcacaguagaagguguuggagacuuugcuuccaaucauccccagagaaacacaaggcagcaugggaagccaacagccacggaaucuacgagagauggcgcgggcccugccuaugggagaaaggccucugauggugaacagcagggcagggccgugacagugugccgucucccaugcugauagccuuccuugcuaugaaguacucaagcugguucuguuucuuagaacaggaggcugauccccagguagugcugacauuugggaugggggaggagccagugcaaauagcuccuagggcucccccaucccugcuguucuguugcgaguugggguguggagcugcugaggaacugcucuggggccugaugggauggguggugugugcuguccuuuccuggggcccuugguggaaaggcuccaaauggggaguuucugggaaggcacguccccacaugaggccgacuugcugggcuuggugcucucgcuggaagcucccuccuggguccauggcucuggagucugagugccacagccaucacucccaggacaagaggagacucuggggaugggugcaugccacagccgugaggaugugggugugggcagacccacugugcugaugaggaaauggaggccaggggaacggaaggcauuuguuucagggcacacagagcuauuacaugaaugagcacacauccaacccacagcacuugaugacaacaccuccgggcucccacccuccacccucggcaucgcuccaguuucuagggcaggguucuuccggguaggcauguuccuugccuccccauuccccgggucucucucccagcauagggcccaccacucaccgcggacuuugguuuuguugauggaauuugauuaauaauagcaucaguccccagaaagggaaccuggagggcgauuuguaagaaucagcccacagauucucuccugauacuacugggcacaucuuucuggaaaaaauacugaucucuaaauccguucuuucugucaagcuuuagggcgcucuccaggugaaauccaggaccauucucaguagaagcaucaguaagaaccacaggcucacacccaugaaacaaagcagcagaagcucuagguucacuuuucccaauaaagguuuauggcccaaauggaaaugcgcccauguuugcaggguucuugacuuggagaggacauggccgugcugauauggcccacuccagcagggucuccaccagcccgauacggcccacuccucugaggucacagcuggccuguuaugacccacuccuccagggacuuggccggccccauacgacccacuccaccugggacauggccagcccgauacgacccacuccaccugggacguggccagccugauaugacccacuccaccugggacauggcugacccaauacggcccacugcuccagggacaccaccgccucaauaaacccuaauagguguacugggaacauggccggccugauaugguccacuccaccugggacaugggccagacugauaugacccaguccaccugggacauggccagcccaauacagcccacuccaccugggacaccaccgccucaacacacccuaauagagcccacuccauugggaacagggcuggccugauauggcccacuccaccugggacauggcccacuccaccugggacauggccgaccugauauagcucacaccucuagggucacagcuggaccaauacagcccacggcuccagggauguggcuggcugauauggccuacuccucuagggucacagcuggccugauaugacccucugcuccagggauguggcuggccugacacggcucccagcagccccucacaaagccucauuguuccagugaagaagcccuugugugacugaguacguucacuguuuccgcccagaacuggccaaaaccuuuggauaacagagaauuuguuuagcaaaaaaaagcggugccccuaggcucucaucuccaagagccgcccccuagggaggacgccuugggauuucccacacugucuugcaguuuguaggauccacuggccacaucugggaugaggcacugcccgcccucagcaccugcuccagcuccugcccucaccaauucucugggcagagccucuggaaggcacucccuggccccugcccuucuugcuaccccagcgcacugcccacagccacccuaaucauuaucuaaagccacugccguggccccugagaaagucacagaggguccguccugacuugccagacacugcugcagccgccucucccugcuucuaagaugguccaggcaccugcuugugccuaaaugcccuucucccuuggcuuaggacagaacuguggcacauaacucugagcccagcugggauauccccugcaggacauagcgaauuucuuucucauaaagauuucccucccacucuggggaccuggaaggcccugcugcuggcacugcccagcgccaucccugaaggccacaggcucaccugcucucagacggcacauggcccaccaacaggaacuugcuucacccugugaccacugcggggacgccccucaguguggcaaaaucuaacacaccaccgaaagaaaacuaaacugagugugcuuucaaagugaguuugaguguucagcagugguguacaugcguuagguucauuucuuuugaaauaaauaauaaggaaauguuuagggauaucuuuuaaaaacgaugcucuaugaaaggagaaaauauuuaaaaaucugcaggugauuccuucucuaaguggaagacagcggugggcccugcguggcuuguggcguggaaggugcccgugcaggagaccucccggcccacagcaugccugggcacugaccuguuuuccuaagagggaagucaucuuuggcgucguacauucccaggaccgggugguuauaggaggucgacacuccgcucugggguggagaacucuggucaagggaacugugcugcguuuuccuggagagaaggcaaagacagaugguuuaguuuacccagcgcacugccccaggcaugcugcagccgagaagccacacacgaugaucuuucccuugaaaccucagccccaccucaacagacacaccuuuucccuagggucaagcugaaauuaaauggaaacaaacaggaugcuaaacaagcaagcaaacauccgaugcccacauccuccucugcgggaccagcagugcuuggggaugggaugggcagcaccucuggccguuuuccugguggcuguucuccaccuggcccuguccucucagauggcuccagcccagucaguucgcuaccagggccaccacuggccacucagagagccuauccccgguggggagaggaagaggaaaacaguaggcugcugcauaaggaaucaaaggugaguucauaggcagcugagacggggcaaaaaacggucuaagaacaaacgcugugaugugugggacucucucugccaccuggagagaagaagcccauggggcugucucucagaaggcacccaucgucauccgugccuucaccaaacucacccuggucaccucccucucugggggaggaacaggauggcagcuacugauacccugugcccagggagcugaccuacgaaagggacuuccuguaugaacagcuggguacaacuccacacccuccaggcagcaagacaggaaucgucugccaggagaauggccggaggacggacauggggaggaggcgggcccugggccgggacggggaugugggcugccacccggaugaccaucagcaaggccuuuuuugacggcacugacagcucagucuugcucaaaacacugugcugaguggaauaaauucugagucuuuaaacugcguaaucugcuuaaugacuacaaacaaauuugccgacuuacuuauuuggaauugguuagacuauuugaauacauaguauggcacaccaaugcaccuggaguuauuugaauuaagaaugggagcuuguaaauggguacagguguauauuuaaauauuugagagcacaccagugcaaagaaugugcugaagggaacucauagacaaaauugaggagccgagcccaggcaccugggcaguggggugcugggccgugcaucacaggaggagcucagggagcuccggaaaacugcacagcuucaggccacgccccaaccccgcccacugcucagggcacaccuccaaccccaagcagcuucucgcuguuucccggggaauuccaccaugcagucaggcucggacugcagggcugggacacgccugucugcaccugugcaggggcuguggccuccaagugggaccacguccuugugcaagccucccuucucuucccuguaguucuaccccucgucucacaaucucaugaaaaggucugggggcaacacucuuucucuaccaaauaguauuuucagauuguauccuauggggaaugugaucuuggcugauuccaaacuucuucaacaccaggugacagucugggaccauuuccgcguucacuuuuuccuucaugggaaacacggagugacuuguacaugcaucccacgaguuaaaaagaucaguauuuacauaauaauaaauuuaaauaaauggaauaaaaauuauuauauuugaacgguaggauuugcuuacagugaaguaggaguugcaaaaguuacauugguuuaagaucuaacagacguucucuuacuauucugaucucuugaggugcuuucaguguuaaaauccccacuuuccugucaaaccuuaaaacgagcagagcagcaggugcaggaggggcugggcccugccccccaacugccagcgccuccccgcuggaccaccucgauggauccagagaccucacaggagcgaccucaccuccugcauagcccagcucaccgccaggagcacaccaugcagagcccgccccaccgcgcacccgcccuccagacaccaggagagggcggcccucaccgucagggcaggucacacccgcccagcccuggucacauggucccaggccagaccgcacacgcgugcccuccgcgaagaagcguccagcagggcgagcagaagugaagcucuaucccugcugcaaucacacccgcaccgcacacaauuacucucacucacauccgcacaucacacaacugguaacacucacauccgcacaucacacaacuauucacacccaugccucacgcuacucacacccacccauaccugcaccucacacuauucacacccacacacaccucacccauaccuauaucugcaucucacuacucaccuccacaccucacacacacacacccgcacuucacaauacacccacucacaccugcagcucacccaacuacucacaccugcaccucacuacuacucgcccccaauucacacuacucccacccacaccucacauuacucacacccacaucucacuuuucacaccugacgcucgcaccuacacuacucacacccacucacgcccacaccucaccucacuacucacgcccaacuacacucacaccugcacugcacacuacucacacccacauuccacaccccacacccaccucacacccacaccccccucacaaccuauacccacccacacccccucaccuuacacaaacucaugccuaccucccgcacucacacccaucuaccucacacccacuuacacgcacaccccacccacaccccacacacccacacuucaugccucacacccacccacaccccaccucccacacacacacccgcaucucacacucacaccugucaccuuucccacaccucacacucauaccccacacucaccucacccacugcacacacccacaucccccauucacacccuacacuaagcuaaccccggccacagcccacacucacacucaccccggccacacuccacacucacacagucacacuggccaccccacggagcccugagggcagaaccuacagagcugcucccucuaccucaccugaccauaaauuaucuuccgauuuuucaaccuuucauuuccugcagccuggggaugggacacagacgcugggccaggagccgaggugcagcccccacggggcccuggggccaacccggaugccacaccuaaaggcaaaccuugucuuccggaggaagauggaaaagcaaauacuguuuucuucuaaacacuggcuugacuguagaauaaagcuucauacaaacucaaccauuucaguuccaaaccauugcccuuucaucagauucguaccagugauuuccaagaaauacaacgaggaaccacauacgccaggauacuccagcagaaauguaccaugaugggagccacaugugaaauuuacaauuuccuaguagccacauuaacauggauaaaaauaaauggguggaauuaauuuuaguauucgauuaaaccauuauaaaaaccauccuuucaacuuauaaucgauauaaacauauuaauaagacaccguagguccuuucuucagaccaagugucugaaauuccaugcucugcaucuauggcauguccuggucggacccagccacguuucaagugcucgggagccacguguggcuuguggcagccacacuggaaggugccaucuugucucaacagucuuaaagcuggaagcggugacucacguaaacacccacagaguccacgcccugaugaagccacagcaccauccaucucugcagccucccagcccuggucugcuuucucucacagucgauucacuuugcugacucugaauuucccaucaguggagucauggggguggccucuuugucuaggcaccgugccucuggggcucccccaagcugcugcaggcgccagcgguccguuccuugucacugcggaguagcagugcaggggccccaguuugcacgguagcgugugcaggggccccaguuugcgcggccguuccccuguugauagcuugguuguuuccacuguuuggugacugugaccguaagaugacgacucgucguguugcuugcuuucaugucuugggcaaauacggagaagcauugcugggucacaggguugguggguauuugucuuuguaggaaacugccugccuguuuucccacgugugauucagauuccaacaggcagcacacagagguccagggacaccgcaucugcuccagcacccggccuguuucacuccggccauccccacagguaugaaggggcugcuugccgcaguuuugauuugcauuuaccugaugaccagccaucuugagcaucuuuuccacacuuacuggccauccccaugccuuuuuuugugagguaccuguucaaaccuuuugaccguauuuuuaagugggcggcuugucuuuuuacuauugaguuauaggaacgagcucuacauuuuggauacaagcgguuuguaagauauacgcauugugaauauuuccuuccauucuguagcuugcuuuuuaauuuucuuaauggugccuuugaaagagcagaaguguuucaguuuguggaaauaucauguuuuggguuuuugguaucuagccgaugauuuuggcgaccuaagaaaucuugccucccccuccccaucaagguugggaaaaguuucuacuaggucuccuuccaguuugaucaguuuugcgucuaggcucaggucuaugacaucugaacuaaucaugcguggugugaagcugggaucaggguuucaguucuuucccuaugaagagccgguuuucugacaaaguuucugccaccacuccaugauguuuaaguucaggguucaaauacggcaaaacaagaaaaccaccaggcuccaggaaaacaaaccuguccuauggcugacuugagaucaaguccuucccccuccagccugaagguccccagagcccucugagaagaaguaccuccggccccugccauuaaagccagggcacgccgcccuuguccaggccaagacacucaccuugaacacccagcucacccagggaguuccaggaaaagucaguccucccagccccagccacucuguuugccaccccuccucccuggaagccccccaucucccgucucucagcacgucccucagcgcccugaggcugccccaggccacuucuucucccguggccuccuugacugcaggugcagccuuuccuugggccugcugcuccguccuccccucagguccaggccacugcccggcuucuauuccugcuggccucggccccccguccacuguccacugacuccugggcgagggggcgccagcuccccaccuucuuccaugcugccguggccacccucugggggcugcccugugcucaccgugaccccugcuucccagcagccccacugcucuaguccuccaacucccgcugcagccucccagacucugugcuccucuucagaaagggcugcccgugcuugccccacuccuaucacugucuucucaaagcucgcuugcucggcugccucacagggggacccaaggcggcccugcccugguccagcaggcucugcacuccagcucuccauccuccgccaggccccaggcccacccugccccuggcuccucauccugcccuuuccagcuugggccccaggggcaccaucugaaccacgauccacacuccugucccuugcuccuucugcccugcaaccccacgcccugccccagccaguaggacaauggaguuucuccacaaccaguccaggcaguggacuggcucugggggcacagaucggggucucccccaaagcgggcucccaggugccgguugccagcgauucucaggaagccaccuccucucucaggucccagugggucacugcugucacgugcugccucccauggacgccggucucacuccuccuugcaaguuugugugucccuggucgaguuacccaaauccagacggugugucugccgugagugcagcuuaugugccacuggcaagcacagcggcugccagaguggaggacgugggccaccugugcuggaaacaccuuuugggaugugucgggguagcgggcggccuccacggaaacaagggggaucgcgucugagcugugggggggucucacuacacauagcuguccauuuugaggcuugagaauagcuauuuuuuuuccaacgaaauuacugauauuucgauuuacaaaaacucccuuaugggauuuuuuucuagaaaugaaaugaaccuugagagcagcagaaaacuacauuucaaagcgauccucuguugcccuugcucacuguuucaagccgcaucaccucgccacucgcucgcacugugcucugugaacucucccccgaaggccuucuuuugcauggcaggucggcucucuucaguccucagacgaacaagccuuuuguggucucugucaauugcgugggcccuggcaggguuucuuaguauaaaauaauagaaguaccacgggggcuuccugacuagccuaagaauuauugaaacgucaggugggagcgcugucggagcacagaggauucagacaagaguuccaguuuaaguggcucuuauuguggcugaaaaauggcacaacauuaccaagaguaacgacaggcaccagccuccggagcacugcucggucccucugcaggggggcccacucccaugaggacggccaccgugugaguggacccccagaccacgucacucuggaggggggcccaccccgugaggauggcugcuguggaaguguacccccagaccacgucacuauggaggugggucccccugugagggcaggggcagcugccgugugaguguacccccagaccaugucacucuggaggugggccccuccgugaggacggcugccgcacgaguguacccccagaacacgucacccacauccgagcaccacugugcuugggguuucaauuccucacccuccuucccugccuccggugaagagcuggcuccaugcaaaucuaccggcgaucagacaguccucugggcccccagagaggaggccggggugcuccccacacccacacuuacccguaccaguagcgagggucgcuggaaaugcagugguucagauuccggugggccagcgccuucuuuuuauugaggacaaauucuuguaacuucaucuucacuucugugcuggccacggcaccuggcgugggagaaagcauagcagggggugaaguguggcucugcccuacagcagcaaugcagggcagcggggccacagagggagggaagggcuggggacggcuaugcaccuucaggacgcuguggccuccugagcgcuuccucaaagaaccaaggccgggagggguuuuaaugagagguuuucuucccaucaagauuuuacaucauugcauucuauuuaaaaugcagauuuaaucauccgaaagacuuauuguuagcuaacacaaaacccacuucugaaggaaguuuuaauauucuuacauaaaagaacacucugaauuaggcaguggcagcguggugguugcauucuugcuaccgcaaagcagaaucuaagagagaaggcuuugugcaaauggaugcaucacgcagggacaaagccagucucacaggcaggcgugcuuccuucuacaccugcgccgacaugacggccggcucugcuuccaacagcaucaaagggcagcgccuguccuccccagcuuggcagcucagacucaggcagagugacugcaccaagugggaccgaagucgaaacugugguuuucuuccguggcggugauucuuuuucaaagccucauuaaagggaacuggcaaaaaaggccacucucaccgccugaacacaaggccuguuagcacggaggcugcucgccucagaucuccaaucuaaccacacaguacuucuauccuucuuacagcaccuuaaguaucuuccuaguguugcauaauauucagauagcguuuguaauggucaaaaacacaccuugaggugagugaagcauguuuacaaaaccacuucccgacugggagacaguuuugguuguuagaaaccacgcugcagugaacauuuaugaguggguaacacugacuaccuuuagaauuacuugcuuaggacaucuuggcaaagugacuacaucuaacaaacuuacuauucuaacccucggcacaucuugguaaauugcuguccaaaauaucccuacacauaggccaggcccgaaggcucacaccuggaaucccagcacuuugggaggcugaggagggcagacugccugaccccagggguucgagaccagccuggacaacaugaugaaacccugucucuacuaaaaauacaaaaauuagccgagugugguagcaugugccuguaguuccagcuacuugggaggcugaggugagauaaucaccugagcccgggaaguccaggcuacagugaaccaagacugugccacugcacuccacccugcgcaaugcgaguuuagacccugucucaaaagaaaaaaagaaaaacgaaacuucucuacacgcugacccccugaaccacccauccaccugcagcaggggcagcugcuccuccugcugguccucaaaucaccauuugcccaaauccaaaagccagcaggcaucacugugaggcaccccugagcaccacuggacacgcgccgauuuccucucuugcaagauaauucauguccuuggcuuauguguucuuagaaucuuccggcgaugugcacagugguguugugggucuguguguguguguguguuucauacuuguauccacuggaguugcguggguuucuuaugauaauggcuguaucgagagccuaguauaugccagcccuggccugguucggccucgcaugagagcuauaaauagguauucucaucccccgacuguggauggagaacacaaaggcggccaggugcgccucaggugagguuggcucaguuaccaagucucauggacgcccugguucguggcucucggcugcuccgugugugugugcauuuacccugccucuuguuuccuuuuacaauuuggguaaaauguucaaaugcuuguuuuuauaaagucuauuuuaguuuuuccuuugugaguuuucccuuuccuuaaaacucugccauuguuccuccuuucagugguuaauaagccaucauuuuaauuuuauccuugguucuggugcuggguuuucauucauuugguuauuugcuaaauuuuuucaugacucacucugauggcucagaaauggauuuggcauauaaggcucuauggauauucugaccaacugcuaauaaaugauuaauaucauuagaaagaugucuuuuccuugccaccuucaucacauaccaaaugucuuugcugccacucacaaauggaguuuuuguuaguuaggcucauucuguguucccuacggcagaaccccacucccauuacauuaagguggaacuuuaaugucuggucaagggucagucagcaaugagacgccuggaaacagggucuacccaggcugugguggggccugcacuagccaagccagggaaacacaaagacauuaacuacacgaccaccagcaugaguccgggaagggccaccgugaugcaugaggcuucaggcucagggcucucugucggucugagaaaaucaugucauugcccgagucaagcugugccugugacgucccccagcucaugcugcugaagaugucucaucaccuaaguugugacugcggugagcacugccccagguaggguggcgguggggggacaggagggaugcuuuuucagggcacccggcguuagacucgaacaucacuuagaagcacuuuuagcugaacugucugucuguaaggggacuggucagaagaucacacacuuauggaaaccauucgcuucuaccauucccaggcaugugagcacuggcauuccuaaaagauuaucagcaacaggcugcuaacuuuggaaaaacagacccagacauaaaccagagaguuaaccucguaaauauacaaacugccuccacaacuaggaauaaaaggaaaggccgggcgguggggaagauaagugagcagagaacacagaaggcgaauuucaaaaggagaaggcaaauuugccaaugaguauguuaaaucagcuuaacuuuacugauaaaagaaauaagaagugaaauggguaacuucaauuuuuugccuuuacacggauaacauuuuuuuggguacuacccaugcugcugacagugcagggaaguaguccaaccgcaaaaugaugcuggugacagcgacagugaggaugaggacccagauggccaguuguuggaggggacugcccugcaggucccccuacauggccguccuugaguggaggcagcagagcaggacaagaagcagguucucggugugcgggacgaggacgcccucaacacuuuccaguagacccaaacucagugcagucagccuuaccugcucaaaacaccaguucccagggacagcuguuacuguggauccacuggcccuccacgggggagggugcgcacuccaggaacaggacccacuuuaugacccacguccucucccugcuucugcaaacaccauucgguggcaaagggugacuuggccacaagccuggguccugccuggcucccucuaugcagggcugggugcugggcaugacuggcguucaugccccaugcaguggggggcagacaugacugggguucacaccccacccaugcccagcauaggccuggccagcaggaaacacgaggaagguaagucuucgauucaugaccuuucuaaccaccaaggaaucuucuuuugaucuuucagacuuuacuaggagaguauucaaaaugaggggcugauucugacccccaccccguuucugcacuucugguuaugcacacgcucaucugucaacagguuucucacuuaaaguucuagaaugaaaaaacccauucaacaaauggauagcagaucucccuaauuuuuacuuuuacuuuuuuuuuuuuuuucuuaauucacauugaguaucacucauccccugcauggaggcuucuacagaggcucuaugagaugccagcccguucuggccagcagagaugaagcgguggauaaaagaggccaaguucuucccauaccagggggcagagagugcacccgagaccuaaggaaugagcgagcaacagcugagcggggcagagagaggaggacagcagcucuggguggggcggggcggggcagguggggagggacggcuguguucggggagggacggcugugcucccggagggccguggccugggccuggcgaguccagacgacagagcuguggcagguucugcuuggcuucugccugaaagugcuccuuuuucucuccacccccuugccucugaggaaggcacaacuucauggaaaggacaccuaaugacuuucaggaucagccuuucacgucauuuuuacacagagcaaaggacuugcucagugaccucccuccauucccugcagggcugcgcguguggaccgcagugagagaaagcggggcuguauucgcuccacacugcucgggccgaguccagccugccccugcuccuuccccgagcuuaugugaagagccgugucuuagauucccaagugccguuaaucuaaaucaaaaccuagcugguuaaagacaguguguucuugcuaaacaugaugaaaacugccaccguucugucaaaugaauugcauuacuugguaucaauaaauaaaagugcagaauuauuuaaaauuaaaaguaauguaaauguuuauaaguguaaugauauuuauuagauacucaauaagaaauucacuuaaaaaaaacccaagagaauaaacagaugcugugcaccguguuuucaaaugcuuagaugcuggcggugcuucgugucccccgcgccggcccgccacugcuccuccagccugcacagacaagaaccuccuucaugggggaagacgccggcuugggccccgcuuacauaagagcccccgaguggcguccaccacaggggccugcggcccugcguccucaccacaagaccacacucugagggcugcagagccgacacaagcuugccaaguacccaacuguacacaguuuauuauuaauaauaaaaucugaccacccaaauccucagugaaaaccaccgggacggccgccugugacggggcuagaggggagcaggaacauuccagagcuccaguuaaggguggacggcgcuucggaugcagcgcagggauuguuuugggcugguaaacggauccaaaauguuuucugaagugaagucuuuucauauucugugagccucaagaugguauuuuuauuggaagagucugguaaacucugaggaaguaauuuagaccaagcugcuuuuuagcaaucugaaaaacucuuauuuguugguuaguuguggcacaaaucacccagcugauauuuaaauuuuaaacuucaauucuuugauaagcaacuauuuucccuacuccaaagaaaaauacauaggauacacccugggcuaccggcgaaccacagaagcguggaggggaggccggaccccaggcagaggccccagugcuugggcccguggcgcacacccgcgaugugggucccacgcacgccuccugcacugcagcgucaccagcacaggccagacaagucaaagccccgcgcacagggcucccacggggaccgcgugcuauugucuacggaaggcagcuuucuaaaguggaaagcaaccccacagggugggccccgcccagcaggccguggagccccuaagauacucagauuccucacacgugaagccagagggcucagcugcgcuccugguccucaacccaggcaacgcacuaggcagcuucagaagcaagaacacugccagccggguuccacuugggaucaguuuggcagaacacccuggagugaacagagacccacagcacagccguccacuaccgagagggcccggaucugcaugcaaagaccaggcgugcgugugugcagcccugucugcaggguccuucuccucaaggccucugcagccaugucuggaagcucuccccuaugccgccccgucuccucaaggccucugcagccaugucuggaagcgcuccccugugggcaaucccuggggauuaagucaccaccuuaucuaaucaaugugccaggagccagggccaucaggcagauuugguacucacuuucaaauccugaugcaaaaauuagaccuacaauggaauauaaacccuccucagaggccuucuaccuugaaauucuaccaguuaaagugaaaaaacauuuaaagugcauuuauuauuucaagaguaaaaugcugugauaauugauaaaaguguuaguuuuauggacaaaaacaauuacuaagaacuuggaaauagcuaaauagaggaauaaacuaaaaacucagagagugcauuagcuauguacucuuaggaaaaauauaucuagucugaaauagcaaauauuuauaaaaauguacaacauaauauaggcauaauaauacaguuuagauuauaucccaauucuaauuuagcauuaguuauaacauucauuacauuaaaaauaaacuuacaaacugaauuuacuuaauaguuauuuaauucuuuuuagaacacaaggauuucaaauacaaacaaaugaacaaaaauguccuauuuggaaaaacuucaaaucuagugcagauuaauuaaaagcaaaaugccaauuucacaaucuaaaaauuauaugaaggcaaaucaccaaacacaccaaauauuaacauauccuuucacuccagacaaaacgaagaacauaaacaguauaaagaacagguuaggaaaccuggaguacuccaagcacaugguguuuucaauaauguaacuucaagaauuuuuauucagguaauucaauuaaaccuacuggaaauggucagaagaucuagacaaagcacccuagccuucugugugaaggcacagagaacaacuagggcagcauggaacaccagggccgaggucagaaacagggaccgcggggagcaggaccccacccucggguagccuguucucuagacucaacaguggguuucggaagaggcccuugauagggccacaaaaacugaggaaaauuaaaggaccccaauaaaccucaugagcuugugcguaggaccucaaagggauaugccuuaugaguaacgauggccagaaauccaccaggccuuugaaggccugaaacccaacucagaaucagcuccagaccugacugcauucagaugcuuaagaaacuuggccacuucuggucaacugcaagaaggaaaacaaaguccacucgaaaagaaugugucaccaucccaggucccccaucaucacaacagugcaaagucagacaugcaaccuaaaauauccaaccauagaaauaaacacaaucugaccaaaaaaaaaaaaaaaaaaaugagagaaacaacaggcaggaaagccuugccacagggccagagaguguuaccagucagacuccaaaauaacugcacuacgugcagaaaaaaauaagaucaagaaagucuauggaaaacuaugaaaaagggccaaaugaaaauccuagaacugaaaaccaaauaaauguaaaauccaauggaugaguuuaacagcagauuauugugcagguaaagcacaaauuagggaaguggaugauaaauuggaagaaaauacccacacugaggcaaaagaaaaaggaaacaaagacacaaaaauaacuuaagaaacuuaggggauacugaaagcuaauccaacacagguguauaacuaaaucccagauagauuaaauggagagacuggggcaaagucaguaucuguugaggugaaguuugagaauaaucaggucuaagaauucauaacaguauaaaacaacagauuuaggaauuacaaaucccaaaaagaagacauuaaaaugaaagcaacuacaguuaagcacauuaaagaagaacuucaaaaaaccaaagacaaaaucuuaaaaauagcuagggaagaaagauuauuuccaaagaaggaacaauaggauggacagcucauuucuggagauuaacaauggaagucagaagagaauggaauggcauucucaaagugcugaaagaaaauaaauacaaaccuagaauucuauacucagcaaaaauaaccuucaaagauuaaccugaaaucacauuuugaacagaaagaaaauucaucaccauuagacccacauuaagguaaacaaagaauaucacagaugaaaguucagacaugcagaaauuaauaaaaguggaaaggauaaauuuaugaguaaaucuugacuauauaaaauaauaacaacaaugucuugugauguuaaagauaaguuuagaguuaaauacaggucaaaauaguauauaaauuaagaguuaaaguaucccagacccuuacuuugccagaauuggcaaaaguauuaauuuagauaaggcugugauagauuaaagacaguuguugaaauccuacugauaaucaguaaagaaacagcaaaauagugauuaccaagcuggugaaaaaaaauauauauauauauauauauauauaucacuaaaaacauacacuaaaggcaagacaagugcauuagaauaguugagauaauuauaauucauauuguacaaugauagauuuaagcauaaauauaucaauaauuacauuaaauguaaaugggccaaacuaauugaaagacaaagauugucaaacuacguaucaaaacuugugggaugcagauaaaguugcauuuagaggaaaauguauagcuauauaagcauauguuagaagacagagcugaaaucaaugcucuauguaucuauaucaaaaagcuacaaaaaccacaauacacccuaagaaaacagaacauagagaaauaaaaauacuagaaauuaaugaaaucgauauucaacaaacaacauccauaaagucaaaagcuagucuuugaaaagaauaacugauaaacuucuggagagagugaccaagaaaaacaaaagcaaaacaaaacagcagcaauaaagagaaaaagcacaaacaaccaauaucuggaguguaaaagaggacaucauuaaaggucugacagacauaaaaaacaccagaaaaggacaugacaccaaaaaccacuaagucaaaaauacaaaaauguauaacaaaggcauauauuucuuuuaaaaaaauacaacuuagcuaaagugagccgggggggaaaaaugucccaggaacuauuuuaaaaauugaauaaguaaucaaaaaccuuugcacaaaugaaaucuuaggguuaagauggcuuuagcaguaaguuucacaagauauuuauggaaaaaguaauauccauguuaaauaaacuuugccagagaauacaaaaggagagaggaaugaugcuuaacucauucugaggccagcacagucaugacaccaaaacuugacgaggacauuaugagaaaggaaacuguuuggcaaucucccucaggaacacaguugcaaucauacaaaauaaaauguuagcaaauccaaguuuucacuacauaaaagauaauauauuacaaucaaguugacugggguuauuuuaaaaaugccaguuagaauuuauauucaaauaaauccauaugcuuuacuucauuaaccacauaaagccaaaaaaucauacaaucaucucaaaagaugcugaaacagcaccugacaaaaaucaauauccauucauauugaaaccccgagcaaacaaggaauggaagggaaacuuccaugaucugauaaauagcaccugucaaaaacaaguagacaaaugaguaaaaaauacaaagccccuacagaaaacauggcaccuaacaguaaacugggaaccagacaaauguuccugccaucaggaccacaauuugauacuauauuggcaaucucagcccauucuauauaauaagcaaguaaaagacauaaaagguauuccaaucagaaaagaggcaaucuucucauuauuuauagaugacaggauucuaaauguugaaaauucaaaacaaucuauuaaugauuaggauaucugaguuuaacaggguugcuggacacaaagucaauggucaaaaacugacugcuuuucaaaauuauaaaaaccaagccauucacaauagcaaccaaagccaucaaauggcuugacauauauuuaaucaaauauaugcaagccuccuaaacauaaaacuauuaagaaauuauuaagaaaaauuaaagaagguaaauaaucaauguuguaaaaauaucaggucuuccuaauuugaaccacagagucaaugcaaucacaaacaaaaccccacuaguaucaauuccagguacaaucagcuccuaggagauaauuaaagaggauguauccaagauucugaagaaaggaaagauuucuuaaggcacaaaaucaucuaaaggaaaagacugaaacuguauuagaagggagaauuucugugccugaaagauaacauuaagagagugaacaggcaaaguacagaguggaagaagagauuuacagcauguacaacuggccaaggguugauuccauaauauauaaagaacaacuccaaaucaagaaaaagggagaccucgcaucagaaaaaugggcaagagacuggaacaagcacuucacaaaaaggggaauauucauucggcaaaaaaaacuuaugaaaauaaacuaucuuauugguaaucaaagaaauguagcugagggcaugaggaggagcugaaauuaaagugacugacagcagcaaguguugacaaggacauggagccacaggaaccccuguacauggcugguaggaguguaaacugguacacuacuuugaaaacuuuugggcaucacguaugaacacugacaacaugcaugccccaaaguucaacaacuccacuucacauuugcccacauguaccaagaaacauguacaagaaugcacauagcaauacugcuuuuaauagcucugguuaggaaacaagccaaauaucuaacaacuuuagaagaaaugacuacauuggugcauuuauaaaugggacaccaugcagcaauauauaauagauaaugaaugaccucuugcuaaaugcaaaauggggaugaauuucacaagcauaauguccacagaaagaagcaaaacgcaaaaauccuacauauuaaggguuccauuuacauacauuucaaaagcaggcaaaauuaaucuuccauguuaaacaucaggagaggaguuaucuuuggggaagggggaagugcauaaggacuucucuucugacucaugggccagcccuacaagaguaaaucccucuacucuccuuaccuggaauccuguuaccugaggaaaauguauaccucgacuccuuuucaguauuaccagggaacagacaaauuuaacugagcauguaaguccugggcagaaacucggagugucuaugaaagucccuucacucuggugauuagauccugacugucugugucacuuaaaacaagaaguuguccauggaaaggauauaaacacacagugagccaagggcucuuuuaagugaagaucugagaggaugcucagagcugacucagccccacgguggacccugcaccccggggacacgccagggcucagacacacuggcgacgcugggcaccguccucgugcagaggagcccacgggucaucgucccagcagcccacagucagcaggggcgacacuguuaccuuuuccucaguagaugcgucccucuaacuguccaaagugggaaacagcaaauacaguguucuccuggauaguaugaagugugggcucuccuuagaagaaaacagaccaugcuggucuccagauguacaaacacagcccccacagaaggcaaaauucagaguggaaggagcagauagcaagagcacgcugcuggcccucacugggccgugggucacucuacaaccucacaccugcuuugaaggcacuuauaaaaugcucccgaaagaaaaguacuuugaaaaaugcagggcagaacucacagaugaaauucacugugcaucuggcaugcuuuauggcuuuuaauauuuuuaagucuauuaggaauccugccaaauagucuuuaaaauguuuaaaucaaaccaaaagucgggcugaaugccccuugcuuugauguuaauauugaauccugcagcccuggaugaagauaaauccauggacucugguucacugggggagcuaaccaugggugggcugacacacugucacacucacugucccugucagggggugggggucccauuccuggccugcuucuuagaaacccagcacaggcaaaguggcaagagucaccauggugaggcucagcugccccuagaucuuucccuacuccccgugugcugccccagugcccuccugcacucacuccuucugccccucaccuuccggaguccaugcccccacucccucccucugcccggccucccucccucugcccggccuucugcgcccgcacucccucccucugcccagccuuccgugcccgcaccccucccucugcccggccucccucccucugcccggccucccucccucugcccggccuucugcgcccgcacucccucccucugcccagccuuccgugcccgcaccccucccucugcccggccucccucccucugccuggccuuccgugcccacacucacucucuuugcccuucuccuuguucuugagcugcugcagcuucugcucccggugcugcuucuccagcuccugcuccuggcggugccucuccagcuuccgcugguguuccagcagcuccugcuggugcuucauggccagcaucuccuguuguugcugcaaguggaaggaggagacagacggucagagcccaggcuccacacacacacagagacccaaugaagacccaagaaaccagcccaggcccuacacgucugcccugguguggcccugggcacugcccugcccugcacugcugcuauuucaguccaaaaaaagaagucagggccauuccgggcucugggcauugucuuaccuucgaaguggaaaacauuaaaaacaaaagccauuggcuugcuagaagaaaauacgcaagaagaguuauguuaucuugcaaguuggaaaugcuauuuugagaacgacacaaagacagugaagagagcgugaaaugguacaaccacuucagaaaacugcugggcacuuccuuauaaaguuaaaugcacaucugccccgagacccagcaaucccauuccuagcuauuuauccgaaacacggaagcacacccacaaaaagccuguacaagaaugugcaugggagcucuggucacagaccagccuugaugcaacccacauguucccucgaagguggacacuuggagaaaugauguguguucaucaaagagaauaccaccuaaccauaaaaaacaacaaccuacguguacacaagaaaacacaggugaacugcuaaacagcagguguuggcagagggugaaagagcagagagaagaggcaagacugaaagacccuccgcugagccucugcacuugcagcuccagauccgcacauuccaccacagccugguguggaaauacgggugguuggcccucagugucuccaggcucugauccuccgcuggcucaaucaguggaggugaaacccaaaaauauggagggcugacuauauucacaugaagcccuaaaacagaaaaaacuaacgcacaaggaugaaaaucagaagaaggcugccucugcgggggugagguaggguugggggugccgaggccggaggaaacgccccagcggguggaguguccgaccuguugacugucuacagggaagggcacagccacccaacagcacccuuaagggcuggcauucuaccgaguauaaauuauaucucauauuucaaaaacugacgucgacauaaaauguuugucuuaauaacaaaaggcagaagguaaaagaaaaacugcaguauuuaugacauacaaauuuuauauaaaugguuguuauccauuaaugagaacaugacaggcagcccacuaaaacguugggcagaaaagaacaagaugcacagaagaacuguuuaaaaagaaaucgggauaaauguucaagcucacuagugaacacuucccauuucacucacgguaucggaaaaggugaaaaggaacaauuuggccuggcgcugacgagugugggaaggugcaacugaccagacgcccugagagggacucccgcaaacccagagcaccucuguccugggacccaacccaggcuccagggcucccgcacguccuuccgcuccucugagauggcuccgcucucguucgcaugcuccaggguucugucugcacacacuuuccucggcuuccacacaaaccccugggccagcccgggggaagugccaggccuccacaggugugaggagcucugccaccugccugccugggagagccucucugccacccucuguggccgcacgugucccggucauggucugucugcuguccccagugauuguuccguuaccaguugucucuugucccagugucuuguuuauuuuagacauagggucucgcucuguugcccaggcuggagugcaguggcgcaaucauagcucacuguaagcuugagcuccugggcucaagugauccuccuaccucagacucccaaauagauggcaguuaauuaaaaaaacaaaauuguagagaaggggucuugcuauguugcccaggcuggucucgaacuccugggcucaagccauucucccaccucagccuccugaguagcugggacuacaggugcacaccacugcacccagauacguuuucuucuuuuuugaugaaacaagaucuugcucuguugcuggggcuggucucaaaccccugggcucacgugauccucccgccuuagcuuccuaaagcucugggauuacgagcgugagcugccucacccggccacugguggguugcuuuuuguuggucuugcuccccuuauggaggaagaggggacggugagaggguacgggauaagcaggcauccuggcaaccagaguggcccgaggaacuuucuguggaggaaauuuagugaaucaggggcuccgggcuggcuccagaguggggcuuccaccagcuggugauucuuccuggaggaugaggcucaggccagggaaaggaugagcaaagcauagaguggggugugugugcgaggcagccaccggaugcccgaggcauagaguggggagugcgugcgaggcagccaccagacgcccgaggcauagaguggggugugugugcgaggcagccaccggacgccugaggcauagaguggggugugcgugcgaggcagccaccggacgcccgaggcauagaguggggagugcgugcgaggcagccaccggacgccugaggcauagaguggggugugcgugcgaggcagccacuggaugccugugcuccaugaguggcugcgcuggcacagcaggacuggcgcccaugggaugccacccacgucacacugucgucccuguguauucuucaaucccucuacgacagggguccccaccuccggccguggacggguagcagcagucccuggccuguuaggaaaugggccacaaagcaggagguaaguggcaggcuagggagcauucccgccagagcucaagcuccugcuggaucagugguggcauuagauucucacaggagugugauccuguugugaacugugcgugugggggauuuaggaugcaugguccuuaugagaaucuaacgccugaugaucugaggugguggaaguuucaucccgaaaccauucuccugcgucccccaccccuguccacagaaaaaaccaucuuccacgaaaccggucccuggugccaaaaaggucgggaccgauugccgcucuacaacaaaugcgcaucacuucagagcaagaggugauaacaaaggaaaaugaaaaguggcugagggguaggaaagcagaugaaaaggauuacaucggacgggcagaggcaaccccgacagaguagggccagcagggauggggggcugggucccugaggugccacagccugagagcccacgcggcgugcucagggugggaggcggcacaagccuucugcuacagggcucgcugcuccaagacaacagggcugcccgcacggaggaaccugcacaucaacgugcuugugcacccaagugugcguucugaaugugagugagcgcgugggauugagcaugugugcuccagguaacugugagcgugcaagggcgcugcccuucucugugggcgccaaccuucagcggcguuggcaaggugacgggggcaggcgguguguguccgggaacaucuccugcaucuugcuggguccuucuucacaugagaggcccgagccgacuggcaagcuucacacccuugcugccccugcacagccagcuuccagguggccaccacacccucuccugcgagagccuggagguccagcucagcccccgggcacccagcacacacaccuuuccaaccccuaggcuucugggaagauccagccugcaaaaacagccuggcccaagcccuuucauggucacaggcggugcaggggaugaggaauggccucaccagggcaucaaucccguuccuggaccucgcuucccacugcugaggacucagccgguuuccacgaccacccagaaccacuuguaaauagggaagaaaggauuucagcuugcucacagccucuuccuacucaagaugagacaugccagucaccccgcaugucugugaccugugugaaauuugaaucacauuguguccacgauguuaaacguaacaucaacuguguaauuuuguaagguaaaacuccucauucuuccauucuguaaguaaagcccccagcccagacaagggacagagacaggcauuggccaaccaaauggcauucggcaaccucaaacuggcgcuggcagugaacaagcaaaaugaacaugauugccccucaugagugccccauguggauggaagggugugcugggccgcugccccccauggcccaccccgaggaagaguccccaggcagaaaccgccugccccauugcagugaccccagcagauagcucuggacugaggcugccccagccuccaggacggagaccacagcgcuggucuuucccggcccaccugggcugggucauugcagccugcagcccacagccagccuccccguccacugucccauggcagcggaaguggccuggauggcagagccccacaggaaucgcuuggaguccagggcagugggaccucgggcucuaggcaggucugcccagucacaccuguggucacacacagcaaggauuuacagcagcagagagagcagaucagcauccagacauuggggacaggaccugccggcucuccucacagaugaaaagcccuguccacaaacacgcccacccaccuacagcccucacaaggggggugggacucaauuccagccaggagcacggggauagaagagcugcagagguggcaggagguaggcccacacccaaggaaggagggaggagaggaggggcugaggcaagacccuacccaggcaggugcaaugcaggcuugccuuccagcaggggugcugcuccuggcagaugugugggcacaggcaaggcaggaggccugggugggccgagggagagggggcacccaccacgcccggcagcagcgugugcgcaggaggggcagggagggccgucagggcuagcugcacacaccaagcaucucaccuguaucuuucccauggcaaaaacuuaauuccgaacaaccaacuuaaaugaacuucuuggggauggugggauaaacauaagcaagcucuugccguguccuucaucagggcagcgcuggccuccgaagacucacaggcggcccauagcacgcuggcuggagggcagugcccaggccaggcugccuggcugauaaaaccugcuccacccaccugcuugcugccagcgcacuugcaccuaaauauuuaaccucuccgugcuggguuaaauguggcaccugcccccaaggguuccugugaggacuggaagagguggcauggggagaacacucagaagagcuggucugggcuugccuccgugcggccugauugucaucaaaccgucacuuuugaaagaugucgccuagagacgccgacuuccugcagacacuaaauauccuaagguaaaaucaggcccccucaaggcuagggagauacuaccuggagcacaccuuccuaacgcgguguuccuugccgccacaugcaagcaaagucccucuaccaggacaaacaucugggcauguacagauucaggacucugcccuggggacccggagcuguguacacagggaaaggugccccgagagcaucccugggccacacugucugcagauugggaaugccaccagcagguuaaccuauaaacauacaacccacagggcuucggggugcuucucagcucagaaaacaaacacaguccuuuguugaacugaucuccucgucauggcgagccccuccccucuggcugucaccugcacagggccccuuggcucccucccucccgcugcucagagcucacucagggcggaaacgcagagcggacagaugcagccuaaugcagucucacaguaucuacuugucagccagaacccagagggaaagugagcucuuuccaccaucauuucaaaaagaaugaaagcaacaaccauggcugcuggggauuaaaauucacaggaaggcaaaacucccagaaacaugacugugguggaguuuuaaugaaaccagcagucacaaacagugacugauucccuaccugcccccggcaacgcugugugaucucggcuucgcuacuuguagggaggcauuccaccuuauuagauuuauaacagauuaucuguagagcaaagccugcaaagugaaagccaucaggacaaacuggauuucaacacucccuguucauagcacaagcugagacgucaggccuguuucuugaucuucaaagaagacacagggacccucugcccucggcaugcucggaaaaugcuggaaccacaagggaagauggccauuucacucuucuucacuccugccccacauccuagcaucgugaauagguacuuauucuccaugggaacccucaguuggcuucuggagggcaggugcgucacuggaauaccaaauucaggcuucgaaaaacaggacuuugagaugcgcuuauuuuuaaguuagcuaaaauugucugcaacuagucccucgcuaacuuuacacgucagacuacuccauggggcaagggcuguugggaagcaauuuuuugcagacugaaacuauaaugagcaauuuaaaauaagaugacuacgaccucauucuucuaagaaaagcaaaaacaaaaccaaucauagcugauccuauuacucuaaccagacuuuaaguuuacguuaagcguacacugaacucugaaccaaauauaggagccccagaauuuagcugcuuugacucugacuucagaauuuaauauacaaauauucaagugguaacccaaaaagauuuucacuuuuaaaacgaaacucuugacuuucuugugucucuuuuucaacuugccaggggaacagccccagagugggcagaugccgcgcccgcauaaagcggcaggggccaggaggaaagggcggcagaauggacgccacggacgguaagcugccgcccauggaugggaacaccaggugcagaccagcugggguagggccacggcauccauggcucuccaggugugugcccacgugcccuaugugucaccuggccccacugcccacugccacgugcaugugccucugccuagcuugggaggcagcucaugcuaagcaaaggugugcacgaggucuucccgucuauucuuaaccuucacccagaggcaccacagagggacucugcuccaaaccaagagugugcuccugcccccugccuccccaccgcaccccuguccuggcgcagagcccuggaucaggcauucggcacagcucaggugagcucuaaugcucacugacagcugccucaggugaccagaaagcugggccugggcaacaucucuucaccuuccucggccagguauuaaagagaauaaggaucaugacccacgcucccagugccagaaaacuagguuccuuuccguguuaguuccucccugaaaggaagagucacacuaucaacuaaacagcucugaaaacucucuccuauccacugugcucuccauagcacaagucacauggacacacacacacacacaagcacacgaaaaagaggccagccuugcuaguguaaaaaaaaaaaaaaaaaaaaaaaaaaagacaugccacuaaaacaguguguaaaugauuuuuacucuucaugcauucgacugggaauaggcugaaguuagggaagaaaaggcacgccuuacaccagugcagggagagaggguaagccuugcaggagggcgaugugcaaccuacauacaaaaggugcccuguaccugcccuggaggcugugcccuaugggggggucccuaagugucuguccuggaggauguguccuaugguggugggggggucccucagugucugucuuggaggcugugcccuaugagggggggucccccagugucuguccuggaggcugugcccuaugggggggucccucagugucuguccuggaggcugugcccuaugagggggggucccucagugucuguccuggaggcugugcccuaugggggggggucccccagugucuguccuggaggcugugcccuaugggguggucccucagugucuguccuggaggcugugcccuaucggggggggucccucagugucuguccuggaggcugugcccuaugauggggggucccucagugucuguccuggagguuguacccuaugggggaggucccucagugucugucccggaggauguguccuaugggggggucccucagugucuguccuggagacuguguccuaugguggggggucccucagugucugcccuggaggauguguccuaugggggggucccucagugucuguccuggagacuguguccuaugguggggggucccucagugucugcccuggaggauguauccuaugggggggucccucagugucuguccuggagacuguguccuaugguggggggucccucagugucugcccuggaggauguguccuauggggggggucccuuggugucuaucauggagggcuaucccucagugucugcccuggagggcugugcccuauggggggggucccucagugccugcccuggaggcugugcccuaugggugggucccucggugacuacccuggaggcugugcccuaugggugggucccucggugacuacccuggaggcugugcccuaugggaggagugcccagugucuucuggggagaggugcaccccauggggugccuguaucccccauggggguugcccuguaucuccugggaagaguugugcccuauaggggugccucggugucuucuggggagaggaaugcccuaaagggggugcccuguaucuccuggggagaggucugcccuaugaagggugccccgugucucguggggagacaugugcccugcagggggugccccacgccuccuggggagagguguacccuaacugcuggggaaaggugugcccugugggggugucccgugccuccuggggagagaugcacccugcagggggugccccguguuuccuagggagaggugcacaguguggggggugcccugugccuccuggggagagaugcacccugaggugggugccggggcccagucuugugcuuggggucucccacaugccccugcuccaucacucaccagccuggagcaugcucuagccauggcuucguggccuguccuuggacccucucuggguauccauguuuguguccugccucuccauauucuucugggaggcauugaucagaaaugcaagagagaggccgggcgcaguggcucacgccuguaaaccugacacuuugggaggcugauacaggcagaucacuuaaggccaggaguucgagccuagccuggccaacaugggaaaaacccaucucuaccaaaaauacaaaaauuagcagcagggugugguggugcaugcugguaaucccagccacucagguggcugaggcaugagcaucgcuugaaccugggaggcgaagauugaagugaacugagauggcaccaaugcacuccagccugugcaacaguugagcgagacugccucaaaaaacaaacaaacaaaaacacagaagugcaagagagaacuuccacgcuuaccugggauccgcuucuugguggaaaagcaccauccgagaaggagaggcaaggcugugucuaaaccaccacaaacagccaggaaaccggaaaguccaaggggaccacgagcauuaaaauucuccuaaaagauccuauuuacccaacauuaauaauuuaaguuauauuuuaaaaaugacucccuuuucaauuauaaaacucuauucaaauucacugaugauuuaaugacacuaauuagauuuuguguucaagaaaucugucugacaaacacuauugccaaaugucacuaacaaacaauaugauggcuuauaaagagaguuuaaaucauccaaacaaaagccuccuaauguaaugaaaccacuauguaguucaaauggcuuuuauaaucucuauuuuaaugaagaaauaaaugauuaaaaugcaaagagaaaggcaaccuugaacuucuuucugugcuuuugagacccuggcccagagacuggcuccagagccaugguucuaaggucucuggccaucucucagagggugauggggugggcuuucccagggaccccuccaggaaugaggagcauggccugaaggccuggccuguaggagcgacgugaggacuggggucggggugcucucuuccaagcagugaagccagcuccuggggcaccagaagaggagaggcagagggguucuggaggugagaccuggccucacccugagauggcagcacugaccccaacucaagugucuucuuuaugucuucuggccuccuaggacuaccuugaggagccccagucaaacacacggggcuuaggcuuacuucucagcuucucaucuacgucgucuucuuguaaaagcuacaaauucaaccagcacggaaugagacaucagcaaucccaucucuuuaaccucgcucugcaccgacagccauggcggcuucggggugggguccuaaucaugcacugugaaugcuccagguggaucaacggcaaggacugcagggcucaccagggugcagugacaacaggaaaaauggaauucagcaggagccccugaggccauccucagccagcaucuguguuggccugcaggaaggcagggaagccggagugagugagugguccucauguccccgaggcaggcgggaccaauggccgacgggggcuucugagaggcacagggcagugccugggucaagacugcugucagggaguccucgggcuugaugugggguugccaacaugcagaauacgaaggagcuacgguacucauuuuaaaaaauuacuucuaggagucauagaaugugagccuauggcgcaaaaacuaaauaaaacgaguggccucuugagggcugcucuucgcagaucauggaaaggcuggugagcugaagcccugggcaggcugcagggauugccugcagugacucccccggacccgcgccuucugccuggcaugcaccuguuuccugcagccagcuugaaaacucuucucccaggccagaaaaacagaggccagcugcaguugcccauggucagggccgugagggaggcaagacuggccuguccacugcaccgaguggugccaucaguaaagugaagacuguguccucucucaugucccaccugccaggagugucaggaucacagggaucccaaaggguauggugcuuguggagcucucaacugccccacccuaaacucgagugugcuuguuaaaguggacagggugccaguggaggcuggugggccaaucuccacagggacaagugacguguuuguuacacacggcugcuaggucgcucugaaaucugaaggcaaaaacgauaaagcauggacuucaagagcucaggaaaguguccucuccuugguuugucaaacacugacauuagcaggcccaugcaucugggaaaaagcagcagcaacaacucccaagccaacaaaugccaaggcaacggugccaaguccaaagacccagagcccgcaagcagccccucaggguccagccagaaaccucccagcccccguucccucaaggccagagggggccgaguacagagcucuccgggcucaccuuugaagcacaggcacucacagaaugguuuggcacccaugagaggggacauggagcugucccugagccuguccuccagggccagcccagcuuugggaugcagccucccccacaaucugccacuaagucuacagacaacugauacuacuuuaccuccauuucucgacagugauuaugaaauaaagacacugaacaaagugucuuacauauaaaggaagggaaacugggauccuguggucaagagaauuaucagcuagggcagaaacagagggaugcaccccuaagcuacucugcacacuaggugggcacacuaauaucugugugugggcuaaugccagguagccaagaccucaggugaacaacuucuacccauggaccacgugagcaucucagaagcaccagguugcauacggucauaggcuuuugaugcccuacaucugugcuguccaacaguugccacgaaccacguguggcucgaaaugcggcuggccugaauggagacaugcccuacgugcgacccaguggcuugccaagacuuagcaugaacaacaacagcagcaguguugguggcggccugccacuucccagaucagggcacgagagacccuguggcuuccauguuggccaugcuuccucucggguugcucccucugggaagcuggcugcuaugcugugagcagcccuguggaugaggaccucaggccuccugccugcggccaugugagugagccugaauggagcuccucccgccucaguccagucaacccugcagaugagaccacagcccugccugacaucuuaauaacaacauaaugggagaccccaucagcgaagcugcuccaggauuccugacccacagagcaagacaauacaaacuugcuauuuuaaacugcuaaguguugggguaauuuuguuacacagauauagauaacuuagucugguuuugugggauuuuucacuuuguuuacugugaccacuagaauauuuaaaauuacugguggaauuuuaauauacucauguauauuucuauuagacgguguugcucuaaaugguucuaaaugcagugacagcauauuauaaucacagauaucauaacuagccugccaacuauauaacuuugcuacauaucacuaguacauauuuccaauugauuuaauuuuaaaaucugguaucagauuaaauauuuguagacaguaaguaccaaaaaaagucuuuuuuuucuuaccgcauuuaaauuaaaagaaaauauuaucuuuuucuaauuauaaaagguuaguagagaaaauagaaaauauagaaaaguccuaaggaaaagaaaacacagauuugucaauacaccucccagcaacgaucauuaagguucuggugcuucuucccuuugguagcuuuucuauuucugagcauguuucggaugaaauuaggcgauaagcauuuuuccuauuuggaauaugcuuccacucaaugacuuuggaccgccguucccacucagcaccacguccuccacaauacacgcaagugcugcccgcgguuuguugccugguguuaccgucccaacgcagaaggccuccugcaggaacccugcaucaugccuggggccccagcacacuccgcggaggcagggcuggagucaccgggaguugagggugccggaggccuggcccacccgcagccccgcaccgcgccucaccuugaugugcucguggagcugcgccucgugcugccgggagagcugcucgugcugccucuggaacucagcgaugaggaucugccucuggaucugcugcuucugcuugagcgccaggagcuccugcugcagcugcugcucccgcagggccggcucugccacaggcagugagaacuggugguccaggcgcagguccaugggcacugccgagggggccacuugcagaggcagcgccguggccacauccacugugggaaaaacaagcaggagagccggucacugccgcccuuugcugucccugggccccagagcccccacccaacacacuggccaccuucacggggcgggggggggguugugaccauuugaggauuggauaccccucucccccugucccccucuugcccaacaaacucaaaaugcaagacucagaggccucuggggcccauuccucaagggcaaaaaccacaaaagcccaugggaggucaggccaggacgcacuccacaaucccuguuccuuccuccacccuccccgggaggccggcucucagaggaccccgcuacaggcccagaggccuugcugacgucauuucuagaggccaauaaugagaaaaauaaagaaaaagguuguggcuguucaaggaaaagcgcgggcgccaggucucagccaggaagacugccuguccugcuccucuuccuccucuuccaucgaagucaccgugccgcugugagagccacaagagcgugugccccagaagugguccagacagacgcucgagacccggagcccguuuccauggugagacaagcgcccccuuggaaaacauguuuaccagacacagccaacgagacgugcuccuggcucuuggcacaagugcguuccucugggcaugcguuucugcaccucgcgaagaaauggauuuucugcccuguacuaaugugcuauugagaaaaggcuacaaguaauuuugaugaggaacagaagcugaaucaauuucauuccuuacaaucaauaccaaaugaaagugagaaaaguaacacaggaagaaggguagguuuaaauuacagauaucacaaacagcccgaccugcgcaccccuuuuacggcaggucccuauucugaaagcaugcagugugugcaggcacucacucugagccagcacugcuccuggcacagcccagggacaucccagcgucacuucucagacacgcgacucugccgaaaacuucacugagaguccaagugagagcccagccugccugcuccccucccacaggcccaccccucagaaagcuccccauaaccaacacucaugugaccugggccaaguggggagguggggccuugcccucuaggagggucucaagcucagaggggugucugggccaacaagagggcugcugagaaaacagcuccucgccccucagggucagcaccuuugggcgugaccuuguccaggugcaucccugagagcagcccacccacguucacccugacacucagcccgucucuggacuggcuuaagaccaggccuugucagcaacucaguuccuaggaaaaccugcacuccacagucucaaagccaccgauuugggugaaacagcccauagguggcagcugccccugggugcaaagcauuuccacagucacugcccaggcagcaggucccacacuggcuuugucuccaaaccacuggagguccuggucccaggacucagccuucuccugagaaaagggugggaaaugcuuugggggaggccugggcacuggccggagcuugggguucugaucccuggguugccgcuuagccgugggagcugcagucaccugagcuccuggugcccagggugaggggugcucucagcuucucuggcugacuucacugucuccucaccccuccccugccccaccgcagucaaucaugcuccuaaccuggcccugcuggcugcccuggcuggacuggcuugaaccugaggagugcccaggccucaggccacgaagaccagcucaggccacuuuccuggacagugaaaagacacaaagcaacccagaaggugacagaagcuucugaauauaucugaucacauuccacagcgcagcacgggcugccucguuguuauuguuguuuuuuaaaugaaauccuccucucugacuguuucuguuucuuuccccaaaucagugaagugcaacccccaacuuuuaaaaugcauguauuuaguuuuuaauugggugucgacuuugacacaguaaaagguuuucauuugcuauuaugugagaagaaucuacgcacauaaacugcguguucaaugugcggaagcagggaguagggguccgcccaccccccaccccgcacaugggugaggacuguuccaugugcaggagcagaaagcagggguccacccaccccccaccccacacauaggugaggacuguuccaugugcaggagcagaaagcagggguccacccacucccccaccccauaugugggugaggacuggacccuauucauuuccuuucuucccuuuucugaucauuuuuaugacaaaauauagcaaaauggaaaaacugcguaagcaaugcugguuuuaugaaacaucagcguucaccuacauuugcuucagacuuucuuuuaaggaauaaaauauaugaaaggcagggaggagagcuaagucagcaaacucgcaaacucggagaaaagagaacggggccuggcuucuugaagaagacucagcuggcgggcucccugcugugggcacugggggcuacggguccggcucucacaagcacggcggugcuaaaugcuuuccugaacacacagucucgugaaugacugucagguugcgguucccucuuccgcguucauggcugugauuggcacgcgguucuccugggaccagugcccugcagugacuuccuagagugccucaggugagcgggcccgugcuuuccagggauaaacacaacuuuguucuucuaaguuacacagucagcacccaugggugaacccaucggggaaggcauacacuuguauaauguagaagaacaaaguugcauuuaucuccaggaagggauaaaguuagaaaaacaaaauagcaucaacaacgaccauguuauuuagaaugcuggugucuauauuuguaggugaaacuggucucucucauauucuuucuguuuggucaaacagagacauuuuagcuugaacaaauaagcacagggaauaaguaacugcacagcguugcaucuuggaagcuggguuauugccuacgucucgccucauuuaucccuguguggggggccugggugggaccccugcuuauaagaugugcugcugucacccaaggucccauguagaaacagggucccaccacaggcgcugggcagaggccugacccgcugcuggcuuuagcgcaucccccuccauuucuaauuucucacagauggagggagggggcagcauuguaaacgucugguguuaaucucuuuaaaaaccgaacauaaaacaacuuuuaagggauuuuuuuuauuaacuucaaaaacaugacaugcccgcauuuccacuccucauucaguucccaaagaacauucauggcuccugcugugugccaggugcugugggaacgggcccagggcagccgcuggggcgccgaggagcacaggagcugauggcaggcccaggggaagggcccacagugggcugcgucucaccgagggcaggggcugccugagcaaggacccagaggucugggugcagguggagggucauggggacgggggagcccagagaccagccugccaucugcaauccuagagugucacucaggcuuggggccgggagagcagccaagagcgcgaggggaagcagcagcaacucuggugcuggggaggacccagcuucucaggacaaaguggggaaggcggggcaggcucugcacacccaagguuggcuggccgaguggaauuuucuuucuucaaacuuuucucagauuccccugaaucuggaaucacaggacaucuuaaaaggaaacccaaguucauguuugcuccaaagcaucuaauagagaugacacuaacaugaucuugaugcaaaugccaccgaagcuauuucaucagggucagaggcaaaauucaguguacugaaauucccaucacaacgcaggcaccuggccagaucugagcccgggguggucaaugcugaugugggccaagggcccccaccaccugggaguuuucagaaauggaaaaugaucacaagguuccucacagggaugccggccagcauucaucauugagcguggaggagaugcgcucacuuggaugccaaggaggacaggcagcgcccucugaagguaagaauugcucccuggauguagccucaucuggauaaccuacacaacucaucuuuccauccagucuacucaagagcuauuaaugcuuuaauuccuaaggcauucauucuuuaaucuguuccuuaagcuguuuucuuggagauuuguacaaguucugcaaauuaauucaaauuucaucuuaaaaggaauuugucaacuggacugagagacaaucaaaacagucagacacggaacaugcugagcgccacgcugcugccggggaauucucuucugaagcuugggugacgcuccugcccgccucacaggcacacagcugaaccuccugugcgugcaucaccugaacggucacagcucgacccaagucugcucuuaaauuccaccaccugugaaacagccagcgagcagccuggcccagcacuccccacucccaaaagacaggacccuaugggggaagaaacugcugcccaaaucuucugaaugucgcuuacaaacuccuuuuucugcuaaaaccuuccauucugugacagcacagagaggaugaugcagacugcagcugggaagcugcuuccuacuccuccaggccccugcugggucacccuagagcugccaaggccagcaacugaggaggaggagggcaggcaggcagggcuccuuccagccacuccagcuucuccagcaguuuagcgcaugcuggaaggugcuggcgcugauccgccccuggcagugcuggugagagaggcaaguuacuccucgcagaucugugucuccagcucggugcgcgucucccuacggacauggaagagugcggguccccugaggagcagggaggcgaggggcccugcagagcagccaccuucugcugagaaggagccuggacucacuggcacagugcagccagagggggcuucggugggcaccgaggcuggggagucgggcucaccaaugcgcagaaugcugucgcuguucucacuacggcaccuccugcauuuucacucauuguggggaagggauguucacacugccuugguuuaccggacugccacgugaaacuccacuaucugcuaaaguaagcuaagagcagagcagagaaaaucaacagcagcacacgccgccugcaucccaugcgcaccuccggccacggccauugcucaccucugaagacaaugcugcauuuauguuggauucaauaacacaaauggagcguucacagggcaaggagacccaccccagggcuccugagggcuuccuaaugaggauccugggagccggguggguggggaugaggcccaagcugucccaggcccggccccacacaccagcugcagagaugagaaccacaaucgcauucacgcauucgugcgccuacggcugugucagacgugacuugugcuauuucuguaucaaaaaccauucaaaaugccacgaguucccaacagaagcugcuagugcuuuugacccaaagcacccugaagaaaacaauaaaaccuucucuccuuaaagaaugcagcaucaaaacaaaaaagucuguauucucaugaauauucuacgguacagcagaaaacggcuuuuauagguugugccuugagaaacauauuaagacaaucagacuccugacgucagugagagcacaaaggccgcauucagaguccaaugggagacggucagugugcugugaaugaauucucaaucacaaacagaaaaaccuguuagucucucucucucgcucuuuuaaaauaaauguucauaaagaagcauacugauuuuccacgacaugcuuagguccucuucucaggacgcgauuucaugccaucauacagauauggaagaaaaagaggcacuauucuuuagguaacacagucaauguuuagggucucuucaaguaaagaaugacucauucaaaucaagggaaaaauaauagauauuucaacuauguaaccaugauuuccucuuacacugauauuuugccucuauguggggguggggggaagagagaggaugggacagaagaggagggagacagcacaucagaaaugcaugacuuagcuacaauguccuucacccuuuauuuauugugcagugugccauccaugcugaagaacaaguauguuuaguaaaagaacaguaaugaaaccagcaccagugcauccuccgcuucaaugaggcccaaacgucacccucugcgucccuucaaaccacaugcacccccuaccccgugagcaacauccugaccuuguuaaguguccucuugcuuugcuaugauaauaacaucugcauauauguggcccugaaaacacguccuuugcuuucugaagacugaaggcagcaacaccagugcaguggaaggaggaguugacgaugguucccgggacaggacagucucgaguccgagucugccgucagcuucugggacaggggaccagagcuucuucuggggugaagccacgggugacccccaggaaaccaaguacaccccgucuaacaucuggcagggcagucauguggaccagaaccaggugccagaagguguggucuggggggugagcugcccuccaugguggccaccuccagcucucaggugggaacugggcagaagacccccuuggagaaaugagugaccucggggaaucgaggcaguggggcaaggaagagagaguggggccauguggucaacagaggucaggcacagacaagcggcugaguguugcauccucagguuuaggcagcgaggcaggcagucuggugaggccggcccagacgcugccuccgaagcugugccacucaccccgggcaggcgcucccucugucugcacugcugcuggccuggacggguccaacuccuccaggggauucccucugucucugcccuaccuuaagucucccgcuuccuuugucccagccaucgucuuccuugguuuauuuucucacucugcagaacucaggcuccagcugugucuuaaaaagggaggcaugagaguaaguucugcacaucugaaaacgugucgauucuccccuucacgcguccugacuuuggcuggguauagaauuccagcuugaagaccauccuucgccuucgggauucugaaggcgcaacucuguugucuuccucucccaguacugucaggaaaaugggcgccacgugaugcugcaccuugagugugacucgaugucucucuccggguaucuauaaggucuucuccaggcccccagcguuccgaaauuucgaagccgugugguuuggugaagaccuuucacacccacugcugggcgccuggcugguccuuuggagacggcagcucccgugcucccaucguagggggcucccugaagcacuucaucaaggguuccccuuucccauucucuccuucuggaacuucuaccccuugaguaggagaucucccagaacaauacugggucuuuuccauccucccuguuuuccuugucuuugucuuacacgcuucuucaugugugauuuccuuaaauguauauucuaaccuuuuaaaugagguuucaugauuuuugcuauuuuguuucuaacugacaaauaaaacagccauuuucagaggacaauggacccuggauauucuuuuuuuaaaaugucauccuguucauauuuccuagauaaaauaucuugucuagucucugaagauaguaaugauagcucacuaaaaguuugugugugugugugugugugugugugugugugugugcugagugucacccaggcuggacugcaguggugcgaucuuggcucaauacaaccuccaccucccggauucaaaugauucucaugccuugccucccgaguagcugggauuacaggugugcaccaccaugcccagcuaauuucucucccuuccucccuuccuuccauguuggccaggcuggucucaaacuccugaccucaggugauccucucgcuguggccucccaaagugcugggauuacaggccugagccaccaagccuggugacaaguuuucuuuucccuguggagucucuguuugcucuccaccgucccugcaaaagccuccccucaggugccugguugccccugguuauguguugccgagugugaguggaggcacgaaaaccaccugccaacugugggcacagucugguucucaaugccaggcuucauggagggugacuggagguggcaucaucaggaacccccuggcucagugcccagagaaccuuccccuagggcuggccuacuguccacgagaggcgccucuccauccugggacuagagggugagagcugggccuucaguguaccaagggagggacccccuacucaguguuugcuguggacacagugacuagccccccguucuugcugcaguacccacauccucagcuugcuccuguccccaugcagaggcgcucaggaucauagucgcuggagagcaccccuuuguggcagcgcagcuuccaucuggugaguucucagugcuccucgugguuggcugagaucuguuuuuugggucugcugaaucgcugugacucugucaccugcugucaguugccaggcucucauucgugucgccccucuucuguucuccccaucuuugugagcuuaugaccuuucucuggaauauauauuuuuaucuuucaugagaaauuccaaaaauacacaaaagcaugaagaauaguguaaucaagccgaucucagguccucugcucauccaccacuuccccaccuucuagaugacagggaagcaggccccagucgucacugcgaagacuuccaaaucaaaugccaucaacacacgcaaauaaauggacaagucuguaauauuaugaaguagccagaaaguguccccauaguuucauaaacacuuuuaaauauuuuguucaaaucacgauccaaauacauuguaauuagcugauguaucuuuuaagaccccuuccccugaccuccugcuuccugccccccaccacccccaccccgauaauuuauuagcugaagacaucgggucaucugcacuuugcugauuacacccuggugcugacgagcaaggcucugucccccguucuucugaaagcugggugcucaccgagaggccuggucagaggcagcuuagacuucccagcaaggccuaaggcgaaccccugcucucuggguggcuuuuuuguguugcgaaggcucaaaaugaucacugacuagauucucucaucaggguuaaaaacagagcucuucgagucccaucagccccucuccauguguuagcaggaccauuucuauaacgggaaggaauccaagaucaacuaucuuguuacucucacaaacagcgcuuaugagaaaggcagugucaugcuugauucucuuccucgguuugcccaugucugaaaauccugagugggucucguggcagccuccaaacucgagcagugaggaggguguguuuuccggucacuguuuacgaaugcucacaguccuguccuugacgagcaggagccccgugguuggaucgggcggcccuccagacccugugagugcucucugagagcagcgcccuguucugcuaccagaugcuuuggggucuuccuguacauuucuuuuuuuuuuuuuuugagauggagucucgcucugucacccaggcuggagugcaguggcacgaucuuggcucacugcaagcuccgccucccgggcucacgccauucuccugccucagccuuccgaguagcugggacuacuacagacgccagccaccacacccggcuaauuuuuuugauuuuuucaguagaggcgggguuucaccguguuggccaggauggucucgaucuccugaccucaugauccaucugccucggccucccaaagugcugggauuacaggcgugagccaccgcgcccagcccucuuccuguacauuucuugaccccugugugggucccuuucuugggaaauagucuuagagaccacagucuggagacugggguaagcgcuguuauuggguugggacuuacgaacuaucgaucuuuacuggcguuuuugugaauuuccugagggacggacaugcguguuugaccugccaucccuccucagagcuauggagagcaccucgcgcugaagcugacauucaaacgccugaacggucauaacugagacccauuccaaacgcugacuuacaugugaugucauuuucccccaguguucuuaacugaauugcaacuguuguauuuaccaugguggggaggggcacgcacgcaaaguagagacgagguagagaaaguagaaguauucuuuaagguaaagauauaaaaauauucuguagauaacauguaacuuaaguggcccuaccuuggagcuucguauguaggugaguuuuuauaugccacuucuguuucucucauuuagauggauauaugcaaugccaaagacaaaagcuuauguuaacaaucacuguaaguuaaauuaugcuugaaaaauaagaauaaaaaauauuauggugcaagaagaaggugcuuuguauugcuuuccauugaaaucaaaauguaaagaaauaaaugcaaagagaagauacagugguauuuauggaugugcacaggggaggcuuucucuguguggggcugggcgggagagagacgcgucacaggcagauugcauucgacgccgugcucggaguggcguucucggugcagaguucuagcaugaaggcagcugcagcacauggccaggccuggauggcacugcgcuuuagccuucuagaaaagaagggagguggagcucuucaggcucccugagaacugcagcagaggagacugcucgcucgagcaggaggugggagagggcccacacaggaaacuuccccugccuccuuguccucuucacuaccggggaaucacagggccuggggugaacucuggcccacggccuuuagugcugauguauuaauucauuuaagggacaccccgcuugacaggugugggaaacugauguacagacaguuuuaagugacuugcccagggccacacacuagugcacagcaaaccagaacccuggcauccuaaccuggcugaacagugagaggaggcuggucuugcuggaaacaucaggggcugaaggaguguuauggggagcucacaggucacccaggggggugccucaggcuggguguggucagcaacacagggauuugggagcaaugagagggccuggguccuaaccugccguagagacccaagcaucccugaggccucagaacuucugcuccggagucgauggucuuccaaagccagcacugggggccugcccgaccccucggccugcucuguguggcuugggcuuugguuucauuccugaccaaaggccaggccccccuguaauuacuauuugcugagagccuacagcccacagcucuccgugaauaaagucacuuuuuccuaaaaagcuccuggggcuguggcagcaaccuagaucugcucccacaaagcugcucaaggccgagacaacagccccagaggcacagccaggccccaccucccuucucaacagcaccagaaaaacaggugacgagaggggaagcccggccaagcccagccugcugagcacagagauggaaacgacacauuccugaaacaguauuuucacugcuaaaaauaaaaagcuacaauuaauaccaggugugcauuuuacuccacugucuuuuuguuuuuguuuuuauguaaaucggcuuucacuugcaccaaacucaaagcaccuuccaaaucuacguuuucaaacugcuuucuuacuggcagaaaaaaagucuaaguagaugcaugcauaauaagguaugaacucagcccaaaucugugccacugagaaggguggucccugcaguuggcaggaucuuuccccagccuccaccccccugcaggcaucuccagcaucccagggcuucuccgggucugcuggacccgagaacauucugauggagaaggcgagcgggugcugcuggagggcuggcugucuccaugcccucaccucauccacgaaccuuggaaccagccugaggggacacuggcguaagauggggacuaccuauaguaggaagcucugcagucuccaguaccagacugcaggaugguauuugucaggaaagccuaaugagaguaaucuccacccagaaucuccuuuuagguugucucacaggacacucagauagaaagaccuggucucuccaaauuuccaguguggacuuaagacacgagaagaaacagguaacaccuggagacaggcaaaguggggcaguggacggggcguagacuuggguggggugugaguucagacccagcggggugacucuggagaagguacccuggccuccaucuaucggggcgacagcaggaugucugcuuguugcagggcaaccggagcucugggagaagggcuggcauggguguggcugguauucaacacaggacucugggagaagggcuggcauggguguggcuggucuucaucacagggacaggaugcacccuccacgcgggaggggcgguggcagggccaugcaacauggagaaucaccguccaggagagacaaggcaaggcuuccucgauggagcuguacccccugaccucaugagcuccacacacuucugggacaaaacagcaggcccagaaaaagcuuuucaucacccagggugauaaacccagugaucaggaugccacgaguguguccaggagggcgcagggcugcagguuuuggcauguccuguuaguugagcaccaggaaggcaaagagcauugacaagaaaggaagggccuguccacgccgccugagcagcagcagacugaucgccgcaccuggauguaggcuacggggugcagcacagcccaggcagcaagcccagacuccugggugcuggcagcgcugaguggagccucagcccuacaggcacacagcccugcagggcuccugugccauaggguggcaggcagaagcuaccgcgaaaaggccaagggccugaccuguccacugguccagcaagagagcgggaaacaccaaggggaagagcucaguaagcccaguguggaugccuagcccuggagacuccaaacccccagcaagugggugcccacccagcacagacaagguggacacaggugcaccugggaagaauccucccugucccuuuuuaauaauagaauuauucuagcaaaaucagugucagcuucacacacgagucaaggauaaaaauacguuugaccgugcucagauuuagaaaauuccauuuuuuacucuaacuagaagccaagaaggcucauuggaaaauacaaaaauuacacuuucaggauauaagaaagaaaccaaaggaccugccuuucccucccuccaggaucacuaaccaguaugaguccuguggucucgaagcugaaccgcuuuaacugaaacagacuuggguucuaaaacaugcaugaacugaacguccacggucugacugucuucuguaaaaggaggguguggugacugccguggugacugccaaggcgaccacagacaguugcccaucccugacccauaguccaguagggaaagacuucacugcagccuccaucccucacccccagcccuggcuggggauuccucagucugcaaaaccuucuguaugcaaagcaguggagaugagggacugcgagguacuaacacagacacgacacuaaaauggaauuaucagcuucaauggauucgaguaggacucagaaacacucccgcuucauaaggcaccaagaaaauaggagcugauuuguucuccacugaagagggagaaagaaacacuggcuuucauuuccucagcgcccuucccacagcuccugguuaggaguccggguccaaugcauccaucgagcucucucucuuccaagggaaauaaaaagcucuucauaguguaggagaaugaagggaagagaauucgaacaaugaagcagauucugguaaaccucauauuccuguguaaagcaggaguccucauuucuaagcaucuagccuggcggcuucugugaaccugugagcuccucucugcgcagggcauccugcuggccggccgugucccggcguccccaugcugugcagguguagugacugcagauagacagccgaccacaaugcugaccacgaugcagcggccccugugcccgggccacgggcccuccaguucaggcaguggugacucggccugggcuuuauuagaaaaggcacccugaauacacagggcuccguagggaaggugucuguacugcggaggguucgggaacacaaacacgauuucccaggcagaaugucaggaacggcagguagcuggcaggcaggcugcgaugggcccagggaaaugggcagagggcucugauucggaucacguccagugaaaccggcccuuacagucugccaucugcacugccagccccuacgcuggcccaagaaccccugcuuucagggaaaagaggguccguggagggcugcaccacugaggugugcucaggaagggcuuagggauggaccaggcgucccgggccuggcacagagagucugccgcuucucgcccuucaacagccagacccugggaaugggucagguuucaacccugcauccaacccuccaggacagagggcaccccaagucuauccucuggagcuccuaucagggcaggugcugagaccacggaggggccucugauggccccuuccucuguuuucagacaccaaagccucuuaggguccccauugcccccaacagagcuaaccccugcuaccugggucaaagagcuaacucaaugucacagggaaggugucugugcuccucccuaccccaccugucaucaaagcugauugcuagggccuccccaccuucccccguccccgagccgccucugucccucagcacugaacuccugcaggcacucauccuuccggccuggucuccccaccccacguggcuggcagguggcaaggccuacauuuaggccagggacucaggugccagagucuguacucugagcugcaaaccucuacauacugucagaacucuggagaggcaauauuugaagauagauggcugacaauuuuccagaacuggugggagacaugcaucuacagacacagaaagcacaacgaugcaugaaaaagcagaauggaaucaagacaacuucaaagcgaaacagcagaccgcugagacagaguucagaagaccccgcaauaugggcaacguuauccaacaaaggaaaugcagucacagaagccaggaccagugagccucugagaacuaagagaaagccacugucaagcuagaaucgcauucacagggaagcuauucugcaagaaagcucaggauauaaacauauaccaggcugaaaacuaagaaaguuuaaaaaacucaccaggaagcagucaggggaggaucaacaacauggaggugggcagagaaagggggagggaagaaaaggugagcaaagaacugggggcuacggagagaaaucuaaacagacuucaucugaacaacacaggaagaagaagaaagaagaaggaagaggaggaggaggaggaggggaggacgaggagggagggagaagaacaaagaaggaagaaggaagaaguuuaccuaacuugugggguugaagugaaggaaaauuuaaauaguagagaacggcaagaggugaauggggaaggggugcucaguguuaaagugucuguaacccacguguuguagaggucagggacauaaaauagggacuuuagacauuuuaagcucaugcaguaacguuucaccuuaacugccaggaauaaagcacaucaccuccaaagcagcggucagguuggggcaggauccaucagaaagaauuuuaaggagaagaaagaaauaauuuguuggauaacgaauauggcuguuaguuacacccaguggcuuacgccugcaaucccacacuuugggaggcugaggcagguggaucacuugagcccaggaguucaagaccagccugugaggcauagcaaaaccccaucucuacaaaagcuacaaaaaauagccaagugugguggugcaugccugugguuccagcuacucaggaggcugaggcgggaagauggccugagcgugggaggcagaggcugcagugagcugagauugcaccacugcacuccagccugggcaaaagagcaaaaaccugccucaaaaaaaaagaaaguaauuaaauaaauguuuuaaaauacggcuguuauauacaugcacacauacgugcacacacacacacacacacacacauggguauggcugguugccucccaaaagaggugcaccauugcaucuauaaagucuuaccaaaaauaaccaagcuugaaucugaucaaaccucuagaucuaacugccaauuuauaggaaauccaggcaacaaaggaacauuuuaaaugacaugacagggcuaaaaucaaguaaaauuuagaaccuaggaaggaaaacucugugggacaaacaauacagugucuucaacagauaaaucucaaggacugaaaaaaaaaaaaaagguaggaagaagaaaccuagagauuaacugaggacuucaugacaggugccaaucacaguguaugaacacugcuuggacccagagacuccugguaccaaaagucaaaccacaaacuaaaaaagugauuuuaaacaccaucagggauauaucaacauuggguaaaaaucugcuaauaauaaagaaugguucaucuugucuaaauauguacaucaucaaugcaguaaaagagucccuaucuuuuagagagcuaggcacuagaauguuauugaugaaaugacauggugacuggggucugauucugaaagacugagaggcuggggaugggagggaggccuaaacgcaaguacuggagggacugcccuggccuaagccaccugaccacgccccagggcucacuccaccugcucuccccaccgcuggguaugccuguaauucucuacaauagaaaguucaauuucaaaaaaaaaaaaauuucuaaauaucuaugggccaaagaagaagccauaacaguuaaaaagaauaagaaugaaaaaaauacauacaaaaucuuguaagauucuguuuacuauaauuagaggaaacuugguagccuuaaauacuuauuaugacaauaauaauacgaacugaaagacgagauauaucuuuaagaaauuagaaaagcaacaguagaacaaauccaaagaaaacagaugaaagcagauaauacauaaaugaaaugaaauguaaucauuacauacacucauauacaccaaaauaauuuuaaaaagugauucucucaaaagaccaauacaagacaaacuucuguuaugagugauuuagaaaauaaaaagaauaggcacaaauuaaaaaacauuaggaguuuaaucaccuagccucagauauggcagagauuuaaaaaauaaaaaaauacaaaggaacaacuugaggccaguaaguuuuaaaacuuacaugaaguagacacauuucuagaaaaacauuccaaaguugacaaaaaauaaauagaaaacagaauuaacccuauaaucaugaacuaaauugaauuaauacuuuaaaaucuuuucacaaaaaucauuuuaaaggcagcgacagccacguuucaacuaauggaucaugcaacuuuaaacaaacucuucaagagaaugcaaagggcaggcaggauccugagccaauccuaugaggggagaauaaauauccuuuuaaaagaacugggcaaaguauaaaaaagacagaaaaauuacagucuuggucauaaauacagucacaaaaaucucaaauaaacuaugagcaagcuuaaucuaauagucuauagaaaagacagcagaccaauacaccugguguuuuaacacaagaaaacacaagaaaaggccgggcgcgguggcucacgccuguaaucccagcacuuugggaggcugagacaggcggaucacgaggucaggagauggagaccauccuggcuaacacggugaaaccccgucccuacuaaaaauacaaaaaaaaaaaauagccgggugcggucgugggugccuguagucccagcuacuccggaggccgaggcaggagaauggcgugaacccgggaggcggagccugcagugagccgagaucgcgccacugcacuccagccugggggacagagcgagacuccgucccaaaaaaaaaaaaaaaaaaaaaaaaagaaaacacaagaaaagcaaccuauguacaaaccaccuauaaauccaacucaccguuaauuaugaucaucuucagaaugaaaguaaguauauguuaaaauccagcuauucauuauaaaagcuguuagcaaacuagaaauaaaagagcgcuucuuuaaccaaaaaagaguuaucuauuaaaaggucccagcaaauauugcuuuuaauggugaauccugaaaaagcugauguaaugauacaggcacaaagggagggaacacaacuccugauccagacuccaaggcuacagauacugagcuccucccacccccaccaccugcaaagagaagaaugacagggaagucaauagagcuaauaaggaaauguaauacgguguuagauaagaucaacauagaaauccaauuccacuucaacauacugcaacaagcagaaaaccuaacauaagaaacaaaaaaaauacaaggcaccuagaaguauuucuaacaaaaaaugagaacgaccuuuauggauaaaaauuauaaaauauauugaaagacuuuuuuucuuuguuugagacagguucucacucugucacccaggcuggagugcaguggcacgaucauggcucaucgcagucuccaccuccugggcgauccucccaccuuagccccucaaguagcugagacuacagaggcgcgccaucacgcauggcuaguuuacguauuauuauuuuuuaaagaggggguuucgccauguugcucaggcuggucuugaacuccugagcucaagcaauucauuugccccagccucccaaagugcuaggauuacaggugugaucaggccacugugccuggcccugaaagacauuuuuaaauggucuaaauaaauggcaagauagcucguauucaaggauaggaagacuuacuauucuaaagauagugauucucuccaaacggaacuacagguccagugcaagguaguucaugaucuuaaaagcugaauauaaaacuacauggaagaagaacugagaagcaguugagguggucccaaagaggguagaugcagguccuuugcagauuacuguggaaaaaacaggguguuccacaaaugcagcugggacaaacacuuauccuacuauucuacggggaacaaaaagaugggauucgucccuauucacaccacaggccaaaauggauuccauguggauuaagacucaaaugugaaagacaaaauguugaaauuuuuagcagacacuauuggaaaauauccuuggaauagaaaacucaagaugugaaaagugcuucuuacgacaaaauaugacguuguuacaucugacuacauuuaaauuaaaauuuucugcucacuagacagccuuaaaaagugaaaggcugaaucucagaggagcuacuuuaacacagcaacugacaaaggaccuguauccguaacauguaaguaacuccuauaaagccgccagaaggagagaauuccaaagaacagcagaagguaugaauggguuggucacagaagacccugacagcaggggaaacaaaggaucaaacgcuggaccauguuagugagggcggaaaggcaaaucagaccccuggagaccccacuuuacgcccaccgacccaacuacggguggagaggcagggagcgggggcgugggagcagcagcagcaugaaugagacggggccuucuagaacagugggcuuucucauagacagccgaaucucgcuuucgugacccagcaacaagcccucuccuuaggacagccacccuugaaaaauuccugcacgucuacacaaggagaaugguacaaggauauucauuauagcagcauuaacuacaaaccgcccaaauaucaacagagcaacagauaaacaguggaauauugagaguguagaauuguaucuggcaugaaagugaacgaaucccagccauguggaaugacguaaaugaaucuuagaaacaaugcugaguuaaaaaaacacaaaaaacaaaaacaaaaauaaacaagcugcagaaaacgacgucaguaugauuucgauuauuaaaagcucggaaaagcaaauccaaaccguaugcugacugaggaagcauacuuacacggcaaaacuaguuuuuuaaagaaaguaacucagugcuaaacccuauucucagcguuguguuuuggggaguggugaauggcuuuacuacaaacguguacauuuauuacccggccugugagcacaacggcuuggggcucccuuggaggagaccggcccugcuuaaaccagcacagggaaaugucuugccccacuuccaccaaaagugacucgcuugugacacaagguccccuuuauauuaucauaauaaaggaggaaacgccaguuuagaggacagagugacggcacaaaauccuaccauccugaauuccuggugacagaggacacucaacaggugggauaagaacauuuauacaaugaccugcuugggaucugagccuggaacgcggcugagaccagaacccucucgagugaaaaccaaccagcuccugcggcaccuuccacgggacaaggacgaaaaagcacuauuccuucgccggccaacucuuaaaggggauuuauggcaugaaccugaucacagaaaacacacuccacaaacacugaggguccuuuacacaugccauccuaaaagaagguggaugcuggccuguccugcuuuacuggacaguauuugaaaggcuggaugaagcaaucuuaaacguuacaauaccugcagaucagaagccugacugcaggguaaaaucaccuagcuuucaugcaucgaaaaucacuuucucacaaaaagauucacuuacauuccauuuuaaauggaucuauucaaaaauuuaaacaaaaaugucugacagaagaaaauauauuauuucuuucauccuauuuuuaauauuauaaacagaauuguugcccucacaauacaaaaucacuaagcaguauaaaagccagcuuccagaaugcuggaaagaauugggcucugcccuuccugagagcccugccccgugcuucuccugggggccgaaaguccugguugcuaacggugaugguccccagggugguccgggccccugcacacaucuugacuggguuuagucaaaugaggaugaagaaauccccagcacugaguuuuaucuugagauaaaagaaacaucaaaggaaucugcauuugaaauugccauuccguuaguuucucaccucacuuggcuuaacuugaaugauaugguugccagccaacaccagacuccaauucuugggacuuugucugaagcaagggcugugguuucuaaacccaaugauucaaaagcugaagcugcagacacaccuuuaaaucccaggcagugacuuuuccacuuugcuuucacugagcugucagauguucuuaagccauauaacauauuccccagaauccagcaucuuaaacugucuucaaggacugcuauaacugaucaugccuuugcuuucaaaaauaagccccgaaaaaaaggacaaaaacaaacaauccagagguaguggcaccacgcgccaccgaggagcuuccucgagagcagucccgugcccugcagacgcugaauuuagacuucagcgugaagguacaaaggguuccauucuccuuagcugacuauuucaucaaaagcacagggucacuuuuuagaaaacaucccuuaagugaaaaaugcucuugaagacuuugcucuaaugugaccgaugggaagguugggaaaacgauguucugucucacuaaaauuuuaaucuguaagcccaaugauaagcauuuuuacaaagaaacagauaaaagugaugugaacugggaugcuuuagauuucuagaguauucuuaggagccaaaaucaucucuaaccuuaauugugagacuugguugaaagggucuuucuacccacggccuccuggcugagcugggcgggcagggggcauuucccucuugacauuuaaagaauugcuuccuguaaagaacacaggcuagggcacugacccgacucccucaaccccauucuaaaagcaguuuaaaaaaaagaagaaaaaaggaaaaaagauauaaaucucuccaaaaacacagaucccacaagcagacagcagccauagaauucuggaagccagucgggggcuggcugaccagagagcugaagccaggcuggucugaaggccagaauggcccagggaaggcugagcuauaaagagcaugugaccccucaucccuucugccccccauacagggaccaaccccauucccccagaauuccccaggcuuggugcuaucaggcugagggcaggagcgccagcaugggcaguaaacaggggcagugagagcugacaugccaaggggugaggcugugugagccaggccuggacuccagggaggagcugggaggguccucucugggcuaagagaacaggacaacaggcaguggcauccaggaccaccaggaagugaucaggucccugucugccaccuggccaggaagauaagcagucaacaugccccgcccagcuuguuagagacucacucuuagacgcuggccagccaggaucaccaaacauuugggaaagacucuaauuugaaaaacagaaaagcagaccaaaacaaaggcccccucuagccucuguacccacguggguuccagucuguugacuuguucacuucuuuacugucugccccucccugcaaucgcccaggaaaacgcaaagcuggaggagguguggcaucuggguugcucucucuggucccgccaguacccagagcuguccccagaauaugagacggccacgaugcuggaaggaaggacaagaaugaggaggaggagggcuuagcacagcucaucagucccauaacagcaaaguaggggccagggaggggcgggcggggcacagccacaaggacagaugcuggguagccaggaggaaugcugaagggugagccguggcggaugcugaaaaagaacgcacucagcaacggccaugagguuucuuuaaacccaacagcacaacucagcggugcccgcgccccucauucccugcucgcugaagacugcuacucaaguucaaccacucacuggaggauugagcucuccacaagaaacuucuggacccuacacaaacaagccugcugcuguugcuacugcaucuggaauucacucggguucuggaggcccaucuauugucuauccccaaaagccugcaucugcauagucacaccagcuuguguuuuuccagcucggagaguggccggagccacuacccaacuccagcaacaaaacuccugaugugcuuacgcuggaaaacccagcaucaggguucccaggagaaaaaccaaggggagacgcacaggacagcccacauucagcacacacugaaauaaaagcauggaacacacacugccugacagggacagagugagccuucaucuccagcucccuggagcgcuugcagugcacagggcagggccugcccuccaugaguacacagcuggaugagggggacccgcaagaaagcagaaagcuaugcaaagcaugugccuaaccgccugcuaguccccauuucacagauguggaaaacugaggcagggagguagagaaaucugccuaggucacaugguugggagugaaaagcugagucuggcugacauaaaguugacaggcucacucuggguguuagcuucuugugcuugaugugugugacacguuacuauaaacucaauggcuugaaacaacguauguuuauuaucuuacaguuccggaggccagagucugacaugggguuuacggagcgaaagucagaaagccagcagggcugugcuucuucugcaggcuccaggggagaaucugcuccuggccuucucuagcuuccggaggcugccauguccccuggcuccuggucccuucucuccucaacaccagcaccugcauggcccugucgacacucugucugcauaccuccucugacuccgauccucuugauuucuuccuuaaagaacccucgugaagacaaagggcccacccugaugauccaggacaaccuccucaucuccagugaguaacaaccccaucugcagagcuccuuuggccggguaagguuacacagucacaggggcugaggauuagcugagggacauuucggggguuccauuauucugucaaccgcacucuggcuccuuggccgagaucagacuagaggggcaagaacagaauuggggccaggugaggaggcaccugcaacagccacaugggugacaccuguggcucgccacgcguggcaaugcuggagcugugagcagccgccaggcucagcacacguguugauagcuuuaaagagguauauuuuacacucugcccuucucaaauguacaauccaacaaucuuuuaguagauuuaccaagauuuuagaacauuuucacauuugacugggacccuucccucugcacacacuuuaaugggcagcugccagugcuggcugacaggccaugcaugggacuggagagaaauaggagucaaggggacucuugggauccugagcccggagguugcccugaguaggagaggccgcgggagaagcaaguuugcaggggaagaucaggagccugcuuucaaacuugcugagucugagaacgcccagcuggggaucgacggcaagcaggcucuaggaucuggaaggcaggugagauccaggcgggagcagacauucgagcggcagaaucaagaugguguugugaucuaugauuugacuggaugaggccaggauaucaccaagggaaugacucaguggaaacaaggagugggccggagacaagcccuggggcgcuuggaugugaugaugcuggagagauaagaaaaacccaccaaggcaccugaggacugguggccggggcgggggaagguaccaggagcauguggugugguaaggaggugcuuccaccaagucaacacuggugagaggccaugggcugaggccgggcauggaagcuggcaacagggagucacuggugacacgaaaccaggggcuggcugcugggagcccagagaagcagggucgacgccccagaaaccugggcucccugcaggccaaagugcccucccucaucucaccugaaaucaacagggagggcaccaaagaccgucgccaaccuccucacaucuggagugggcaagggcucaggacggggcuggcucaaggcgcagggagaucgaguucugcccaccuggacuccaucucucuucucuggucaacaacaugaauggcggcaacacuaggagacauccccgcaggaaaugccacaccucucucuaaucuccagacagcagacaccccuuccccacuaaccaaaacagaaacaagacacaaaaacuucaaaacaagaaaguguggacuggcaaagcugucugcaccagcgccucugcaccgggcucccuggaggacgcggucaucaguuccgcgcaggcacugggggucugcgaaucuugguucauaaaaaaucacccugaauaaauaaugaacggugcaaccucucuggaaggcaauuugauaauguguguuaaaguccccaaguaaauauuuaugccauuggcuggacucauaaaaguuaugauauauucauagaaugcacccaaauuuauuuuaaaauaauagguacuuuuaacacauuaaacccuaauuuguuuaaaaaaucaaacauauauacucuucagcauauauauguacaugugcuuacauuguauauagcuuuuacauuuuaauuagggccauauuaugcaugcuuuuccccuaguaaucacugugagcacuuuccacaucaaugaauauaaaaacgcacguguuuauauauauacacacacacacauagauauucacacauacucacauauguacauguauauguaguauuuaugcggaagauuccauucaagaacaaaaaugaaauguucucacacaucuucccagagaaaaaaaaaaauaaaagaaaaagucuccaaaaaaccuuggcacuaagagcugauguucucauguucugaccuuaaagacaacuggcgaugaggaggaagacgaugaggagggcgcccuaccagcccugaucuugcccucucaggacaccuggggacacaggugcucacuguccacaccugcugcgcugcagaccacuaacaaccaaaaccuucugaagaagagaaggcuuuguuuaacugaguuuuuaauuuuaugugaugcugaauauuuaugguaugaacaucugagccuuugcucuugaacugaauguccuuccaggaacacagccuccuucucugggugaagcuccaccugccagacccuccgccuucacucugcccugcugcacuccuuccuccugugggcuacuugggccccugggaacaggacugaccgggaaggguguguguccugccccuucccugugccgggaugggagucuggugagaagggggugcacagggguuccacccgccauacucggcaucuuucuaggcaagucagaaugugcacaggaaggaagcucugacuaagcuaccucgaacuauucucaacaauuucuaaaugacacagucccugguuugucagaagagaaguaaguagcaaaagacaggugacugcauucacgccacuuucccuucccccaguguaaccccaaaccccgagcccccuuacagcucuccuauagaaagggagccuccuuggcagacauucucacacccugggccauggcaggcugcgggcacugggccuaagggugggcucaggaggacacaccuccgcagggcuccaaaggggacccgcugguggcagagccugaacacagcacaggcgguagcagggucuccaggagccggcagcaucgcucccggaagcucuccaaaagcaagaggcccgucgacuccccuucaugguggauaaucaagcgaccagaucuucaaacccaacuuuccaaaaccuagugguuaaccuaaaauuccucgcauuuuaaauggaaaugguaaugaaacugaaauuugggggaagaaacuuaauguaucuguuuucucauuuuucucagugauagaaucaguaaccauuuuaaggcuaauaacuugauaaaugucagucuaaauauauuauuuauauguuauaaagagaaucaccaaaacucaaaauaacacugcaaguaacaaaaucagaagguuggagaaaagagacggcagaaagugucugugccgacgggcuacucucucacaucgucugaaggugcuggaacaggaaagcacaguuuagggaaagcguaugagcucauaagaguucacacaauaagaacuaaaaagagagcacggccuuccaaaucaccagaaggaaaagaaaccacacacaccagaccaaauaaaagguaagaaagcccauauccaagaagucaaauaggaaacaaaacaagaagcauucacaacagaaaacagggucgggcacaacagcucacgccuguaaucacggugcuuugggaggcuaaggcgggagggggaucguuugaggccagaaguuugagaccaaccuggccaacaucauaagaccccaucuuuccaaaaaauuaaaaagucagccagcaguggugacacgugccugugguuccagcuacucggaaggcugaggcaggagcacugcuugagccugggagguagaggcugcagugagccaugaucaugccacuguacuccagccugggcgacagagugaggccccagcucaaaaaacaaaaacagauaaacagaauauaaaauuggaugaaaauuuuaggagaaauauguccauuuuaucaacauucauaaauaacacagagucacaugaaaauuaccagauuggauaaaaaacaggacugaacaaucauuauauuaaaaacaaauccauacugguaccaaaacagagauauagaucaauggaacagaacagagcccucagaaauaacaccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaucuuauauaaaaauuaauucaagauggauuaaagacuuaaacauuagaccuaaaaccauaaaaacccuagaagaaaaccuaggcaauaccauucaggacauaggcaugggcaaggacuucaugucuaaaacaccaaaagcaauggcaacaaaagccaaaauugacauaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaccaucaccggccaucagagaaaugcaaaucaaaaccacaaugagauaccaucucaccccaguuagaauggcaaucauuaaaaagucaggaaacaacaggugcuggagaggauguggagaaauaggaacacuuuuacacuguugcugggacuguaaacuaguucaaccauuguggaaaucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaaaguccaacaaugauagacuggauuaagaaaauguggcacauauacaccauggaauacuaugcagccauaaaaaaugaugacuucauguccuuuguagggacauggaugaaauuggaaaucaucauucucaguaaacuaucacaaggacaaaaaaccaaacacagcauguucucacucauagguaggaauugaacauugagaacacguggacacaggaaggggaacaucacacaccggggacuguugugggguggggggaggagggagggauagcauuaagagauauaccuaauguaaaugacgaguuaaugggugcagcacaccagcauggcacauguauacauauguaacuaaccugcacauugugcacauguacccuaaaacuuaaaguauaauaauaauaaaauaaaauaaaauaaaauaaauaaaauaaaaacaaauccaguguaaggcucagauuagacggguaaaaagccccaaaaggcaaauagaaacaaauugaaaugugcaaucgagauaucgguaucacaaagauugaauccaacacuaaauaucaaacauauuugaccauuuccuaaguauaaagcaugcaaucuacaaagaugacggaacugucugaggcacacacuguggguaccuucgaguaaaaacacagaacacacagaaugaagacacacauggucagcacuagauaugaacuugcucuuguacacucacggcagagcaaacacacaggaggugugcauacagaggaugggaauaguacaauucuuacuucagccaacagauaggccucgaaccucuuaucauuaagccauguaugccuuuugcugcaagccuccaugaaacauuuacaaaaaccaaugccacauaaagaacacaguuuccaaauacacacaguguagacuaaacacuggaacacacugcaacagaaccagaaauaaaaccaggagaaacaaaaauccaaccaugggaaaaaugagucucuuucucuuaaacgcuucaaauucuagugaaagugguaaaaauuuauaaaguaaugaacacaucacauaucgaaaauuguaggaauugccuaaaauugagcucagagaacaaugaauagcugccuacauguaaguaacuacaaaaggaacccaaacaaauaaaaacauuagacucaaaaaguuagaaaaauaacuagaaaauuaaagcauacacugugcacugaaaaagaggaagaagauaauaaagaugaaagaaaucugacagauugcggaucuaggcagaagcgauaaagccuaugguggggacaguuugugcuugguaggggaagacagugaccucggagaagauggugccagaagacucuuaggaacuggucagcggccuuucaucaugaaaaucuucaacgacacacagaguuagcgagaggaauauaauaaacacccacguauccggcuaccacaaugaucaaccuuagucauucagcuucaucuacgaacauccaucuuuuuuucuuuauuucuaaucccauggaaugacacaucucaacuuuaaauggauaacagaugggaaacgagccauauauuuuauuaaagguuucucacacuaauauugugaauuuaaaagauaauuauagauucacaggaaguugccaagaaaguccagagagguugcagguacccuuccgccagguuucccccacugguuccaccuucuguagccaaaaaaagccagggaccgaccuugguaccguguugucaucaugaccaaggcgagguacucccucaccacgaagaccucccucccaccagcccuuggacucagcucauucugcgggcgguggcgugugacccgcugagugaggcacagaggccucaccgcccugucucucuuuaccuuccccguuuacaggcgccuuaaaugauuccucuacaugaaggagaacccugucagaugguauuaguguucuugcgaauaccauuuagaagaauaaaagagaagcgaaggggauggagcggacaucggcccguucucugacauaaaccgcugaggaaagccaaggucugugcacaggagcgggggacaccauggugccaccugacaccacaucaggggaggagaugggagcauucugggaaacccucuggaaaaaaaaaucacagcuccaaccaacaaagcuaagagcaucugguuaccccacagggacuacugaauugcaaagcaaaacaaaaaagacaggaguguggcaggagcuucggagacccugugccccuccccagggguuaagaguggccagcugggaaggacggcccaugcccaucucuguguccucagcacucaccgcaaggccuggacucaacugugucaccucgaguugcgccucaaagugcgcugagagugggacacacacacacacacacacacacacacacacacacacacacagccuucaacugaagaacagcuacuuccacaucuguccacauucuuaaggguccccuaaauguaugacaaacucaaaaaucucauuuuucagccagucaucguggacgagagccauuuuuauaaugcacacacaacuugaagugauucuuuucuggugaauauuucuuucaaaagguccuauuaaaugacaagccgaaacuauugaagcuaucacgaacuuugaggaaauaaaacuuuccuuaacaggucacuuaaaaggcuuuuuuucuucugaguaauaagcuguaucaacaacgcagcaagcuuuacucaaaaacguauuccaaauuugauucgaacagaaaauaaaguccuuccuugccagcauuaaauccaaaugcggcuguaaacuugcugccauaaggggcuccaaagacccuucccacccaagggaugacacccugugccagcgcaaggccagaaacagaucagaaacgccucccuucgcuucccuggcuuuuacggcagcccgugauguuauucucguggaauuccgugugcagagucccugggugcuggccguaccagccagggcuguaucuggagggagcaagaccaucugugugcuucuguuccacaauuuaaugaaaacgcaaguguuagauuuuuucccugcucccuauuucagaacuauccuuaaagcucuuuagaaaauccuuuuaauguuucuaauuuguucuauauccccaggaagaaaaaaacaucuuuuggaaauauuugcaagcucaaauugagcaagagcugaaaauaaaaaccuggcaugcaguugguaaguuggcuuucaagaagugcacaaauguacuuccuggaaacuauaaauagaaccaggccuuaccccauaccaaaaaaaaaaaaaaaaaaaauggugaaaugugcuuuaaguucucauacagaagcgcagccaugaaagacaagcaugacccccagaaauaacagacagaaccauccgucugagaugcugcuacaaucacguuauggacaaagcauuccuggaaaaucuuucuaagacucuacaauuccaaugcaaaagcaauugaauagaaacaauaacaaaaaacuaauguuucaggacugagcacgaauuuaaaguauuuuugcuuugugaucuccuuucguccucacagcccccugaagcaggucccagcggggaccuggguaucacagacgggagaugcagccaguaagcauugucaccuggauucaaaacuggccacaccuccuggaacaccaccaccucccugaaaccacugcagcccaucucuccagccugcucacaccagcacaaguuacacguuacuccugaaagcuauccaaauacccuaaacccaauggauaaaaauauauugucugaaaauuaaaaauaguuucaguggucuaggaagccuacaaaucccacugcaguugcucuugccuucucaguuacguaagaucaaguuuacauaagaacgcauuucagaauuuccuucuuagcaaccuccaaacguuugguuauguguuucaccuaacagcugggccgaaguaggaaccacuauuacuuaacaguaacaguugaaauauuuaaaaauagaaaccauuggagaagaagagagggcaccaaggacgaggccugaaggagguagccccucucucuggggcgagccggccucuuccaggcagcaacguacauuccgccggggcuuucuggagaccggcgugggcugcagcaucuuucaagggcgcugcgggucacuggggguggaauaauccagcaggcagguggaaaugcagaaggcagggggcugguucagacuucuguccagaaaaaucaccugggcagcuugauaaaaagugacuuacgccucccagccucaguuccugaaccaguaacuacugugugauguccccaggggcauuaaaugccaaugaacacacgguacguagcugagugacagauggguggccuugguaaggggaccuguggccaucaguguccucaucauugcuguaauuaggagcaaccacgagucccacuuugagcaggaccuugcugcuggcuguggaggcugugcgcucacacucucugcccagcaaagaucccggagccaguaacucucuugccagcaggaacacuuuacaaaguaggauuugguagaagaugcaugccagcacuaagcaaacauuguuuaaaaaaaaaaaaaagggaaaagaaacaaagucuacuuuguggaccuugcacggaggagauccacugcccgggagaguucauguccauguaucuuucugcuaugaaugcccagcgcaggccccucccacguucagcgcaggcucgccaacgccuaccacucaguguuccaaacugggugccuuugaaagcacugcacagauccauacuaauccucaucccagcgcagggucugcuccacccacauuccccaugaauucaugcaacuccaucagcagugcuuaaagccaaaaauccugaggucacccucgacucuucuguuuccugcacagcccaucugcaggcuaaggaaaucccaucuacgucagauaucucuagaauuuguaccauuuucuacauucccacuccaccuacccggacugagccccauccacugccuggguugcucccagacccuggugggucucccugcuccuccgaugccugucccacguggccacugcauucucuguggcauacgucacguggugucgcuucucugcucagaaccuccaggagccuccaugucacucaaagccaugccuaauugauuaacccggccuuuuaugucucccgcaccgcccacucccucuucuccugaccaggucuucggccugcaaaugucugcucaccuucuaaggaggccugcccucaccagcggguguaaaaucgcagccccuccacucccgagcccugcucugccuucccugcucuacuguuuacucauugccuuuacuaguuuccucucuuccucccaggguaacaugaguaccaugaaauaggggucucugugucaaucauaaauacauguauuccauaugccaagggcaggggauggcauuagaaggcccaaucaauaugaaugagugaaugaaugaaugaguugaacgcagaaauccacccuccugaauccccaguccuugacugcucacucuccuccacagcgauucucgccucucacauguucuaauauuguagguaauuuacaaucaauaagcuggaauuaaugagcauauuuagaauccagcacccaauuacuagagaauucaaaaucuucucacacauauauuaaagauucauaaaaauugaccacaaagcaagucucaguaaaauucaacagcuggguaauuucuaaccauaauggaguaaauuagaaaugaauaacaaaaaagaugacuuggaaaauucagacuuucgggaaacaaaaaacacuucuaaauauuucauuuuuucaaauaaaaaaggaaccaaaaagcaaauuucaaaauaacucucuugagaaacaccaagacuuuaugaaguguuaauguaauaugcuuuacaaauuaaauaauacaaauuagaacuuauccaaagcagccccauuugaaccccaagggaagcacagcacagaacccugaaugccuccauccgaaaggaagaagggcuaaaaauuaacaagugaaauguucaaccuaaaagaacaagcauauccgaauaaaugcagagaaaggagaacagcuauuaaaacaggaauuaauaaaacagagaacacacccacaagagcagauccacgaaggcagaagucggucugcgggagaguaaagcauagcuggacucccaccaccugcagggugcccccaccccagggggggaugagaaacaccuggauggagggguggagccuggcugggcucaagagcaggagagggaagccaggaaggcggggaaggcaggucggcaggggagggcaggcccgcccaggaaggcccacgcagggcugggugcuguagaacugaaagaagugccagccccuuccucaggcgccugacuaaaccgccuucaauuucuuccccucgcccguggccacguacugcuacccaagggacaccuccaguccucccucaccuggucagacaccuggcucugauggccccucggagccccucauuggaaacacagagggccugaguuugguucugcaucacgugugacagugugugcaucuugcugugagguccagaaauggaaaccuuccuuaaaagaugggcagguuccucugguaggggacaugguguugguacggcgaaaacaugacauuagggucaaauguggcugcugagaaggaacucccuuucagcugcaccgcgacacccuaacacagacaagggucggcaaagagccaucucccucguccuggcggcacaggcuuccagaugccacugaggggcuccgcaggcccucuggauacauuuuacaguccacagccuuaaagcacacaaagcugguaauaaaagaaaaaagauaaaaagcccuuuaaccagaaaugaugucaugaugcaaaaauucauuccuggauaauacuuuuggccaccagugacacuccgaauacacaaaccaaaccaaauucucaguggaaaaaaaaaauccuuucuuccaaccaaucaucacuuagaacuguggaauccucccugagagauacucagugagauuucucuguauucuguaucaacacgguugaggggcacugcugggacugccacauagcuuucucucucccucuaaaguagagaaacaaccagucaccagcuccaccccauccagauuugcuguggauguguggacgguuuuagaagcacccagaggauauuucucagacagcacccccaauucuccacgacgccccaaccaauaaccgucugcuuucuuaccacccauguuccuugcuaagggcagacaguaagcucuucagaaaucuuugggucgacagcaacaacaacaauguaacauguaauggggggggugauaaauguagauaacccaaacaaucuaauguccacccaggauggagaaacuuucuaucuuucugccucaggcacugcggacagggaaagaaccaguuggaaagugaggccggcaggcucacggguggggcuggcaggcagcaguguccugggccgcguggggaggcacggucccaccugccagccacaggguggcauuucagagccacagggcauuucuggucaaaaauaacagagugaacacaaucacguugucaggaucccuccaagauucugcugaaacaguguguggauuguuuagaaagacacaccaacacaacacacacacaggagaugagagagcagccacaaaaugcuggaagucagaaaggaucugggugaauaagguaucagagacagcaaagcugacccaucagccagggugggccaagggaggggcagaccagucucggucacacagcccuccggggcacaggggcuggugggaccaggacuggaggugaaggagaaugaaauaucugcucagggaaugcagggccccaaccaccgcuuaccccacguggcuggcagagcccagggacuacuacccucuggagagggagauggaacagcacugaaaacugcggaccaguggaagcuggccagcuacacgugagguguccuggucuuccugccccagcaugggggcagggcaggcagcauugggcccucccagugaggucacaggggcuaagcagccugcuggacaccaugccaagugggaccgggcagcccccagcggccagcacccugcaugccccugcaggucccgccagccucagugcccucugcuacagauggcagauaccgugcucaccagaaaggccaggaagacugucaucacagaaggcagagccuggacagacagacaagcaccuuggggaaaugcagacagagagaagggaagacaggcccuccaaagacaagcggaaggagcgggaggcagcccuggaguuccaggacaggagggcaugccucgggugcggaggaacauagucucugcccggugaaaugagcaagcaagccucagagggcuaacaccauuaaaagccagaagggcccucugaaggcaaaugugacugacucagcagcuucacgagagucaucgcccugcagaucagguccagcggacugcagguccagcagcugccacugcaggguggcccgggcccucugcuaggucucccagcugcuuccauccaccaggcaucuucucaagacacauuuucaacgcaauucaagcccuccuguuguuaugcuucccagcaucagcugggcuggguuucacuugagacaguugcuccuagggacauugccacaaagggaugggaagguggaagggacggugguugagcugcaggaagggcagagccacgaaccuggggccaggcacaccagagggcaccaggaagcaagagugcaagagaacacagaccccuccugugugccagacgcuacgccagacacuugcccuugcugccugcgcccuggcccaggaccaagcagccccgggacaccaggugaggagcagccugcuggaggccauguggccaaagggagacaggaagacugugcugcccccaugucugccaggcucccaggccuuggagcaacucagcugagcccaggaccugauccuucacuggccucugucaauacugagccggaacgggauggcaggagggagcugucacugugagaguuaggaggaaagugaauggggugcaaauacaggcuguguacgccacgugaaaggugguguucuuggccccgcaguguuuccagagaaaccugauguuacugcucaugggaguucacagaucugaggggaaggagagcagaaaucagaagugacuugucuccagguggcaaaaagcaaacagcaucagagaaaaacagaacgaucugaagguuuaggggcggauagggaugagauauugggaaggacuggagaagggggcauggguaugaacagaccuugaaaaauaacaccuuuugaaauucuuaagagguaauaugccuucagccaucgaaggggaauuggaacuugaggauuacucgacaccacaucuagugaacaagguagugaccaagcaggagggcgcagcuucugguccaaaacuauucucuacuauaaaguaacaagggcugggcacagucguucacaccuguaaucccagcacuuugggaggcugagguaggcagaucacuugaggucaggaguucgagaccagccuggccaauguggugaaaccucgucucuacuaaaaauacaaaaacuagccgggcgugguggcgggcgccuguaaucccagcuauucaggaggcugaggcaggagaaucgcuugaaccugggaggcagagguggcagugagccgagauccugccacugcacuccagcccugcacuccagucaacacagugagacucuaugucucaaaaaauaaauaaaaauaaaaauaaaaugaauaaaguaauggggccaauucgccuaauugccaaaagugacucuuaaagcauuucuaaauugcucauaauuguacacgacacacacauggccuccaggaguaacgcuauauugcagucagcuucuaaagccauguggggggcagacuccugcgucuggccuuugagucauggcuauucauaccggcccucagguuaacuugauggagggcagucaacaaacucucaacauuaguuugaacuaagagaaucaaaccaugggaauucuuuucagauuuuucaaauguugacgaaaaaggccaaacucuguaaaauaguugaagagguuuauuuuaagccaaauacgagugaccauggcccaggacacagccucaggaagucugugccugagguugucacguuacagguuggcuuuaugcguuuuagggagacagaaauuacaggcaacacauguaagguauauauugguuuggcccagaacaucuugaagaaguagggugaggaccucacagauccuaggcagacugaaagguuuucugacugaagaguugaugucagcauaaaaaaauguuugaguuaagauaagcggagauucucguuauguggaugaggccuccaggaagcaggcuucagagagaauagaugguaaaugucuccuaugggacuuuaaaaggugacuuguaguuaaaucucuccuggaucaggaaaaagagaccuggaaagggcaugggauucucuccagaaugcaaauuucccccccaagaggcaguuuucuauagccacucaaaauagguggaaggaauauauucugggguaaaauacuuuuauuuccugcagggccugcucucugucgccugcugcuaucccagagucaggguggaaccgggaaucuuacugcugugucuguuuuaucagucgugagaucgcuguuuugauguuaacgcuggucagcugggccugaacgccaaaaggagggggcgucuaaggaggccuguccaaccccccauucccaucagggccugaacucauuuuucaaguuucuuugggaccccuuggucaagaaggggguccauucauuggguugggggacuuagaauuuuauuuuugguuuacacaaacaguuuuacuuugaugucuuuacauucuacacuucauuuuaccucuaaaaauuaaaacaaagcaagcaagcaaaaaaaaaaaaaaaaaaaaaagcaaagcaggugacauguuccguggcggacaugaccguccuggccaauccuugcccguggcuggcaagcugccgaguccgugggccggagggcauugauuccucaaagacacuucccugaucggaggaaaauaacccaagcagucacggcaggcgccgccaggacgaggccgccacggccucucuucuuccugccacuccugcccaguccuuccgugggggccacucgaggaaccaccagagauggccguggguccuucacuggacccuauccaaaccccagaaaugccagcuuuaugaugaaaacucacaaaggggcaccacgcaggaauauuacaaccaaggacuuuguuaccacgggcucuguguaugaagguaauuaacagcuuccggugccaauaaagggagacuuucgaagcuuccccugaggucacacguccuugcagauuuguaccagauuccacuuucuucucaccaaacgaaacaaugcaacaaccgccacaaaacacaucuaggaggcagcaugagcuccaggcaccagccaaccucaaauacuuccuguuccaaaauguaagagcagugucuggaaauacagcuccuuugacagugugcuggucaaacaccccuuagaugugggaauccaacgcugaagccaaacgugaauuuugcguuauuuuggagaguuucucuacaguuucuaguuaauccccuuuaagguuccagaguuuucuuuuaaaaauggugcuuuugaaacauaaccuuaaaaagagccucccuaacucugacagauacacguuucccaggacacagguacagagggugaugaaaccgccaccccuaugccucaggaaaccguggaacgugcuucucuuuaguccagcaucccggucuuaacaucggccucuacuuccccuuuuggccgauggaagggcaucgcauuuucugaggaugucuuucuccccaguagcacagcccucagggcagucauguguccugcccuguaauguauaugcugagcgacccugggacagcggccacgggaucugaggcucuggcuuuccuucuguaggagcaguggggggcacaggagccagggcacucggucacgguggagagcagcgccaugagggccguaagcccucagcaugccgucuguuuaacaguaaguccuucauccacacuuccuguugcuacugacuuuuuuuguuugccuccgguuugcucccggaugccugagguagguguccuccccgaagcaccccucuccucaaccgaggcugcugagcaccugcucccggaugccugagguaggcguccuccccaaagcgccccuguccucaaccgagguugcugagcaccugcucccggaugccugagguagguguccuccccgaagcgccccuguccucaaccgaggcugcugagcaccugcucccggaugccugagguaggcguccuccccgaagcgccccuguccucaaccgagguugcugagcaccugcucccggaugccugagguagguguccuccccgaagcgccccucuccucaaucgaggcugcugagcaccugcucccggaugccugagguaggcguccuccccgaagcgccccuguccucaaucgaggcugcugagcaccugcucccggaugccugagguaggcguccuccccgaagcaccccucuccucaaucgaggcugcugagcgccugcaaggccuggcuggaagccagcucgaccuccagccuuggaacccaacacccaccacuuuagugauuuuuuucuacaauaaacauacauugcuuuuauaaucaggaaggggaggaguuuuagcuacaaugaaucugaaacaaaugacugaguaguaauaguuuuuaaguuccccguaauucagcccuugggcauaguuggguuuauaauccuguaugacauuuugcuggucucuccuggcugacuaauuccauaccuucuccucuguccucaaacugcaacaucuccccagccuaacucagucaauggcucuguuugcucacuccaugggaaaacacaaggcucuggcagagaaccgggggucacgagcucccgcccccaccccacccugccaccaugucuccgccugggaucugccucggugucaagucuccuccaaggguggcccuuccccucaccaagccaaggguggcccuucccucaccaagccaaggguggcccuuccccucaccaagccaaggguggcccuuccccucaccaagccaaggguggcccuuccccucaccaagccaaggguggcccuuccccucaccaagccaaggguggcccuucccucaccaagccaaggguggcccuuccccucaccaagccaagguggcccuucccucuccaagccaagggcggcccuuccccucaccaagccaaggguggcccuucccucaccaagccaaggguggcccuucccucaccaagccaaggguggcccuuccccucaccaagccaaggguggcccuucccucaccaagccaaggguggcccuuccccucagcaagccaaggguggcccuucccucaccaagccaaggguggcccuuccccucagcaagcagacaacaacucccaggaagggggaagagcaaagccacguccacaacugugacauuccacuuauucaaaacgcaaagaaauaggaggcaaagauggaauaauacuaacaacaugucuguuauaucuuagugguaggcaaaugguuauguguuuucuuuuaugauagagcuacuuuacaauuaaaauuuuuaaaacauuuuaaaaaagaaagagaacaaagucuacagauaaaaaguuaugagggaaguugaagaaaucaaaguugaucuaagacaaauggcauuuuggcuuuuuccuccuccaguacagcugacaauaucccaaacccaaaaaccaaaauccaaaaugccuccaaauccaaaacuuuuucacggugacacucaaaggcaaugcucauuggggcauuucugauuuugaauuuuuacacuuaggaugcucaaccaguaagaauaaugcaaauauuccaaaauccgaaaaaaaaaaaaacaaacccaaaauccaaaacacuucugcuuccaagcauuacagauaagagauacucaaccuguauagacuuucccaaagcacaugauaugcucaccugacguuucuaaaaucucaagauggcacacgaauacaugguaugaauaaugcuuuucuguuggaagugggaauuuauuaggacuaaguguauugaaaaagaaccauaaucagaaaaagaccuguguugaacauaacggcauucacacgagggaauggucaggaaacaggacagaucaacaguggggagggcugcccgggcgcccuuccugcuccaaguacacacucaucuguucaaagggagcgagcucucacagugacugcuggagucauuccugacaauugaguguguguguguaucagucuguuuccacaccuucaaacaucaaaaugucuaaagaauaguuaagauuaaauucaaucauuaggaaauguauaacagcaauugaggacugacauaacauauaccuaaaaauguuuauacucccauaccauaaaaauguggcuuuaaagacauuuuccuaucaauuuuccaguuaucaccuaaccugagauuaauauuucuuugcaguauuuuucaguggguugaaaugaccaaaaugcaguuugaaagaacacgcuucacauuagaggcuucuaaggcacaggccacugugcaggcucaaugauggaugucauacaggacugcugcacaugcaugcaugcuuucucugcccacuguuccugggcaucgcugcuacguuauuuaaaauuacccugcaaacacucccaccacgcccaccaacccaugccugaauaugcaauaaaugccaggagacacggcacucucucugacucagaccaaugggaaccugaugacaagggagguaaauggccagcgucauggggcagccuucccaacaugccacuucucaaguccggcggcucaccccaaaggaagagaaugagggugacaggcugcaggagagguccaggccuugaacggggauauaaaggcuacaucacacacauuccucaguacuagucaacgggacacugagaugacauuuauugaggaacuacuaaaaagcugacacauaucuuucaucuuuaugagaacucuguagagaggcauuaucauccccggcuaagaaaugagaaaacaaaacugagcuauucagcaacucgccuaagcucccacgcaaacaggcagcagaggcgggccccaggugcccucugugggaggcugaagccccggccuguccucacaccaggcagggaucccauggcaggucucgacaggcagggugcgcuucccaagccagaauauuaauuugaagcccaccuuuuuugguucacuuggaaacuaugcauauuuaccaucuuuucccagcccaucaagcuaucagaaaauccucuuacccucgugccacgccugguuaagcacaagcaaguugucucaaaaaugccccagccacagaauucaguguuuacacgaaaacaacaccggcaaagugaacuugagagaaagugaaaaccaaaacugucgacauaagccaaaauuuuaaaauugugcaucuucaucugguacuuaaagcuccccaccgcucccccaggcuccagugugcugggguaaaaaauaaacugcuugaucaguaauaaugcagaguaaaaucaagguguaaaaaacagacagaaaggagccccccgaacaccccccaagaggccaggggaccguaccccacagacacagagagccuucccggagcagggcaaagacaccuccagaacuccggguuuggaaaaugacagaaaaccuggccgacuuggaagaaucacaaggcaaagaaggaaaucucuucuuggaaacguucagccuggcuucaagcuggcuucaacuuccuuucggggugaugagugggucuaacuggggcaccggagggcacaggcggcagcaaaggcugacugucaaggaaggugcagcagagccaaaaccagagacccaggccucgggacgcagucccugcaaggcccagccacacugcccugcaggacgcauguggaacggaacacugguucccucagccccacgccaucaggagguucagguuuuauucucggagaggcugcauggcugggaagaaugguacccucacaaggaguuuaaacccuggaggauucuauguggaaacggguuuuacagacaaagaaaagggggaaaaagucuguuuccauggccuauagacuuggaguaccuuaaaauguuaccuauggggcugggcgcgguggcucacgccuguaauuccagcacuuugggaggccgaggcaggcagauuacuugagcucaggaguucaagaccagccuggccaacaugguaaaaccccgucucuacuaaaaaugcaaaauuagccaggugugguggcacacaccuguaaucccagcuacuuggggagacugaggcaggagaaucgcuugaacccgggagguggagguugcagugagccaagauuacgccacuccacuccagccugggcgacagagugagauuccgucuccaaauagacaaaugcauaaauaacuaaaaauuaccuauggaaugaaauauuucugaucaccaccgauacuuuuuuuuguuaaagagcugaaagguacuuggaagacagaugaugccacugacucauuuaaccaacaaaagcugguggcaauggaaaaggcgcggucuguccacggucacguggccagugggacccagccccgcccacugcaagcucagaggucuuuccuacaggcccucacggggaucagggccagggguuacaccuaagccaggcaguuggugccuuugggaagaacacauccuuuagcaccagagagaaaaaaaacaacaaaaaaucagcauuucucuaccauuuacauggcacggagccauuucauuuccaaaaaggauggccucuuuuaccaccaggaagagcacccaaauucagugaaccugauaccccacaccuccccccucgcccucucugcacuccuccaauaaggcagagcgucugaacaccucuuuggcucagcgcagggccggccggacagggcaggggugggcggacuuacccgugcugggcaugugguucacgcgggcaggauucagcagcuccacuggcuggucucggccagaaaguccaucuggagaacagagaaggcacuggcuucagaaacugcgcgcauuucagccaacauacuuuaugcugggagucugcagggaguaacuccccaaacaaugaaaugcauguguccuuccuacuuuuacagggggacacuuucagcuucaucauagauuauuuguauuugccaauguagaauaaucaaaauagccuccuacugagauauggcaaacgcccguuucuggccuaagagccacuggcuuagcaauuuggguuuacuucuguucagcaaccacauuauacccacucgugcugaucagaagucggcucuucugcagaccacaagcauuaagauaacaaaaagagaagagcagcucuuccucuucucagauagugacaaacggucuggacgcucacagaaacacagcacagggagcccucggaacccgccaggugugcagacagggaaggaggcaagcugaggccacucuagcugcaaauaggcauggaggagaacgcuucaccagguguucucaagguauagaguccuuucuuuuaaauccauuuuuagacuguauuauggagcgguuuccaucuauucagacucacugcaaagaugagacuggaacccacccaccaccuaaaccuggcacaggcuggauuuagaccgccugggauuuuucuauauucucccaagcagaaaggaaagaaaacucuggcaagauuuccaggaaucacacuuuucuuuuaaaauuagcuucugacaagugguguaaaaugcccugcaauaauaugcauaucauuacagacuugcacgcggaggucauuuuccuuacuaagcgaaggagagcaccaguuucgcagggcagccauggaacucuguagauacaaguuuuaaaacaggacaaaaacgacuaacaucaggucaaaugacugcaaaaaaaaaaaaacccauuuuuuuauccaaaauagauaauuccuagcauugccaacccgugcauguccuuggagauguucaauauucaagaacggaaacaagggucccaggagauuggagggcaugcucuugaaguuagaacugggaaagugugaggccaacauggaccugcaggagcucagcaggugaggcugcucuugggcaaugcagagaucaaacgugggugccagaaauaaaaaucaaaaugaagacaacaacaaaaaaccacggggaccucuccaaccaaccagcagcuccucccaagucucggcaacucuuaagguuugaaaacagaaguaaagacaguaagacacugggcauauucggaggcaaaacaguucugcuucccugggucaggagaaagaccggcaggucauaguuacaccuuagaagcaaccaccagaccugagcaaucgccccaagucuucacacauuccagggcuuucucaaagaacauggccaccuuaggagauggccuggaugcugaauuguaaacaugaugccaugucucaagagaaccuucacugcaacucagaaagagaccccagauagugguggaaaguacuuuucaagccuuuuuuuccccuaaaaauaaauauauuuguauucauuuuuauaauaaauaaaaauaaauaaaugcucauuguagacaaaaaauaaaaaauucgaaaaggugccuguauguauguauguuuauauguguguguguauuuaacccaaaucccacuauaaauacuuucagaaacagcagaaggcccuuuugaagaucucaauguagcugcaguuuuccaaugggaaggggucaagaggagggggcuuggggggaccacccuggucaggguucugcaacaguuccuacgagccaaugccugucccccagaacugccuccccuguagucagcucaacgcccaaccuuagcuuccaccucagcaaaagcccuagaaccagaaaguuuggaaaccaagaagcccccaguggugagcagcagcgguggggccagagucccagcucacaugaagcccuuucuugaguuuggaagugaacugcuuaugccugagcccaaaaggcggaucccuccagcaccgaguucauacaugaggccuaauuacaaguuacuuuuacuacacugaagcaggaagacacaucagaucucagugcaaccgauuugacuuguaagucacgauacgugguguuccuguauccacaagcaucacucguguguuucagaucaaggugcagcuuagugggucuuggcucaccuacauuucugggcacugggcugguccgcgucccaccuacccuucaagaagacauuuauugcaugcuugcacuagcuggcacaccaaggagaaugccguucgauaacagcauguggauucccugcguaaaccagaccuugaccuuaacauguccaauccuguauacuggcggguggggugguuucugacaccagccaacuggcaccaacugggcguccaaugauccaguuccacucugacaauaacugcccagagcuagcacacacgccacaggggcucagguccacaaggcugcccccauuucagacacaaguccugggccuccuggacuucuaaagaucggcuauaaaucaggaguucccacaagccccucucagguucuguaauuugcuagaagggcucacaaaacucagaaaaacacuuuaccauguugauggguuuauuguaaaagaugcaaauaaacaguaacaugaaggcagggucuggagggguccugagugcaggagccucugugucaguaccacuggggucagcaggugcggcugaacaugcugcuccucucgucucugcguccuggugacuggccccaucccgaggcuauccagggguccugcccuaagucacuucauuagcauaaacucagaagcacauaagaagcuccuccuuaggaauaacgaaaggcucgcuggacacucaggaagcuccugggauccuaagagcucccugccaggaacgaggacaaagaccagauaaggcuuauucuuccaccacacagagaugcugcuuguucucguugugugccacugggccuggcuagucucauaacaaccuguacauucaaacccccaacacugccauguucacaucuuuguagaaugacauggaaaugcucgaagggaaagcuguucugaggcggcacuggguuaauaggaagugccugccucucgcggaacagggcagccauguggaacuaucagaaaacagcaggagugucucaagcacaggcggccuuggaggcggcggcacagacaugggucucagugccggacgcuaaccccacauguggaggccccgugagccccagccagcuggaagcacggccacagucucuuuaagacaagaucccggccugagccguccuuggucguccaccuggacagcaugacagaugccgcaucccucauuaugaaaggcuggggcucagggcagcagccaugaucgagaagccaaacacuaaaggcguuuugccagagguggcugguggaacacaauccuggggguaaagcaguggcggugagugcacuuugcaggcgcaggggccaccaggccugggaaagacagcuuuggaacggaccuaaacaaagcguggccaguggggcaaagaacgucugucaccagggugaaauagacaagcugcgguacacagccagcuggaacgcaugacggcauccgugaaugugcacagaauagauucuuaacgcuguguuuuuucagauaucauauuccagagugaguuaaaaugaaauuagugaugagagguggaauuuccauauuuaucugccucugggcugaaauuucucaggcugaggagaaagcggugcuaagaacccagcguuuacaagcaggaaaauaaugaagaugggaagcaaaguaccacuuccucaucacacgccugcugcaagcagguucccccuuaucugucuccgcuugagaaucuauuuuuggaaacccugcuggacagggacgaucguacugaguguccucaaacagcauuuaaucagcgcuggggcugcagaccagaugcacacugagagggaggccgaggagcacggguaccucguguccucaccagcacaugaugugccccagugugcucaaugcacccacagucaacugcagugaccacaucacucuugccaggagucccuuucgcgccgacaggacccagccugaacugagcauuguuugagacucggaguccgcccaugggaggaacaggacuaagacagacagugcuuuugcuuuucagaauccaccuugcaucagacggguagguaugucuaaccagaaacccggccuucuggagccaaaggaaccucacuuucacccggagggcccaggccccccacuucacacuuggggaaauggccucaagggcugugcaguuuccuaggaucacggagugagcaccagccggaauccaguucugucucaauuaaaccagcggcuugucugaagcuggaccuugagcaaacagguacccaccaagaccagugcccuccaccaaggguuucacaucacaauaccgacacacaagaaaggagguuucuugagccaauaaagaaaguacaugaaagccccacgcacaggcuccugaacugggaggggaagggaguggggagaaagugugguuuccacccuugggaccugccugggaacaccuaguccugcccagguuggggugaaagggugucucuugaagguuucauuugucuuucccagaugaccaaugacacugaccaucuucuuacauguuuauuggcuuuuucacuggcuguuuuggauucaugucuuuuugaccuguuuuuugcccccaguuggguugucuuuuucuuauugauucagaggaauucuuuacaaauucugaacauuaauccucugucaauuaaaugcugcagauauccucucaaagguccuauuucucaaucuuucaaagcuucugcuuuuaugucagguucaagaaacucuucucuuccuggaggcugcagagauauuuuaacauauuuuuacccugaaacuuugcaguguucccuuuuauauguaagucucucaucuacuggcacugauguuuguauacgcuaugagacagggguuugggguauguuuuccuaugauaacagccaaauguccccucaguguuauuaagaggucuuaucuuucaccauggaugggcaacauuaguucccuuauaagccaaaucucaauccuguuggccaacuuguuuuugguuuugccaauaaucacacugucuuaaccaccauaacuguacaauaacucuuaauauuggcaaggcaaaaaacccuacuuuuuucuuccagaucaucuugggcaaaauuggccuuuuacuccgccacauaaauuuuaaaauuaacuugacaaguuccaccaaaagaaaagaaaagagaaaaagaaagaaagagaaggaaggaaggaaggaaggaaggagaaaaaaagaaagaaagaaagaaggagaaagagaaagaaagaaagaaagagaaagaaagaaaagagaaagaaagagagagagagaaagagggagagaaagagagaggacgagagaggaaggaggggaagggagggagggagggagggagggagggaaacgaacagugccugggauugcacugcaucugucauuuugagagaagauaaucuuuacaguacugcaucuuucaauccaugaacaugggcuauuaccuccuuucauuucucucagaaauguuucagaauuuucaguguugcggucuugaacaucuuuagauuuauuacuagguauuugauauuugauuuccauuaucaauuucuguuugcuugcauauggaaacacaauuaauuuuuacuuauugguucuguaucguagaauauuaauuucaaucauuuuucuguaguuaucguguauuuucuacauauagaaucaggucacguacaaauaaugacaguuguuuccaccuuccagaccucacaccuuuucuucuucuuuauucugcuggcucaguccuacaguacaguaacuaaagagaaauggugauaaaagacacuuuggucuuguuucugaucuuacgaaggauauuucaauguuuuacuggaaaguguauugcuugcugcagguguccaacagguaacuaucagauuaaggaaguucccaucuacuccuaguuugccaagacauauuuuuaaaucacauguuugcuuaacuguauuaaacuuuucugcaucaauucagcuuauuaaauaauuuccccuuccaucugauaacguaguaaacuuuuuuuucucaugucaaacuaacuuugcauuccugugacaaaccagcguggucaggcccaggggguuuuugggaacaggaaggcagcaagagcuccacacaagcuacaccuaaacucuuuuccacgcuugauucugaagacuuggagaccucagucccacauuucaccuuagcaccucacuucaauauuucguuaugagcauaaaaugagaauuggauaaauuaacauuccuuuuuuuuuuuuuuugagacauugucucgcucuguugcccaggcuggacugcaguggcuggaucucagcucacugcaagcuccgccucccagguucacgccauucuccugccucagccucccgaauaggugagacuacaggcacccgccaccaagcccagcuaguauuuuguauuuuuaguagagacgggguuucaccauguuagccaggauggucucgaucuccugaccuugugauccgccugccucggccucccaaagugcugggauuacaggcgugagccaccgcucccggcuggauaaauuaacauucuaaaguguguuuggugggggguugcugacauagacaaaaacaaugaaaccgcugugacucaagaguaguauaggucacaccucacugugcacaccccacugugcuaacagagcugcuuuucagacacgggaacggaagcuuagggcuacugggaaacaguaacgacacagucuucauugcagccaaucuccccauccuuucauauuuuucaaacaaagguguuguuuuagaacagcugugaguuuauagaaaaauuaaagcuaguagagacuuauccuauacucugcacccuccaugcccuacaacuaacaucuuccauuccuguacucugcacccuccaugcccuacaacuaacaccuuccaucaggaugcugugcuuaggugucaugacagaaaaagcccggacuugauucagauuuccuccguuuuucccuggugcccauuuucuguccuagcgcccauccaggguccugccucucuuggcugcaacaguaucucagaccuuccuuguuuuugaccaccuugacagcuuuaagcaauccugcuuggguauuuuauagaaugugcuucaacugggguuugucccagggccucacugggacuccagggacugagcugcgugaacaccuaagcaagggcugacgucagaccagagaagccccgauaccuucaaaccgaacuucaugggcaacggcagaguucccaugguuuaaagaaagagcuuagccuuaaagcaaagacaaaagaaaccacuugguucucgugucuggggcaaaaggacuugucuuuugccugaauaaggagggacggaaaacuccuucugcugggaggauuggccaugaggaaaacagccucuuggccugcaccaaacuggcaggugucugugagaaagcgcugcgcgagggcccauguggcccaccaagaccugcaccuccuggagggcguggugcggugcacacucacaugcaaaccuucccuccacacggcgugugagucaauguggaaugaaguggguaucuauuuggguuuggggccaucaugccauccccucaggccucuaaccugugugaccagagguaguagaauuuuacuggcacucugaugcccuuguucaauuaaauuauaaaaggaaguucagugggcugaaaugucauggcuuggaaacaaaaugaucuacaaggucagccaaauacucaaauucccccuagguccuuccccugaccugaacccccagaggggucuccaucugccaccucaagcaggaccugcaccugcgcuggccuccucccagcucagccuccugcuuugcugagugaccccagcagcccauccucccuccacugugcggcccacacccuggcacuaccccugggccuggcagauacuaggcauaggcuugaugcuccauaaacuugugcccacccaaccggcccucccugggagcucugcuuauagccucgagcaucccaggccacuagauucugcuuuuccccacugcgcagguuacugaaaauuaccaaaguuccauaacagugcuugcaucugcccauuaauagaaauuaaacuuuaaugaguaagugcugugaauuccucaggcauguccaacauaguuuaugugcauuuauuagagaaaaugaaaauggaaaaagauucuuucccuaagcaauauuuuuccuucaggguaaucaggcagucuuaaaaugucaaggauaaccuaagaaguauuccuguugucucuccacuaagaaucaaaacuagcuguagcugccggcuuacaggaaguacggguuuggcagaaccugcuaaaggacacuggauuggcuaugaucagucaagcccugaaacagaaaaucccaggacaaaggacucagugaggcggagagugggcaggggaaauuucagauaugcccaccagucccgauguuuuggucuggauuugaacaacuggcuguaaaaagacaguuuuuaagacaaccaguaaaaauuaaacaucguuuggguauaagaugauauguaggaaucaugauuccuucugcugagugugauaaugggguuggaucuguuagaaacacacauucaaguauuuaagggauggugcuguggccucugagaucgguuuuaaauucuccagaaaauaaagguguggagagaugaaguggucacgauggagagccucagggauuuccuggcgggagguggcugugggcacucgcucuaugcacuggucucuuuccuuucauauaucuuugaaacuuuucauaacaauuuuucaagagaugccaggaauaaagacgagccugcccccaccuucuauucaauaugucuuuccugagcaucugcugggugaucuaccuaacuuguuccuucacgaauaucccaacagucuucaguucauccccagccccuauguguucaagcagacacacacgucugguucacagcucagcgagcaggcccugagcgucugggaacgugagagugagcaacgcagaggccuggccccggcccagcagaaccggcaacccacacuggcugccugcguccagucccgccauggggucugccuggugccagcaccugcccagacacagggcagaggagacugcagggggguguccagcugcucucacgugccaggccaggcuugcuaacaccuguggcuuagucgggugauagggacaaaacgugcaaacugagcccgcuggacacgcagacucagcaggcaggcagagcccgguggggaggcaaacgcgggcaggagugagccacgggggaaagggaacagcagguuacucggggauuuucccagggaaaauguggcaguggaaacacagcaccucgccccuuccccucccccgucggagaaaccauccaugcacccaggaggcguggcagccggagaagcaccgggguugcugcaggccacaggacgcgaggagcagugucaggaaucaguguggaaaaggggcugcccgggggcugaauggggcuguccuguugccacagguccuggcaccgagcauagagccaggugugugggcgggggccggccaggcgcuggcugagcaggugauggccacggcgccggcaggagugaaagcaagccgcucuuccugcuccgcagggcccugcucugugcucuaagggccggagaacagcguuuccuggagggagugucucagggccucuccuagacgguucugcagggccuggcauggccaggcugcuuccucccuaaguaagacaacacggagagacagcucucagcuaccccuaccuaccaaguggcacaggccagcugaagcguucauaagugauuuagcaaaucaggagaaaauguccucgccugccuuugaaaacagcaccaucucugcuccugagaggauguccacugcccaguggcgagggcacaugugggugcgucacugcacagcugugcuguacagcgcugggagcgugcgaggaggaucaccuggcaugcaccgugugcaguuucaccagagccagugggaggagucacacacaacagacgucaaauaggaacgcugcaaaacacacaaauagcaucuccacagcuaauguaaaauaguuuucuggauagguucccuucaguuaaugaugaaaggugaugcagcuaucggcaauggcuggagacuagcucugcggucugcucguggauaaccgcgcucccucgcugccgggccacccgcacagccgggcaaaccaaaaggcccacuuuuucaugcuguacccaccacuucuguuuccccgcaggcauccuacuuucuaaacuaacaccuuuucacucccgagaauucuaacaaauauuauacaauuccuacccgcaucuacccuccaccuggacguagaacccgugugggaggcaguccugcaggguuugggguggaauauccccccugucgaguggagacgaggcugacaugaggagugaauaaacgaacacagauaaagaacgaggcacacaguacgugcggggcgagagacucccuuugcuccucccgcuucaccuuugcuucagugccgcagccggggcccgugcccuccacgccagggcaucugagccgaacaagcugcucaccaaacgugacucagcaacgaaaaccacuauacagacgaaccauucucccagaauauuuuccacacugcugaacaucacaaacucgcuaaaggugcuugugguuagguggcaggaagcuggaaaauaggugcauguuaauaaguagcucacgaaaaaugagucacuaauuuagaacaauaaacucaaaguggccauuugcggaaagucuaggcaggcacauuaacugcgcggcugggagcaucaaagcagagaucccucccuggagcgagguggagaacggagggcgcugaccacaguggaccacacccucuccuccucucaccaaaccagaccugaaagcaccgcucauucucugugcagaaaaaggauccuuugaugccaaguuuaaggcagcauuucggaagugaccaaucuguggucaguggccagugagauggggagagagugaggcuggggcucccccagcgcccauaacacucggugauguucugugcgagucaggcugacccugccagcagcuacccaagugacaggccgguggcuucacccagcaaaagucugcuccaaggugcuucagccaacacgccccuuggguugaaagacuuacuccucuugcacuuuuuuuuuuuuuugagauggagucucgcucugucacccaggcugaagugcaguggcgugaucucggcucacugcaaccuccgccucccggguucaagcaauucuccugccucagccucccgaauagcugggacuacaggcgccggccaccacgccuggcuaauuuuuuuguauuuuuaguagggaugggguuucaccguguuagccaggauggugucaaucuccugaccucaugauccgcagccucaaccucccaaagugcugggauuacaggcaugagcugcagagcccggccaccucuagcgcuuuuuaggacaauauuugccucaauucacugaaaauguauuucauuuucuaaacuauuguugccauaucuugcuagaacuaaacauaacauccugcuuacauucuaaaugagaaacaauaacagcuaaguaacuccuagcaggagcugacgauggucaggcacuuaucucuggguuucauucacagaaguaguacucaugguucucaccagagaaauaacuggcacagauacuguuauuguccccauuuuaaagaagccagggagaugauaaagaccauccugaucaagguugggaccaacuuucaaaagcaaacugacccccacucugcuguucugccucuccacacggacucauucaagccucaaggucaacaucccaucacuggcucauucauucaaguuuuccugaacuagcgauuaagugauggccacaauuuuggggacacaguguuguaagucccugcaccccaaacuuccacugcugaagaggugaugacacguaaauuagaagaccgugugggaucacgugcuggaauaacaaucacgcaggcggaacacggcagggacuguucuuuuagacaaagugaccugagagggcccugugaggugguggcauuugagccgacaccugaaggacaugugggaucaacgaucccaacgagguacacacgagguggagggaacagcaagggcaaggccugggaggggaacaagccuggggguucccacggggcagacagaggagacacggcugcagguccgaaggccaugguaaggaccuuccauuccgacuucagccaccaugcggagugucgcccagggcggggaggggcugcggaaggcgggggaggcggagagagagcugggagagauggggaaagggauccaucaggacucugcgauggacuuggcgugggugugccacacucacccagguagggaagacagagagacuugaguggggagaagcaagccggaaauccaaaaugcagauuugauggaaccugcugauuuuaagagagccaaucaccauuuugaagagcaaacaguacgucuaaaccuccuuugaaucauuacuuugugacuuucucaggaaaaaaaaaauccaaaauguucagaauuugugucaaugguucaaaauucaaguucuccauauucuacaacaacauguauuucagcagcauccuuuacucuacccgaaaucucacuauccaaauaccacgccauccugggaggggcucuaaucuucuaaaauauuuauucauuccuuuagcugagcuauuaaagaaaaaaaaaaaacaaggagcugaauauuaagugacacacacugcacucaaaacucuugugucaggaaagaaugugcacaaaauauacauaagcagugaagacucguuuaaugugucagcuggcugcuccacacugguucugccgucucucaccccgcgacagcugugcuccuuccugcugugacgcgucauccaaggggaagcucugcuuccgggccucccgccucuggaaggaggccgugcacagcccucccgccucuggaaggaggcccagcgcagcauccuccgugauggccaccgcggccucucccaucggaauugcagggaauaccccgcuccacaucuccuaugaggaugcguggauguccucugguuaaacaaagcacccugcuuuuauuccaugacucugacaagcacuaucaggagacacgugugguccagacaucaccuuaggugcugagaacccagcugaugaagacacagagucggcccccagggguccgagaggagagguccaggugauaacaucacugugucuucaguacccggucucuaacccugcagguggcuccccagagaucccggggccaccuggccagaaccaguggggaagaacaaggaauugaaggcugugaaaaugugacaugagauucagauaguccagggccccgcacggcccagcuccaggcagucagcuccacgugccuuccugccacuggggcugccacuggcuggagccuccagcagcuugucuuggggcagacacaguggguacaaaaucaagcacugguucacacagcaggccauucuccugaaguauccagaagcugcuauggguucagcgugcacuggcaguggugacacaggcaucgggccuccuuuagaggaacgucuuggccucuccaaggagaaggggccagaagaggcacuuccucccugggaccucgacagaaaggacgguuuucaguggccugacuguggacugcuguguuccagccagaagcccgcugccagaggccacagcgaaggggcacgacaguggacuggcucaugggccuccccagcagaagagcugccagagaugggacucgggggcgguuuucccucacccuuggcgggauccuccccucugcagacccggggaaccugcccacguguguucacgugcccccgccacacgccugguucaccucgagaccugcaucaacuuaccggugcagccagcacgucuggaaagagacucgucagcuggcaccuggcccugugggcgccgucagcucccuuagaggaugacgugggguggaaagggccuuuccacaugagugguuuccauguccucaacuuuaaacgauuucaagacguuuuacucuccuuaauuuugguacuaccgaauaauauacaccacguaguuuuauuuucauaucuaaaauguuuucaaacaaaauuuuauuucuaaaaagugaagaugggggagacacacagaugccaccacagcuagcgucgugggugaucuggguaaagauuuccauucccagccaggcacagugguucacgccuguaaucccaacacuuugggaggaaugaggcgggaauauugcuugaggucaggaauucaagaccagccucaguaacauaaugagacccugucccuaucaacaauacaaaaaaucagcugggugugguggcgugugacuguagucccagcuacuugggaggcugaggcacgaggaucucucgagcaagaucacaccacugcacuacagccugggugacagagcaagaccugccuccaaaaauaaaaauaaaaaauaaaaacaaagaguuccauucuccacacacuggccccagcuguaaccacacaguaccugcaguccuagcuccugcuugagaugccccaaucuaccuccuuguauucuagaacacgcucucccacugcacaaggcucauuauucaaugguacaaauguacauucaagauaaucacaucauuauuauuuaauucaauaguacuccagcacacuccucccuccaacaaaaccagcuuuucuggauccucuaagaagcagguguaccaugugcagaaaucacuauuacauuucuguuaugcacagaaugaauauacccuacacaucacaaccuccccuacaccaagacuaacuuaaucuuaucacuauuccuuuuuauacaacagaagcuucaguuucuaaauauacagugauuucuuuguauugcauucuauuuuaaucuucuaaaaauagagccaccaccaggagaagcgacuugcuguuggauguucacuacgcuaaugucacuggcaggauguggauuucugccccuuccagacuuuccagcuugugguuuccacaugacgacugucauggugguuccaggauucuggccgggagugugggagcaggaucgcccagcaucaaagccaggauccacucccaggagccugugaugccacaugagccagcugaucagugugggccucaccgucaacagccaucgaaugggugccaggaugcucuccaaccuugcaggacugagaggacuggacuaagcacccacaaacguacucacaagccgcagugccacagauagccuaugccauggacauggcccacgccaccauggacacagcccacgucaccauggacacagcccacguugugggagcaaguccucugacuuuccccuccuucagcagauuggcugagagcauuucucagguuuuagcagaaaguuaaagagaaaaaucaaaaggcacgagggaaagagcagaacaaaaaggaagcuguugccuccaagagcucucaugucccacggaaguuccuucuugaggaugggaagauggucugugcccgccaccuccuccccuugcuucuccgccaaaggacaaacacugcaccaaaccagagggcagucaauagguuaaaauguuuucuuaaacgauuuuccaagguuuuaaaugcuucauagcucuaagaacagaguuauccaaaauuuuaaaaauauaaucccuuaucuucuguuuaauaaaguuauuuuugaauuuugaagaagcagaaauccgaucauuucucuccucccucccugacgcacacacccuuaagacccagccuguucuccgccaggaacgcaccaccugcgcuucgccggccaccgguuuugcaacggagagcccgcuggccacggcggcccgcacugcacacuuccuagcaggcuuccuguguagcuggcagugugccuggcagagcagaggcacaacacacauucccaucacacuucauacgcggcauuaagcucaugacauauuuucaucuucuccuaagauauuagagucucgggaacaaauccacuuccuaucacucaacgugcaacucagaugauaaaucuuguaccacugcguuagcgugguaaaaaucagaaucauacggcaaagaaaacacagaaauuacaucaaaacaaaacaaagaugcagcuuucguaaucuaaagcaaauuucuuugguuuuauacccauaaagucccacacuugggcaugaaggcaaucuugaauuaaaacgaacaccccuguaugcuguuaugaccgaugucacaucuaauauucagacaacuagaaagaagggcuagccuuuuaacucaacuacaagaaaagaggaacuggaaaacagcaguggcugaauguguacuccuugcuuugauguucugaauuaacacgcgccuguaguaaaagccaauuuuacacuuugaaaagcacagagccuccucauguccacaacacagagcuacagaacacagcaagucaaccagaacuuuagguucccaaaccuuacugcacugacucgauaaggaucccucgcuucccacuguaagaacaaagaaacaguuaugaagauagaauaaaaucucgcccuaauauuguaggcagaguugaauucaagagaagaccccaauuaccagaaaggaaagaaagcaaacggcccucugagcaggugcacuaagacccagcugccuguuccuggggcccaagagucaucagaacuggagacaggcaccagggagccagugggcggcugcauaucugggugggcaggagagguggccaugagcguggcuuggacagggaacuggaacugagacccuguguccgggcagaacucuuggaggacugucuggucuaugaaaagagaacuagaaaaccccacccaccaggccugggaagcaauagaggguugcuaggaagaggcuucagugagaaucuaagacccuaaaccugggucccuguggauguggccuccagauucauauucuuugaguaguucuggaaucucaagucuagaaauaaggguaaaacuagucuagaaccugggaaacccuguagccccaggaagacaaagaaaaauagcuccuuagggcuacacccacaauccacagcacacaaaacacacaaagaaggaugagaggaagggagggaggaaaguccccugcugaagaguuuaccaugcaaauuuaacaucacaaaugauagauggaaacaacccaccaugugggaaucggcaagaacaacaaaaccgagaaaugacuccaaaauguccacaaauauuaaaacaauguggaaaagacaacaagcugcgcuaaaaaaaaaaaaaaguuaaaugaagaagagaaacuaucaugaaggaaaaaaaccuggaaaugggagaugagaaguuuuuaaaaagaauuaagugaauuuucuauaauugagaagaacagauuagaucuaguuaaagauaaaaacagcaaauuagauauaaagauaaaacuagaucuagauaacuaaccagaaugcagcacaaagauaggaaaagauaaaggagagaagcaaggauaaaagaauaagaugguccaacauagaccuaguaugaguuccuaaagaauggaaaaaauguacaaaugcaguauuaaaacagauaacgaaugagaauauuccagaauucagacauaacaguccuuagauuuaagaagcaugcuaagucucuauuaggauaaauaagugugaaucgacaucuagacacagugcaauaaaacauuuaaacacuaaacauggaaaaagaucuuaaaagcaccaagguaggaaaguuagaugaucuaagaacauugaauugagaggcaauguuucaacagcaacaaaaguagccaaaagauaaugaaaugucuucaaacaugcugaaagacacagcaaccugcaauucuacaccuaucuaaacuaucauucggguaaaagggaaaacaaaaacauuuucagauaaacaaaacuugaguacuuaccauucagaaaccauugcugaacuaacaagggauuaugucagaaggaagaaaaucauaucccaggugaaagaguaagaugacagaagcaaugguaaggcaaaaacacuaguaaaucauguaaguacacauuaauaacuacugaauauucaauuaauacaaagguucauacagauaccgagacuauguguaaucuuguuuucucacuguguguguguguguguguguguguguguguuucaaagucacuguuuaaaacaccugguugguuuccucuuaagaacaacauagaccuuaaaauuaaagggcuucccuuuuuccuuugacagcuaagaaacucagagccaauuaugcaggguuuaugaccugcaucuccgggcucuacuucucuuugagagaccgucauuuuuucuuugcucugaguccuuugucuuuauucuuacacagccuucacuaaugaaauaagaauuaaguacagcugucccugaaauuguacgcacaggcaccaaaacacuugacacgccaacaugccacagccuuggcuucuucucauuauaaggaggaagaggaggccacugaaauauggucuagugugaguaacucugcacaacucugcugaaacaaaguucaguaccacuaaaagcaggguacgagcucagcaauccuacucugaaacacaaaaagcucccaagagcaugacugacagcaaucacugccaggcacaugggccauucuuccugugcugcacucaacaucacacgugcaugucggagagcccgucuuuggaaacagcuacacacuugggcaaaagcaauucuuugugagaaauaaucagcaaaagauugcuuauccuuucuacacucagaaauuaguuaagaguaaccagcucuuggaaaaggauaaaccacucuaugcaaauacuccugcaaagguucucgauuaaugcaaauauuauguuugucuuuuauuuuaaugcaaacagcaucuguucugcacaguccaugccaucacuuuguagucuguguggagcaucucaaguguguuccagcugcguuucagaguuugaaacauucucagagaggcagagccacagaaagcgguucacugaagaaaacagcaaacaaguucaguggggcuccuucuaggaggcuucuuucucuuuuaaggcaggagagaaacaaauccaagaaugaauucccaaauuuacuucugcagaggucuggcuuuaagugugggauuuuucuuuuuuaauaguuuugacuaaggaaaaaauuagguuugcuuuuucugugaauucugucgcaggggaaagagauucagaacaacacaugggggaaaggacaggcuggucggggccaggcugccauccagagcacugacccagcgccgaggcggguuccagccccucccagaaggccaggacuucaccccagcagcauccuccucuuucauagaagguguuggccaucuagaaggcucccugccaacacuggcuuccucagaucgcuccacugauacuguucugugucugccccuaagaggggcauacccuugucuguuuuuguguccaugacccugaagcaaugacuaguucagcagcagaagggacuggaugggcagaugacuggaugaauaaaucaagcuaccuauggggaaacagauaauguggagaaacacugacuugucacccuucagauuucaaauauagucaacuuccaaaucucuacccaagcaagaguaccuggaaacaguuugaccuuaacaugcuaauaauacuaauuuuaccauuccauuuguuagaaugcagguauacugcuaaucggauccacuagaccaagaauccacgugggauagccuaagaagacagaagaaccuggguauuuucagaugucccucaacagaaacaccuauucucacauaaacuugcuguuaaaacucuaaaauauccauguagacaaauaacucuggguaaauaacagaauaagcauuccuauaaacccuuuaauaauuaucuuaguuauuaauuucauuucaaauugccugauuuuccauauauacugcuaaucaucuuauagaagaauuuuguuuuugaccaaaaaaacucugaauaucgauauuuaauaaacaugacugcuucaaaaaacacaagugcaaaaaaaaaaagaaaaaaggugaaauaggccaugugguccagccuuagcagagagaaaaaucacaaaagcuggacaaauauaaacacaucuucuugaugacacuacuaaguuaaaaaaaaacagugaagaauuacaggaccagacaaaggcuggggggugaagauggcauuuggggcugauuuuccccuguugguauuugcagagccccacccccagccaucuaagaaucuuuaguacuuuugaccgccucuugcagauauuaggguuaggaggagaacuccagggacugacaggcaggagagaaggagggaaauguggguugggaucuggaagcaaccccuagggaaaaaaagagacuccacaauaaauggacccucaacaauugcagcucugcuucuaaugacucuguaauccuugaaauagaacugaagugaugacucauugcuagggcccccaagcaccaggcagaaacaaacuucagucuacuaaugaggaugaugucaucauccuaggccucaaacugucucaacagauuuugcaaauaauauuuucaacacacacacuuacacauucacauaucaggcagaggaaaagacaacccaacaaaaaaaacccaacagaacaacaaacaauagaaaaagacccucaggugcuccagauaauagaauucugagaaagagacuuuguuacuuauuugcugcaauaccaggacccauaaacaauaguuucaaaguaggaauaucaauaguguucuaguaacgauaaaagaguugaaugcaauuuaagauccugcggcaguuuuagaaauagauuuuaaagaaaugaugauuucuauguuuaagaagaugaguuggaaacuugaaaagagaauucuagaacugaaaaaugcaaaaagugaaauuaaggacuccaucauuuaacagauuagacacagcuagagugaauuugugaguaggaaggugggccagaaggacauuuccagaaugaucucaaaagucaagggcaggaaguuggagaaacagaaggcaccgagacagaaugugcaggcagacacaggaaaggagacacugaacgggucaaaagcacgucugaaaggacccuggccaagaacuaccccaaauggcuaaaagacaccagggaaaauugcugaaaacaaaaacggccguggagggggaggggggauuaccuacaaagaacagcaguuaggaugacuggugauuucucaacggaaacacguaaaccagaaaacaguaauaucuuucacagugcagaaggacugcuuagaaguacuagaagaugguaacugucaaacuagaauccucuaaccagcacgggcauucuucaaagagucauuuuccaacaaagacugaucaucuuacaccagaagacauucucacaccugaucucagagggaagacuggaaaugaacacccauauaaagaacaaugaaaaggguuuacacguguggauauauggaaaugaauauugacaaauaauaaaguaugccacagaagagacaggacaaaggaguaagggcacagugaaauggcagaugggcacacaaacauucuaggcaaucauguucaauguaaacaaacuaaaggcucuacuccgaagugaagacugccagacugcauagaagaacauaaacuaaaaaaauucccaaacacaugcuuuucacaaggaaauaucuaaaacauacagcuaugcaaaguauggaaagaaaacaguuggaaaaauauguaccuugcaaauaacagccgaaggaaggcuggcauagcaauauuaacgucagacaaaguagacuuuaacacagguacugauuccugacuuugacagcguaucaccccauuuuuuugaauauaaugcaacuaaaguaaaaaucaacaacaaaaaagaacuaggaaaaccuuaaaauacacuuggccagaugcaguggcucacgccuguaauccccaacacuuugggaggcugaggugggcugaucaauugagcucaggaguucaagaccagccugggcaacaaggugaaacccugucucuaccaagaauacacaaaauuagccaggcgugguagaacuguggucacagcuacucagguggcugaggugggggacugcuugagccuggaagguggaggcugcagugagcugagaucacaccacugcacuccagccugagugacagagcaagaccccgucucaaaaacaaaacaacaacaaaacaacaacaaccaaaaaaacacuuauaaauuaccuauaugccaaagggaaauuggguaauaaaaauagcacacauuaaauuuucugggaagcagcgaaagccaugcauagaggaaaauggccuuaaaauccucauauucggguuccacuucaaaggcuuagaaacaaacggaaauuaaacucauaaaagugaaaggaaguaauaagaacagaacuuacugaaacagaaaagagauauagaccgaagugacaaaaccaaaaccugguuguuuaaaaagacuaaugaagaggaaagaucucugcugacaauguugaagaaaaaaggaguuucuucucagcccagagccugugguauggcgugagccccagucccuagaucacagccugcaaguaggaaauauggccuuguggggcaggagaggaagagagaagugacacagugaaacguccuuugucacacagagggcaucugacagccagcuaaggagaagaggaucuaagggugaagcuccugccagagcccaggaaggaaggcugaagacucaaggagccagaugacaccgcucccuugccuuccacccccaacgcugugauugauuuccuaacugcaugccaggccgccaccucuauaagcugagcaauuccuuuuggugaaguucagcugaaagacagagguuggggugucccauccaacggaagccccucugcggaccgcguguccagacucugcaggcgcccugugacgacucucuugcacacacgcacacacacacgcucaugcaaaagcaucgcaugguggguaagaccguggacucugaacccagacgugcaauucaaaccagacucccucacucacuagcugucagaucuuaggcaaguuuuauaugucccaguuucuucaucauaaaaugggaaggacaacgcuuggaucucagggugcugauacgaguauuaacuaagugguacaaauaacgggucuggagcagggucuguuuauuguccaauaaacaugcuaaguuucuauuauccuucaucgugguacagaaugccccaaaccggccugcuggccucaucucucuucccgccagcaaucccaacacuguagccucaagugucucuaucaaaugccuaucaggccacucacuccugggaguaccgcuucucuguggcccugcuguguggccuguggccuguggccuccggcucugcuccugcagccugcaagguuggaugugaggggaugugaggucccccugcugcaguguucucaugccuggccucccccugggcacgccuuccaccuggggcccgagcgcugccucucuuucccauggagggcaggaaggcggcucacauugcauugugcaaauggcucugucuuugcugggauggggacucacaccuugaaccugagaaggaggcacggaagccuauccugucagcggccaccaagaaaacccagcuuccuacguggaagaugacaaggccagggcacugggguggagacggaagccagccugggagcggcuggagcggcagucuccgcuccccacagguacaugcaccuaaacucgaugcggcacuaagguuucagguggacguucuggauguuuuguuuguuucuguagagacaggaucuugcuacauugcccaggcugggcuuaagccucagccuccugagaugggguggccggggugguguuaaagauaagacugagcccagcuggcccauucuguaaaggcaaacagaaaaucaagaaacgugcaggugagacagguacugccgaggccuaaaugcacuuuaggaacuaaauucaacagaauguacacgagcccagguaacacgcuagagaugagacuaaggagggcguacagaaggcaccaaguccagaacuccaccccagcagcugccgugugcugagauggagcguggucacagccagccaggcucugcacagacggaagcaaaccguggcaggccugggcucugggaggugggcaggcccuggggacccuguuaggugcauccauggggcauccuaggacaugacaaaacacgcuucaacaguugccaaaaaugggcaucuuacuagccugccagccagcauguagacuucccaggcugggagccucagguccacagaggaggagccuucugguucccccacaacccacgggcuagagacaaggcuggacaaggggucucccugcugaagaaaagcagaagucagcguccuaagagggccuggugagaugguggcccaggcccacggggaggaaggggcagcagugggcugguccacucuuagaaggcgagguuuccaacucaaaccaccccagaaccuucccucgcuccuuaacaguggcaggagcccggcagggacaccccccacccggcccagccaggagguucugcugccagccugcccagggcaacugagagucucgaaaagccuaugucggaggguccucggguugccuggcgccaugaaagcacugccuucgugagcccccggccccuacagguuggccucuucccugaaggccccagacacagaggcccuaggugggaauccagcaggguggcaucugcccccuugucgcuccaagggaaagcccugagggacccucccaaccacgccagcgccgccugcagugacgccgggccacgcucaccccaaggcccaagaaggagccacgguccacugagacccacgacaagguauccacguggcuuuuuauaagcuaguauuuccuccuguggugucuccuugggggaauccuaaauuucugugaugugagauaaaauuuuagugggauuacagaaaccuuggcuuaguaucagagaccacaauaacacacuuuagaaacagaguagcaauuugguucucugcggaaucguaaguggaagggauguauuuuccuugagauuuuaaaaauaauuaggaggaagagauaaaagagaagcuuuugugaaagcagagauagaaauuuaauuagaaacagacgaggaucuucucaaaucacccuugccuuguuugcccagguccgagaugagguaaugccauuagcaggcaagacugaucucuacucugagggggccagagccuggcucugacacucuuggccaaauguccccauccucagccuggcuccauuuucugggcaagagugugggaccaacgagaccugggcuagugcaggggugggcaggcaccacaagcgggacacccccaagggugcacacggcugaaggcgcaacgggcacagggcauucugugggccacgcucgcagcccaagaacacagacgaggaggccugugcucaggcacuaaggacacggagggacuguucugggauccacccagcagcucuuggaaaagcuggugcccuggugagcaggagagcgugaggcucuaaggaguggaucccucacuggaaggucacggcaccacugagacagccuggaagcuucugugcuucacgaaagaucuacgcgugaagcccccgggaagccaagccccaggaagggcccauuaugccgaugaagacacgagagaaugaaggauguggacacugccccaaacacucgggaccaagagaagaucccagaaccugcugcggcggugacacaggcacauacacaccacugcaauuacugcuagaaaauaugaaaaacacuacccuccuucaugucugcugugucggugcccuagccucugccccagaggucagaauggcuccaagggcacggggccacugugcaacugcacaucagccaucccgaagcccgcccugaggacccccgcccagcccagcccccuacacaucagcugucucgaagcccacccugaggacccccgcccaucccagccccuugcacaucagccgccccgaagcccgcccaguccccugccuggagaucaccccuucucuucacaacaggcagcaggugaacagcuucccccucggagcugccccaugggccucacugcacagguguggaggcguccacgucuacaccaccaggaacccccaggcagggcagcucuuggcacugaugcccaacggguauugcuaggcccgcacggagcugcugucaaggacaggggcaagggcagggaagugaggcucuacacacagcagcaucuucaugccuugccugagaguauguucuagaaggacacgggagagaagaauaaacagggucaggacagucaggaaaggccuccaaguuggagguguuaaccacaucugaagggguuccugagagacacgggggcaccgacggggggacagagcccagugcugcuguccugggcaugcagagcaagccgccugccuggccccagcuguccgacucggcugagccucgccuccugcugcucgaucuaagcuggcugcccagugacgccacucugccccuucucugcagaggggaagcuccgugaaggcagagcccugucuggccacugcuccccucagucugaaaggaaggguacgugggcaccucugagagccaguggcuuacucagggcacacaggaccuuuggggugggggccauccucgagcgggggcucaaugacugaaaacaaaagggggaagacacagcccuggaaaggagggggcugacuuucccaggccaggcggggagcucguggggagacgggcucuggccucagccuaaggucacaccccaaaggccaucccagacaccggaguuccugccgcucggggacucccagcaggcacaggcuucaccucuuucugcucgggccgccccagccuccacugcggaggagcagaugcgccugccagguuccauucagcuucgguuugcaaauggaagcacaggcauuuccaaaugcagcucacauuugugaguguggcaaaagagcgaaagaccgugggggcaggaaacuggauuuuguuugguugguuucuaaaugucuguuaagaaugugcuaauguaagacuacacaugaaggucgcugggcagaugcagcgguuuaucuuggaaaaagaaguguggcugcccacggcucugacaggacagccaaccacaugcgaccagagggagauggcuugggugagccgaggcccuccugauccuaaguggccaacagggugcuuugagugaugcucccuagggcucgcagccugaaccugcagagguugaggaagcugaugcaacagucgaagaauagaucagccuuccuggguagaagccaaggucucuagaagccccguccugucugcagcauuucuuggggggaggcucuucugaaagccaugccuugcggcaggucccaggguguaaacacugugcaggggggacaccuggcccacugcugccccgucggaggguccugccccuuccuuccuacucgguguuccggggaccugaaggcccccauaugcugcuggagguguggcaaugggcuuucuuuuuuccaugagcuggaagcugccucucagaacuguccagcuucagagaacccugaagauggacucuccugccccucccccugcagagcagggcaggcccaaugcgggcugaaguggacaggggugcagagccugacaggggcuggagagugggggaugggggccaaagagccaggggccagcccuggggcucucccaccucccuugaaccacugugaacccgccccaggggaggacuugcugcuccaggucacccuuaacccccaagugacaagcagggcucccacaugugugccaaccccaggauggguccagcacacucaggaaaaaucacagccucugacaguacuccagaggcaucacagaugaagucauaaaacccuccccuucaaacgugugacuucucagcaaacaccgccacagacuuucguaucaggaagucaaucuuagcccagcaaugggugugguuucaaaauaaaucacuccuccagagaagccaaggccucccacucagaaacagcacuuccaaaaucaaagaaaaaccccacuguuaguggccucccagcaccaccccucugugcuuucugggcacugcaugugggacaggugaagagcccuccuggggggaggugcgguggggcgggaacccaggcccucccuuugccccugacucuccugcuccgcagagccuugaggcacaaaggacagagcaggaacacgaggugaugccaaugcucaccaggccacagcgccggcaccaacacaggcaccccacaaagacacagccaccaggcugggugcaggcucaaggucagccagcucugcaggaucccaaacaacagugucagagacaccaggcuucuuggaacuuccaaacaccauuuuaagguuaugcaugagcucaagcauucugcuagguccugggggugaaugggaaugcgggaaccaugccaugggcuggcuggugcugagugggcagugccccgaucaggcuggaguacugaccuccugggccuggugggaugaggugaggccaaagcgagcugccuguccauccucauacaccaaccguauggcaggagcguggccugccuugcccagcucccccucuaaggacagggagggggacacagagccccuaagccugcgcagaggcugcuguggcauccagaggggcugccagccagugaaggcugcugagaccagaggugaaccauaaggccaaggggccaggccagccggagcccaccacacugccauagccccucgccggcaucccagcacagugcccgaggcagggagcccacacuccaggcaggccuacuuccuguagcagagccgcuaggugggaaacgugccccugauucuccauaggccgggacccuggucccaggagcccacacugagauucugacuguccucaaugcccugcacugcaagccacuggcuuggccugcccagcccuccaugaccuccgcacagccauccugccugcagcacagauucacagcccaccugcccaggggggccuggcccugugcuggccaugcuacccccaccuauuccagaggugccuccggggcugcugaggacaaaugaggcuaacaauuacauaccagcugucccgaggcaagaguccacgauuucaugacacacaccuuugcucccucugggaaauuauaagccacuggccaagaaaucaucauggcuuccacacacccaaaggcaagcgcugcagcucacagcucacaucccacccucucucccucugucuccacauucuacaucugccucuugggacccucccaaugucaccauuuccagguagcccaaaggggacugugagcuuguaaaguggaagaggcucuuccuucacuuagccagcacugacggugucuacaaggcacccgcuuggccucuauagcuccugggacuccugcuccaccccacacccaggugcuguggccuuccccaggggacaccaggucauuaguuucgucucccccagcccuaaccacuggagguccccuaagccacaggggacaaggcagggcuacugguaaucucucaggacaccacccugggcauccugggcacaguggcugugcacagcuggugcucacagcugugcagagggagaguaagugcccacauggucuccgcggcagcuguacacugcauggggggugccgcuugaccaccuagcacuccuguggcacuggacacauuacuugaccucugauguugccaucuaugaccugggagauggugggaccuaccaccguccaggaucuagggcagugcccggcccacagaaaguucccauccacugcaccuauaauuacacuucguaaacacuaauccgugaccauggacacgcauaccacacccguccauaucacaccagacagacggccucugauacagacccucccgaggaagccgauggagucugaagagcaccaguggccaacaguucccagcggagcaccagggcccauggcaccacucagcaguugcccaggguccccagauacaacgguggacagcaaggacuccccaaacccuugaggacgugcugaaggcagcaaaaaucuacaacuguucccggaagggcuuggcacagcuauagagaguuguacacacaagaaacuagccacaaaccggaaacguuaaaccacagcuccgugacacuuccucaccaggaggcggagcccugagccaaggcagaccuggagggcuccacagaagaggccugugccaggggcccugcgcccuucuacacggcaauggggacucaaaucacagggacgaggccccucacgaagagcucugcccuggggcagguccucugcauccccucgcaggcuucucccuccgucaaggacagagacugcuccagccagcugguuaguuuccacccaaagccagccgcuugccauuguucccagcuucugaguucuuacaugguaauucugcacauuccaaacagucuuucaaauaccgucucgucuaagaaugagugcacuuuccuaaaaagacaaauaucaagcacuuaaaacacacacaccaagcuacaggcuauacuugaauuccaggcauaaaucugaauuucucuaacuguuguccaaauuaggucaaagaguuaccagaauaaucagaaaauguuuugagagggguuuaaauucacuugguuguaauuuuuuuuauuugcucaauucaucccauucucgcugcugagcuuucuccuuaggaaguuggaaugggugcuggaggaagugaacuugguccucagcaaacugggaaugccaacagcgcuggccacucccagacucgggcugguggccaggacgguggcccuggcgggccaggccccacugacagcccuaggcaggccuguccuggaaggagcagggcccauuccacacugugaagagugacccaagagaucagagauuagacuugggucuagauuuuucucaggauaaagugugauuuugaaaagacgcugaguaaauaagccacaugucaaggauaaagauauucaucaugaaaguaaacaaauuucucucugaguucuaacuuaccacaaaaaggaaucaacauacuucuucccugcuggcuuuuaccaagcauuuccacaguacaaucgguuuggugcucaugaccaccuggagggacagaagaaccugcccugugacuagauggccugcaggccaaggaagacaggguaaucccaggugaccacccauuuccugucagggacacagccccucaggagggcuggacagagaaaagggaacaggacuccccaggaaaccgcagagauccaggugugagaacugaacuucucuuagccuuuucaucaguugucaaccaagaacagggucagacaggcaagcuuuugugcagaagccuaccaggggaccuuagggcaccagguggauggugccaggcucccuacccccacaaaauggaaagaaacaaagaaauggcgacauagaagaauggaauugagcuggcuuuuaaagaaagacuaaucgcacuggcaagaaaucucaaggacccaucacuuccauagcugagcuuccagcggcuugauucuaggagcuaccauuggaaacguucaauuagaagacccucuuacugugcacacuaagaccuaauuuaccagcagauggaagccauccaagcacccccaucauucagacguacauacauucauuaucuacauacauucauacaucuacacaauucacacacccacauucacacacccacacacauucacacacccacacacauucacacacccacauacauucacacaucuacacacauucacacacccacacauucacacacccacacacauucacacacccacacacauucacacacccacacacauucacacacccacauacauucacacaucuacauacacgugcaugcaugcaugcaccuagcaaauauuguacauugucugugugcccaaggaaggguggggucugacuuccuggcacuggccagguaacuccugcaggugucaccucaacaccuuuuagcugagugccaaacuccauuccagucugcaggaauucucugcaagcuccauucuucagaaccccaguuuuccccacugaaugagaagcaugaggcccugcuggccuccuggaggaggaggguccuuauucaugccccagugggcuggccacugcgagcccgugcgcuuuccuaaaaagacaaauaucaaguacuggucaccucguggccgggacugccgggucaccguguguucagaggcugaguuucuacacagaagguuucuaagggaagaugacucaagucauuucaacuuaaagacacagcaaaucuuccaaguugcucgaaaagggaaaaaguacaaacuguccacacacaacaguauaauuacaaggccagcaaugauggguuugguucuuacgacccaaggcuggcucggaucucaucccagcacuuuguuaauugcacauuaucaugugucagggcuucauagacaagagcagcgaguggaccugacuuaucuccccgccccccaaaaugauguccuuacacaaaacacaacaggcaacucugagagagagucaacugcacgcagguggcccuugaggucccagagccuacucucuggaugagcucaggaugucaccagccuuucaggagccugaugacucccacggcagcagguaaggacccagaguccuggaggcugccccaucagcucugucucgggcugcacuggagcagcuguguggacccuguggccuguccacauccguauguguaaaaaugaauggaugacggaaacagaaaagcgccguuggugacaccuuggagagggaaauucugagcaagccgaaagaacucgcuguggccucaaugggaugcucauuagcugccccccgauguauucaacuggaaaggagaaagagcagagcuggcaacaugcagaaaaacaggaaauuucauggugagacacagugaagcaggcgauagagaaaaggaagacuuuaaaaugagauagaaugaggcgauagagaaaaagaggccuuuaaaaaugagaauccagaauaagcugaaauaguccgggggcuaaaaaaccuagacauuuauaaccuaaucaggaauauuauaaugcuuucaagucuccucggaacuggaccacucccuuguuccaaacaaagaugugcuacuugcauucagcauuuguauaauuucuuacaugcacuaacagggaacuaucugacauuucugaaaucauuaaaccaucuacuuaauggaaaggaguaagacgaccuguugacggauacgacagaugugagcguuacugugagcagcacgugcagacuuaaguggcucuuaguucaaaccaaaauaugcacagaccuccaaaaaaccccagauacagaguaaauuauacacugguaggcuagcuuuuggcaaggaaaauacaguguccguuccucauucagaaacauggcaaauaugugcauuaauauuaaauauauccuaauuaguuacaaaucucugaaaauacuuacaacucaaaggaccggguuuaucugauagacacacaaccuucacuuuucucauuaauuuggagcugaaggaaaugcaagauucagaauuuaaaaccaguaaaaagguuggggcuuaguauguuuuuugguguuuuuugagacagggucuugcuccgguugcccaggcuggaaugcaguggugugaucacggcucacugcagccucgacuuccugggcucaggugauccucccaucucacacuccugaguagcuggaaucauaggugcaugccaccaugccuggcuaauuuuuauacuuuuaguagaguagggguuugagaagggguuuugccauguugcccagacuggucuugaacuucugagcucaagcaauccauucaccuuggucucccaaaguguugggauuacaggugugagccacugugcucggucggcuuaguguguuuuuuguuuacacauucuaaguuuucagugcuguuguguuuggaauaaugaggaauacucaauucacaugaaagcaacaguucaucuuggugauuguguuuaggacuaugagagccgauucugccggcauccucccuagagcucuccaucccccgauguggaucuccggauuaucggguagacacugucgucauccccauguuacagacacaaagccuggguggcugaggccggcacagcugcugagugagaguccaguucuggaccccgaagacagguugcccuucauccuuccaagacguggccucucuccucaggaugugugucccacauucagagucccugauggcuccacgucccauaauuaaccucucaacagggaagauguccaccuggaaguuacacagagcuucgaaauuuccuggaacuuguguuucgagugggggaaaagccacuacaaugcugccauacucaacaagaccaauacaagucucagcagacaucacaaccuggcgccagauuccaacaaacucugcacaguaaugacaaaaaagcacaguuucaaaaaaaaucaacaaagaaacccagcucucucugugaaaccuuccauuuacuuggccacuuucccacggacauucaauuaaaaacaacugugggaaaagcgaaucuagccauuagacacugcagaagcuggcugggcaauaaaaucugccucucuccuaacagcccagagaagccuuuuagcauuuacauucaacagaagccaaaagccaggagccccaagagggggcccacaucaucguuccaauccaauccgaguucaauaaaugucucugauaggacaccaaaacacaggcagcaaaagaaaaaaauagccaaacaggauaccagcaaaauaaaaaucuucugagcuucaaaagacaccauccagaaaggcaaccuacagaauggaaaagaauauuugcaaaccauauaucugaucaaggagcuguaucuagaauauaaagggccagacaacucaaacaauaaaaaggcaaauaaucuaauuuuaaaaugagcaaaggauuuaaacagacauuucuccaaagaugcacaauggcccaugagcaugugaaaagaugacugucaucacuaguuguuaaccucaggaaaauguaaaucaaaaucacaauaagaugucacuuucuauccacaaggauggccaggaucaaaaagauacaagaccacccugacugucaaacccagcaucggaaccucucgcagccaaccaucugcacucacccccaaugcaccccugcgcugcugcugugggugccccaggcgaugcccucugacucuggcagagcagggcaggcaacuguaggggacaagagcagcagaggggcucaccucuguaccucccuagacccuuagacaggcaucuacccuggcccucucgucccaagcugucccuauauuccugcaacggcuucuucccucccuagcgaccuggccagagaguugcccacgaugagcggcagagucagagaccagaccugcaggucugagggcugagcacaggaaggauaaaugauaccccacacagggucuacauccucauucccggaaccuagaaauacaccaccuuagaugcucaaacggacuuuacacaugugauuaaggauacugagaugagggauuaucagauaaauuccggggacaggaauuauacaaggugacaaggugucuugucacagcagagcaaggaagcaaucaaagacugcaaggguuauguccaaaagacucaagggccaacuccacagggccucguggaucaaggaggacaaggugaacaucaaugagaguaacagcagcaaaggccuaaaaggcauggagcacacuuaaacccacaagcucacaauuacacacaaaaacaaacgacaaaacucaccagugaccuucagaugauguaaagcaacgagcucauuccucugaaagaugguaaauaaagaaagccuuuccugugugagccgaagagcugaugagggcacuuccucucugcagaagucuuuuaccugauucaggagugagugucuuggauuaucacucugcagcccccaggaaggaaggaaugaagcuagacagccaccuucaggacccgcucaucacccagcagaacgcccacgcccccaugccacagucuugccaacuagccccgguccggcgcaggcuccagcugcaaccgccaggucaccagaaagagagggaggaggaacuugcucaacacgccacauggacacaggcagugagagcucugccguggccacacaacaggacaagccaagcuccccaacaaauagacuggagagcaagagggaggaaacggcuguguccaucacaagugacaguggcccauuagaacccacgaaccuuacuuaacacuuauuugaacaacagccacauacaaaaagaaaagagacugaaaacuuuuugagacaauggggauuuuaaaugacugauuauuugauggauucacguguugauguguuaaagcugugacaaugguauuagggucgcauguucggaagacaccugcaugacgguagaacugcuuuggaacaauacagugaggcaggccuggcccugcucagccaucgcugaagauggggacagcagccuaguccgcuccuuauugucuuuucacuuucguaaauguuugaaauuuuccguaauaaaaaaugaaagauagccagugaaggugcuagauuuggacggggguaucacucuguucuguuuugcuguuuauuauuuguugcaaacauaaaccugggcucacaauuguggaagguuacacccucccagcucauucagagagaaauuucagagccaggggaccucauggccacuaaguuuccacgauucccuggaagagucacauauaaacacacuugugaucauuaccaaacgacaggacaagcccagugcaccccggcguccccucccaguuuuaaggacgaaucauguaugggcccccgcaagagaugggaaugagccagggcgccgcuggucucuaagccacgagccacagccaugacuaacuaggaaacuaggacaacagcuaccauucaacagcuaauucaacaacaauacaaguaaccuucacgguaaaaacgagaaccucauuugccuaccucgaaaauaaccaaagcaaagcaagccagugaagcuggggggcccugggaacccuacuuucccagauggcccuccacggcggggcucucucagcccagcacagugcagagcugucaccgugacucaacggagggcaagccucauccccaaagcugcuccagaaaagaaaaggcucagaagucccagguggauggcccuucccuaggccuggccuggcccccacgcuccucccagcuguccuucugacccugggccacucccccuucugcugcuccucuugguuugaaggaggggaggggcauggugacaucucuuuuuaauuaaggcuuucuuacaaguaaucuuugcaaagagcccuguccuggagugauuuugugugagagggaagaacagaucagcggaggggcuuccaaccauaaacauucccagagcugcgaauaugugccccuggccacaggauuacacguaggaagccagcacacgcuacgcuaucauuaccaucucacccaucucccguggcugacggggaucgggggaagaaagggugggggccggccggaagccccgugggccgaagccaccccaggcccucagcccagaccaccaggccgcgcaggcuggccuccugaggcugucccuggcaagccgccccacgcuggagccaggcugccggcaaagcgcugcucacugccgcuuucuucacaugugguuugauugacgcaaaucaagaggcaagcaaaugauucauaacuguccaagcacagggcucacccagaaacggcaggagcccagacuugcugauucaccaagaaacggcuuuguguaccggaggcgcuguuggucgggacgcuaucauguaugcacacggagcucugcaaaugugauggcaguggcgaugucauggcccacggagugacagcagacccuaaccccaccaacaggcagcaaugcagggccgccacgagggggacacacauggaagaacagcagccaccgccccugccugcacggucugugugugugcggguggcacaccuggguucgguacugccacccugcgacuccagguccagccucagagugaggcugggggccucugcagugccuggucccacuccccaccccucaggcugccaggcacacccaugaugcaagaaggcaagauagaacgccaggaccccugccuuccaggagcucacagggaggggaagacacccaggggagccccagauagcuccucauggugccacgugccacccugaagguauggggcggagaagaugaagcuccucugucgccugccucauuugggaaagcuucccagaggaggagaggccuuaaaaggaugggcgggaaggcaccaggcggugguggacaggcuccgcccaagcagauggccagcaugcucugagccagcgcaggccagggaccucuggggcugggacugcccuggggccaggcaaagaaccaguguuccuccacugccagggaggacugcgcagggaccugacucacggcagacaccgacccccacgccagcaaguucacucugguggcaacgcagagaaccugaagauggcagacaaguuagagcagcugcaccagucuuacagaggcagggagaggccccgaaccagagagcgggugcggacccuuggcaaguaugccuuggaaguguugaggggagaaggcgucaagucguggucccgccaacagagaggccugucuaacugacucagcagccccucugccuccagcucccugugucuggaccccaggccacaggacgggggcaggagugggacaggcacccggguucugcauguauggccugugccaccuucaaagcagcccugacggaccucccaacuaggccagagauugcuccauuggucaucagugcuguuccugaaacggcuucaccagucauggggaccuaagucccucuagcuggagaugagacaccgauacaccgcagacaccaucugcucuccagacacaggccacuuccuggacauugccugcugccuggacacugcccgcugccuggacacugccugcugccggaacacugccugcugccuggacacuacccgcugucugcugccuggacacugcucgcugcccagacaaaggccggcugcagaggccagcagagcagcagagccaggcgaggcaagacggcagagggaggccagggggaaugacaacaggcuccagggugaagccaccaccaagugaucaggucuguguaugaguucauucuucuugcaacacugucugucaccgugccacaaaaucccccaacccugacccccuaacacacaccccucuagcccuuggggaacaccauucgagagucagcuguggagccuccccugcucugugcagccccuuuccacugccgcgcccuccugggccugcauuugccccugcugguggcaccugggacucugcacggcacuaauauuuugcaauucucuuaaccauucuugaaagcagggacgggguccugcucaccuugguguacccagcaccugguauaguggggucccgagguuagcagaaggaucaguaaaagaagaaaacauguauuuggaggacaaccaugcucccagagccgagcccggugagcucagcuucugaagcuccccagaaauagcagaugcccucuuguucccggucuguccaguaaggccuuuccaaaggcacaagggugagagguggggagaggaggagcaccaagcucauuaccagaagggaagcuggggaaacgacagggaagcccagaagugcagacccagguggacaggcccugggccaccacccugggaguacgggccggucagcaggaaggaacauguuuauggucucugcgcuguuggugccagucacgccaugguggcccaucgcugaucaucacacguucuguacuccggagcaggaaccagggucucagggcacuuccacaagcucaccggacaugugcccacucucaccgcacgcauccccggaaccagugaggccaguucuagcugccuaaaagggccacacagccgcccagccugguguagccacaaggacccuggcuugauaaugucugcuuuggaaagacacuuccagaacgcccaacagcgcuuagcaaacucacacagaaaacaccugcguuccacagcaacuccacccgggccgggacccaggccugaagcaguuccuacuacucagguucucagaucugccggaaacaaauaacugagaauacucuccgcucagcaggccccagucauacgccccagucacacaccccagccacacacuccagccacacacgccagccacacacucggcuccccgucucuccugagcaggccagccacacaccccagccacacaccccagccacacacccuagcaacacacuccagccacacgcuccagcuacacacuccagccgcacacucggcuccccgcugguggaggccaccuggaggcucagggugucuugagaaaugaacaggugcucaccauuggcuggaaaggguugaguuuucaaauuaucccaccauuagagaaaaaaagaaaaaaaaaaaaacagacugguaacaaagcaucaagccaagugggggugacuucacccugaggacccuccaguggcagucuuccaagaagaggugcccaccaaccaguauuuucuacaaggccacagaaagcauuuguuuaaaaaaaaaauugacaaucuaauugguaaagaaaaggauaauuuuuaaaauguaaaaacauauuuugggccaggacaagggcucacgccuauaaucucagcauucugggaggcugaggcaggcagauugcuugagcccaggaguucgagaccagcuuggccaacauggcaagacaccaucucuacuaaaagacaaaaauuagccgggcauggugaugagcagcuguagucccagcuacucagaaggccgcagcaggaucgccugagcccaggagacagaggcugcagugaggcgagaucaugccacuguacuccagccugggugacagagggagacugucucaauaaaaacaaaaaacauguuuuguaccacaugucagucaaaauaaguggccgaaggcugugguuugcuuuaauucaccuucuaagguggcucuggaccuuccuucaggaaacggcuuuccugcccaucaguguggcucucuuccucuuuaaacaugaggaccauuggggccggggccgggaagaccacacuccugaagccaggugcaguaguguggacauguagucccagcuacucaggagggcgccuggagcccaagagcucgaggccagccugggcaauagugucagacccuaucucuuccaaacaaacaaauaaaaagacuaugcugccggcaggacugaaaaaccagaaagaaagaaaaguggggcugguguggggccacacccugccccaggcggggaaagugguuggagguaauggggcagcagggcccacaggccggagggcuccccuccugauuccagggcaucagcaaacucaaauuucauaauggcuuuugcuugcaaaagcaaagugccugauuugcuguuucucccaggagacucugggcugcuaagaaggcaaagccugaggucugugccugaccaggagaugcucacgucucugagcugaaaacagugacugaacaaaugacucauuagagggaucaaugaacaaacuggcaccaggcacuaaauucacacuugauccccucagccuuauaauaaacucaugaggcaguucuacuacauccaucuuacagacgagaaaaucaagguucaaagaaacuaaguaaugcucccaauaucuaggcagaaaagcugggguucaggcccgucucucugccucugaagucuguccucucuccaacgucccagcagaaaaccucucccuagagaggacacugucggggugaggagcagaagggcaggggugggagcagcccaggguggagugagcugggacagcuccagcagcagcagaagccagaaaucucacacagcccccacagugccucccacaaaugaaggucuccugagagcaggggaccuggggacaagaaccagccacaccaggccaggcccgcagggggcaugggaugggggcgacugagugaggaguguccccuacccucaccacgagaguccagguggaaaccgcgcccucaggaugaauggccagcucucaccgggcuucuccacgccuuccccaggacccuucccuaauguuuccaaaguggccacaaaccaugaguggccugucugacguuucccuccccgaauucuaggaucaauaacugugguccacagaaagugcggaucccaccucucgggagcaucucaucccuuccacuccugcggaagaggacagcaccccccaaccccaaagugccuguguuuccuagcacccugggauuccagcucgucagcuaagaacuggccaugcugaugaaaucuccuuaugccacuugagacaugugcugguucuuguggcaucaacccugaaaaacauguuggucaaagaaaaaaaaaggcaucuggaaauuucuaccuuauauucucucguuuuuaacaaugccagcaacccaagagugggggcaaagcugaugugcgagugccucguacucccgagacgcuguguuaaagaaggaaagaaggccacaagcccugaaagcacauuuugccccaaacuccacuucacguuacaugcacgaagaacauuagaggaauacagagcuguuucugggaagccagcuccacuguaugaaacauugagucagcaugacucagccgugccgacuggucccuccgaugggcgagccaggggcacagaaggcaggcaggugacccgggcacugcacgccuccccaccuggucccaaaugcugaagccuccaagcaacuuaaaaaggguaaggaaaacauugugggagcaggugcauuguggccucugccaggaggcucgggggccucucucccgcgugaggaagacaccaggcacaacaaagaugcgacgcaacauccuggaacugucugcuguuaacaggggauggcaaacuccauccaagucuuguccccaugcacacacguguguaaaccauguacaccacuccacaauguacacaccacucuacaaugaacacaccacucuacacacaauguacacaccacucuacaauguacacaccacucuccacacaauguacacaccucuacaauguacacaccacucuccacacaauguacacaccacucuacaauguacacaccacucuccacacaauguacacaccacucuacaauguacacaccacucuacaaugaacacaccacucuacacacaauguacacaccacucucaauguacacaccacucucaauguacauaccacucuacaauguacacaccacucuuaauguacacacgacucucaauguacacaccacucuacacacaauguacacaccacucucaauguacacaccacucuacaaugaacacaccacucuacacacaauguacacaccacucucaauguacacaccccucuacaaugaacacaccacucuacacacaauguacacaccacucuccacacaauguacacaccacucuacacacaaugaacacaccacucuacaaugaacacaccacucuacacacaauguacacaccacucugcaaacaauguacacaccacucuacaaugaacacaccacucuacacaccauguacaugccacucuacaauuuacccaccacucuacacacaauguauacaccacucuacaaugaacacaccacucuacacaccacucuacaauguacacaccacucuacaauguacacaccaugcuacaaugaacacaccacucuacacugaacacaccacucuacacacaauguacacaccacucuacaauguacacaccacucuccacacaauguacacaccacucuacacacaauguacacaccacucuacaauguacacaccacucugcaaacaauguacacaccacucugcaauguacacacuacucuacacgcaguguacaccccacucuacaaugaacacaccacucuacacacaauguacacgccacucuacaauuuacccaccacucuacacacaauauauacaccacucuacaauguacacaccacucucaauguacacaccacucuacaaugaacacaccacucuacacacaauguacacaccacucucaauguacauaccacucuacaaugaacacaccacacuacacacaauguacacaccacucugcaaacaauguacacaccacucuacaaugaacacaccacucuacacgcaguguacacaccacucuacaaugaacacaccacucuacacaccauguacaugccacucuacaauuuacccaccacucuacacacaauguauacaccacucuacaaugaacaccccacucuacacaccacucuacaauguacacaccaugcuacaaugaacacaccacucuacacugaacacaccacucuacacacaauguacacaccacucuacaauguacacaccucucuacacaauguacacaccacucuacaauguacacaccacucuacacacaauguacacaccacucuacaauguacacaccacucuacacacaauguacacaccacucuacaauguacacaccacucuccacacaauguacacaccacucuacaaugcacacaccacucuccacacaauguacacaccacucuacaauguacacaccacucuacaauguacacagcacucucaauguacauaccacucucaauguacacaccacucuacacacaaugaacauaccacucuacaauguacacaccacucucaauguacacaccacucucaauguacacaccacucuacacacaaugaacacaccacucuacaauguacacaccacucugcaaacaauguacacaccacucgacaauguacacaccacucuacaaacaauguacaccccacucuacaauguacacaccacucuacaauguacacaccacucugcaaacaauguacacaccacucuacaaugaacacagcacucuacacacaauguacacaccacucuacaauguacacaccccucuacacacaauguacacaccacucuacacacaauguacacaccacucuacaauguacauaccacucuacaauguacacaccacucuccauguacauaccacucuacaaugaacacaccacucuacacacaauguacacaccacucugcaaacaauguacacaccacucuacaauguacacaccacucucaauguacguaccacucuacaauguacauaccacucuacacacaauguacacaccacucuacaaacaauguacacaccacuccacaaacaaaacaugugauguuccaggauucgcucgcccacagucagccacgcaugcaggagcaaugcugaggcugagggugcagagggagcuugacagucaguggaagaaugcgcucuacaagaggacaccacgggccuggcccgcagaggacuaugagggcaggggcuggcgagucaagcuggcuggaaaggccucucugaggaacugaggcuuaagcuaaaaaaacucugcaugacgcugggucucugagauccggaggaaggggcucccggcagcagaagugcccagggugcgggccugagguacaggagcugcggggcuccucaaacagcagaaagccuggucucauggcuaccgccccccaugagcaggaucagugccgacgaggcugcagcgagugucgggcuggccaccgcgaggggccugggacgccacugccggcagaggcuagaaggggccugaccacaccugggcguuuccaccauaagaacacaaaagcccugcgagcagagaagagagcacugcaguacagaaaucaggaaggcagaguuguaagcacugauugcauuuguuuuaaugugacuuauuuagucguaaguuuagcuaauuucguuuucauaacggcuguguuuggcaacccacuuccgcgagcgguaacagcagugccggccaccacgggcggucauggaauuggagaggaucaggcggccuugauggcguuuugguggaagcacugucacaaagggaugaugggcaggcugucgggaguuaggagaagaaaagcaaaauacauuugcuagcuucuggcuugaaugccugggcugacuggaggggccauguagugccggggagaaguggagagcaguuccaacauugcugggggacaguagugcugccucgggaucuacagcggugaggccccgaagcgccaagggcgucggcgcaggggcccccagccagucacaguucccgcuucugcaccccagggccucugaaaacugugaaguccaugcugcggucuccacgcccaguggcuuuccacgucucuccacaugacacucaccugcugcccaucacaggccgcagacacacugagaggagcccaaguggugucugaagcaggacucuccaccaggacagugccgguccugagcccagcuacagggagccgaccacagcggagccgaggacaccgauggcaggacuggcugcgcuucugaugaaugugguuugggaugcugggugagggacagagggagcgggccagggagugggcagagugagccaacgcaugggggcagcccugagccacugugcugacccagugauggccaacagcaugcuccaucacggggacccuccgcggggccucggggagcaucgcagagcugccucccugaggaaugggggcaggugcauuguggcccucguagucaggggugacccugagagcagcuuccacacacgccaggugacaugcaugaaagcccaucaggugccccugggcauccggugccaacagaggcagaggcaggugaaaggcaagaugccccugcaugaagauggucccagcacacacagagcaggccaccacaguagggacugggugggagguggggccuccaggaucugcagggggaaaggcaccagacggugagcgcccacgccccagagccagaggcccuuccacucuccaguguccuggagaccagugucccgguucaaaaguaaauacacaagcagcccucccacaggaagcugaggagagucugggcugcagacuggggagacccaggaucgggaaacuuuuguuucauuguguuuuuuaauguaaguaauuaggguauauuuagaggcucagaaaggaagccagagacaagugacaaaacuuacaaggaaaaugagaggauauucacaaugaaaggagagaugggaucaaaagcaugaaggaagcccagagacaagucgucuaaaugcauccaucagucuaccaagccaucaaauaaaauacaucccaccccacaccuagacaaucuacagucuaccuucauggcaaccuggaaggccagguucaaaguucaaaguucaaagacugcagaugguacagagaaagcguuacacagugagaaaacaggcagcuggaugagcacagagccacgguggagggggacagagccacgcuaaggaggaacacagccaugcugggggugggaggggcagaucccugcugggaguggagaacgcgccgcggcugggcccccaaguucgcggcugugcagcguggccagaaugcugagccggugcucuucccuggcauccugcacuuccuggguaaggaaggagaagccuuacagcaagggguuccaccgaggcuggggcuucgcuagugugcggggaggcagaggagcagugccggcugccagcaagugucuccgccgcgggaccugucaucccagcugguggggagaaaacgaagcuggguaaaaggggcugagagaaagcuggccaaagguugggcuuuugaaguacuagaaacuuccucuucuggggacguggcagacaagucaucuuacaggcucuugugcuguggaaaccccagguucugcauaagacauaccuucugucacacugcugggcucaccagcaguaaggaaacccuccaacaagccagaaauauauaauuaagggaaacaaaagcaacucgagcugacaggagaguugagggcagcggguggaggacugcaugggggucaggaccgaggugagcccagagcugcagcguucaggaugcaggggcuggaguccagggcagcucccaggaaaugcacguggcaugccuaucagaagaacggccuccucacucccaucccucuauuuccaaacaguaagaccagcgagacauacgcucccaagcaaacacaagccaacacagaaagaagugaaaaaaggcagcaaacacaucaaaagacagucaaguucuucaguuacucauaucaugagaaaugguacgauuacuguuucugaaacuuucaaagaaucucuuaaugcuuuauucacuaucauuuuccccauguauguuuugauuaaauaaaaaguuuaugaaaauacuugaaaaauuuuaaguaaugaaucagaggaagcaacagaauugucaaaauuaaucauuuuaggaaaagaacaaaguagacuuucaaaaauaauaaguguaauugaugcauuuuaaaaaaaagaaaacccucaaugaaugauuuaagcaauaaaugccaugcaaaaauaaaaaggagauucggugagugagaagauccugacgaagaaaucagcugagcagagggaaucaaaauacaaaaaugaaggagagcccaaauccuguauuuuguauucugaaaguaaaaguccaaggagaguugaaaacccauaagagccaccugaggaggugugacagcugacucugcaggacugggaaggaagggaaggaagggaaggaaggaagacuauggagcaauauuuaaaggggcacuagcugcggauuuccaggacugauaaaacacacaaacucacagacacaaaggcaaacauaugccaagacaacagggugcuccacacccaaacacacccugacaaaacugggagcaucaaggacaaaagaagaugugacgagcagccagugagacacagacagacaaggaaggagcggcugcuaugcugagguaggccggccaaggaugagaagaauacaccaaacgugaugaaaggagaaaaagaaaacucaccuccaaguuuugccuaacagucacucaggcauguuggugaaauagagacauuuucagaucagacacacauacacacgcaaggacuguaucaccaacaggucuacuaaagcuacuccuaagggguauguguucauaaagaaaagagaaagugaccccagcaggagagugucugaugcaagcaggaaggacaagugcacagggaguuggacacuggccugggcagggaauguccuggggaccucucggacaauacgaggcauuugaucacgucuauaccaggauggggcaugcgucacacuucgugagcccacagugauccaucagcaugaacugcagccgugccuggauuuccuguuuucccugugguccuccuguucugagaccccacccaggaccccacuguccuuccuuuauccuccugacuccugaggcuccuucggcugcgacgguuucucagacuugccuuguuuuuaaugaccuugacaguuuaaaguacuugauuggguguuugcuagaaugucccuuaaucagaauuuguuugaugucaugaccagaugggguuguauguuuuugggaggaaggucacagagaccaaguggcaccuccuuacaucaucucaaagguguacuguugacacgaccuuuuaaaaacuugggauggaaaugaaaaugcuaagugucaaaacuuguuguaugcacccaaugccuacuucaagggaacuguguagcuuauaacagaaggaaggcuaagaacuaaugggagcugcacauccaaccucgggagagagagaacacugggugcagccagccacagaaaguaccaggaagauaagagcaggcauuuaaaacacagaaagcugacuuacaacuaagggaauccacaaagccagagugacucaaaacgauuaauacagauuaaucaagaagaagacuaagucauguuguaaaugaaaacggguacacagagacaaauccagcaaagauguaaacaccagaagcaaaucuaugacaauaaaauugaaaacguagauuaaguaggacuccuaaaaacuuucuuuuaaauccauaugacaggaauuaaaaguucagguuaucaguaaccauuaaagauguuaaaucaguaguuaaaacaucaaaccaccaaggaaauaugaaccccaaauagucugagguuaauuuuuacaaacuuucaaggaauaauuaauucuaaucuuaaauaaacuaucccuguaaguuaaaaaaaaaaaagaccuuaaaaaaggaaaauuaccguccacuccaauucaagaacagagaugaagaauccugaagcgcuagcaaaguaugaaaaugacaagauuuaucacaaacaagcugaauccacuggaagagauaagggaaguuuaacagaaaauuagaacagaaaacuauacgaucaucacaacagacggaguaaaagcauuuggcuaauggaacacagcuauccaugaacuuaacuugaaaaagggaaucuaaaauaaccuaugucaaacaucauacuuaaauugggaaaaauguuaaaaaucuucucuuuaaugucaaggacgacagaaggaaguccaguauuucugcucuuacucaaaacugaacuggaauucccagcuagcacaguaagacaaggaaaauaaacacaggaauuggagaggaagacacuaaacuagcaucguuacuuuaacagucuuugucuuagaaacccugaagaauuuacagaaaaaaauuuuuagaaauuauaagauuuuaauaagaugauuggauauaaaaauaaaauauaaaaaucaacugcaauuccaaaaacuagcaagggaaaacuuaauuaaaaaaaaaacguauugucugcaacagaaaaacaaaacaacuacaaucuaccaaagaauaaagaauaaaucuaacuugacacguacaagaccuuuauagagaaaauuauaaaaaucuauugaaaaaagacaguaaagaagaccugauggagggaaagagaagccacacacacaaauauacugucaggaugccaacccugccuucaaauucauccauagagucaaugcaauuccaaucaaguuucaggcuaggcuuuuuaaaggaacuugucucuagacaagucacagcuuaggaggagcugggacaauugcagggagggggcugagacaggggagugcggcugcagcgccugucaaggagacagugcccugcuggccccaggacaggcucuggagcagcugagcacagggaggguccaaaacagauugaacuuggaggaugagcuggccgcacagcuaucccagagaaaggguguaaagugucaaacauuaugguucucaaaaugagaaaagaaaaugaaacugauccccacccugcaccccacacaaaaaccaaaggcuuaaguaugaaagacaaaacgucaaaggccuuaagagaaaauauacaagguuaucuuuauggccuugagguagggaagguuuuuuggugguuguuuuguuuuuaaaugaaauacgaaaaagcacuaaccacaaaagaaaaggucuguguuuugucuuagucgaggugucauuuaagaacuguuuuugcauauaacuuuucuuauguuacaauauguguguguguuuccagaucaaggaagucgaguaaaacacuucuaaguaacauuuuuuccuucuucacucacuaaaccuuuacugaacuccaacuaagugcccagcaccaggccaauaaagaauaaaaagacaggaggagcagaggucuuuucuucuggaaauccaggcuggggagagagcacacaucacagggcaggagcagcagccccucagccacuguguugggcacgcagggccccucccagccaccuggcucaucugaugugggagcccacggagagcagagagcaccccccaaaguccccgccugauggggcaccagagcucugcccgcugccugauccugcccaaacucugagaaugccccugguuauaacccuccguuucccuacuguacacacuggugcacaaaucugcauaaacccucacuucauaaucauccuucaaauuacaccuaaccuuauccucuugaugguucaccacuuccuaaauuuuaaaacagcaucgugaucuuuacucaccauuuuugaguuaaggaaaacaaaugagagaauaaaauuaacaaaguucuaucaacuacagaaaagaucuuauuuucuaauccaauuacggcaaauaaaaaaggcaucaagaguuaauauaaauguacacuccauugaaauggcuuaaucaaaagacacaacauuaaccaggaaaaauucacucaagucuugucauucaaacuuaaaauauaucaacauuuuuacuaaauuuauuuuuuuucaaaugugcacuaacauuuuccauguuaucagacuuuacucuuaccuaguucccugucagcugagcuaauuccuuaacuauaaagaaacagagcacccuaaggccaggcuguggggacacccagaaccaacggcacgugacaugaagcaccagcgacauggggacaccagcaccaauggcgugaggauguccagcaccaaugaguggcccauuuuauguggcugaaggacaccuucuguguggacuagggagaauaugguaaaacuggagacccuaggagucuuccauaucaccccaagagaguuuuggagagaaaggggauuuagagugucaaucuuuagaaaaaucaaacaggcagggcaagcuccugaaaugggaguaggcacacacacacacacacacaggcacgugcgcacaagcagucacguacacacauguacgcacacacaaccacacaugcgcgcacgcaugcauucaguucgcacgcgcaugcacacacacgcacgcacacacucacauacgcacucacguacgcacacacgcgcacgcacucacacacacaccacacacgcucccguguuuaguguguuucuagggcacuauggggagggccgggguucuauacagggccuggcccaccugaaaguccaugugaaaggcagccuccagggcuccuaucaaguggguggcuucgcucauucacucaggaauuuuucguggcacaguaaggcaagggguggggauuuuucuuuaaaagcuuuauccaaucaugacuaauggaauaagugagccaggccucaagaaaaccgaggacaaaaggaaagagccguucagaaggcagcgccugccuccaccugcuggugcgugcccgggacagggaggacggcagguuuuaccaagcacuuucaaacagaaauccaaguucccaacaaagaaaaccccaaauacaauagucccugggguccuuguucagcccccuuuugacugggacgcugccgucgagugccaggggguguuaugacaaaacugaaaagcauggcggguaagaacguuccaaggcauggcucgccugccagggcuggcccgggcuggccagggccaagugcacacggggaugggccuugccaggccagcugcgacaccacaggcuugcugaaaauagccgguguuuguuuacauggccugggcugagagccugaucgcccucaaagagggguccccuggguggcggggggccugagggcacacaggaagagcugcagugggauuuucaaagaaacgucaucaucuagagacccuggagcucuggaaagcaggaaggccgcuaggucgccccucuggaacuuugguuuucaugggugucaaugcgcagcaacccacgguagggcccgaagccagccugcugcucaggccuggagaaugaaaacagcuuuaaaagacaaccuacaauuaacacagggacaauuaucuuccuaauuuagguuaauuucuacuuacagcccuagcuggcaggucgggggaagggcaauaucuauguaagagcuucuuauuugguucuucuaaguccacacagauaucauaaagaagauuuccaguguccaccaucgccuucuagaaaaggggccuaagcucaagagucccagcuagcugggccuucuccccgggagccgccgauuacauuugcaugaaaauagaaccuuuguuugcaagaguucccgcuccaguggaucccuccuuugucugcagcacagcaacugauggggcaggaugcuggugugugcacacagcccagcucaggacagccacgccaggggcugcgcgcacggcccagcucggcccagcucagcccagcucagggcggccacaccaggggcugcgcgcacagcccagcucaggacggccacgccaggggcugugcuugcccaucguggcaaggcaggcaaggggacggccaggaugguagguggggccccaaguguuccgguguuuugucaguguggcuggggacucccagccgggcaggugcugcaaugcgcuggcucccagagcaccugcagaagcagucccaggggacccugaggucaccuucaccugguacggcagaagacaagaugcccucacucacugcucucugcguucgaggauaaaccccuuucuagcacuggcuguuuguuagaugugugacagaaagacccuggagagcuucugcacugagaugggcaguggaggcugagccccgcuguccaucuggagcacagagccaaacaaaucugaagggcuggcagugaccccaccacuccagcgagaaaccaguaccccugugggcauacuuggcagggcccagaaaauacagacccaccaacccacaucuaaaaugcaucucuuuacuuccagaaaagcaagucaauauauccuaucugggaacucgagccaaguaaugggucaggucaaauaaggcaugauccagugucaugaacuagcagacuaaggcgggaggcugggucgagaggauacuguuucuuuuuuguuucuuuguuuggaaggggggugauggaaguucauuaccagaagccaaggaggcucucuuucaccaggucucucacguggaccuagaccguccuuuuaauacccaaacagaaauuacaagagacuaaaagcuggguggaaacagguaugcaacagcacuaagagcaaaaccuugcucaggccuuucagugggaaaaagaacauuuccgauuugaaguuaucacucaauaaauagcaagcuccauuagauacaguuuuacuuaaaaaaauaacagcugaaugucccuauagacaugaaaugagaccacccaccuggccuucagguucaggugugaggccagcggccagcucccagguagcccagaaucccuuggaaaugacuuuccuucccagguaccugcuccagcugggucaguccucacaaggcguuucccaaagggcaucccgugaggaauuuguguccaugggauacaaauucccugaaauaauaaacuggacaagucucuucucgacagaucccagcuggcuucucuacucgggagcuucccagagcuugaauguagcaguugccuucugaauuucucugagcuucccccaaagggguuugaccagggccuguccccugcccucgguuuuuauggugaauaacugcaaacaccuugcaaaaccgcagggucccagaaaacccuauuugagaagggcccuacccuccacaaucaaagggggauacaaucuaccccagcaggggcggaacauuaacaagggcggagagcagcaaaggagcgugggagaaaggucacauucuugcuaccaugagguaguuaaggggucaagagccaggcagaagcugagagcaggagcccgaggcccaccugcuuauggacacagggauccccagaccaacgcacagggcaccuccaggcuuccugcaguggcuacgcacagggcaucucugggcucucuccagcugaugcgcuucuagcugcugugccuggccacgugguuuuccuguuuuggguccacugcacccuauacugggaggcuaaccuguaucaccuggacauacaguuuacgugcucccaaaauaccugcacucagcggauggcauaaaaaccugacggcgagaacgccagccuccuuccuccuuacaaaaccuuucuagugggaaaacauuuaacaaguauuugcuaagcaccuguuagggcccuagaacucuaaaaguaacaggaggacuuuaaaucauccacuugcaauuuacuaacuugccauuuguuaauuuaacagagacauuucuagagagaacugggccacacaaauacccgcccaucgucucccagcccacccucugcugccuaugggaggaagagcagcucauucucacagguugggcagaaagcucauggaugcuccgugcagugcagggucgcugaggcgucacauuuacgcuaaaacagaagugccccaugauccaccucuaucaacucccagugacucagacaaggaccgcaaucaccaggcaggggcagccccuucugaaccugggcacagaacacucagggaagcuguucgccgugaggacguggacacugggagcuccugaugggccuuggcagaggccugacugaucagaucugcacuuuggaaagguucugaaagcuguggauaggcugauagggagucuggagccuaccuggcucccagggcagagaugaaaaaaaagagaaagagacugcaaggaggucgcgccacuguguuucagaaacuaaguccccguugaagguggaaaggagggaagagcucuguuagaccuaggcuucugaguagguggggcucucucuuucugggaagggacaacaguagugggaacagcuggggcacacacagauguauuugugggcaccccagaauuccucauggcugaggcucaggauagcaagcagagcuggcuccagaacagggaguuggaaggaaggggagcaggugggccugccucggaggccucggaggcagcacagcccacccaggccaggagcucagcgucucagcuuccucaucuguaaaauggggcgaugccacuccucccucagggucaugugagcaccauccaggucaggacugugcgcucucaggacaggacagagggccacagaagcuaggccucugcucugacuaagggggugggugugugggaggcccgggagagacuguccaacggcuucgggacaacgcccgucugauaagacuuuuagugcuagggaacagcugcuaaggguuuuuuaauaaugugaaaagaugauuauaggccgggcgcgguggcucacgccuguaaucccagcacuuugggaggccgaggcgggcggaucacgaggucaggagaucgagaccaucccggcuauaacggugaaaccccgucucuacuaaaaauacaaaaaauuagccaggcguaguggcgggcgccuguagucccagcuacuugggaggcugaggcaggagaauggcgugaacccgggaggcggagcuugcagugagccgagaucgcgccccugcacuccagccugggugacagagcaagacuccgucucaaaaaaaaaaaaaaaaaaaaaaaaaaagaugauuauaguaaacuggcaagggugaaaagcaaaagagcagauuuuuauucauccaaaagcugguuacauaaaaaccaacgagaaugagacaagaugggagccggaaggaaacacaugaaaauguucacagcugaacccagggugacaggacuaggagucagagacucucuccuucauacgccuuuguccuuucuaaaacuucccagagcaaacagguccucccuuaucauuagaaaggagaacaaugcacccugguuuguuaaaggagaaagcucuuggcauucucacuuuguaauuugcuguuuccuuucaagcucagccucugggaggcuuuucauucuguuuugugucucguuuaccauucccguucaguuucauuuuauuucuuaaauggacauccucaccaaaaccaccaccaccaacaaaaucacuaccaaugacuuuugcacaaacagaccaaagaagugggccaccugugugaguucuagggcagcugucucuccaaaccacaucacaagugcccccagagcccuucauugucuuucucagccucuucacugcucugucaccaacucacacuucauuugcaacagcuucuuacagggugcugaaggaagagccaguaauuagagcuaccaggcaaugggcgcaucuacagagggacucuucaucuucacagaagcagcagagagcugaggaugcuaucacgcccauuuuacaugaggacacugaggcacaaagaggcucagggaugguccaaaguuaauccagcaagaaaaggggagcaccaaacuggagccugcacaggcugaccuggagccguguccuugagcacucugcuuguucaaucagaaagccaccacucucaaagcacacacacacacgcacauaugcagguaugcacacaugcacgcacacagaggaugugcuuagcuguaugugugcccugggcguggacaccagcacucugcccagaaggaggccaauacccgccuggaccagggucucugcagacaguggcacagggcggucauggccaguccugcagcgcccuggcccagcugguuuucugguuuuuccccauuucacuggcuacaauggcuccuuuuucagaugcaggcagccagcugagugcugacacucuaauucuaaaggucaccccgugacauuuccugcagccucaacuaccuuccaaggccucagcagaucagggucacaaugcuggccggcauuuaagagaaacugcgcuguuuucuuuuuuaggacuucgcauuuaucuaaucauuucuggaucuuuuuccuugaaaauaagucacuaaauaacaaaccgaggcagcacugcuuaaauguguccccagacagggaugaaauggggugccuguccacugucgggccccggagcugugcuucagucaggucaagggagcaugggaaccaggacuuucaccuccgcccgggagauucuucggggcagauauauuuagaaagcguggauuaaugauuaaugauuaaacucacucaccaggucugucaaaaguggacaguccuggagccauuugcccuaauuucccucaacauucaauauuugauuguccccgccaaagaagugaucagcucuccagauggcuccaaaagauguucguggggcugcagggaacaaauaaaacucccauuucuguuuguuuucauguaaaaaaaaaaaaaaaaaaaaaggaauuaagucuuaugcugcuuccuacaagggcuggccuaugcauccuugggucaggggcacggguggcuccccagaagccucuggaccccaugugcugcucuuuguaagcucugacagaaguggagacugaagacaaggcaaucacaaaggugccugagcccccaaccuucccacgagcagccagcgcucacccaaaccuuggccgcaggaugaggcaggcccacagcucugucagacagcaacccagggucucugaaguggacuucgcuccagaaagggucccaugcugucccagagagcagcgauccgugccaccaaccugugggcaagccacaaagguccccgcuagaagaugggacccagagcuuugcauugccauuuaacucagacacuggugugacagcauaggguugagacgggguugcagaggucaaguccagacucugcggcucccuggcugcccggcuaugagcuacuguggagcggugcugugcugcgguuuccuuaacggagggaauccaaagcaggacaugagaacgccugugcaucaccuguggucacugcuggcuaaugaggccuggggaugccaggccccaaugguagcgcccaucacagugccaaggacuugccucgggauugcaccacgcugucaccaugagccccauccccucagcacccucugggcucagccccaccugacacagggcugugccacaacgaaggccacaaaugcaaaaagaaaaucuuagaaagacuauguuuaucacuuuagaacuuuugagaaaauugagaccuugaaagugaaagugaacuuucaaaacagaaagguaaauaguguucuuagaauucaagcggcaacaugugccucuuccacagggcccccaagucaaaucauuauucccggugccgcggcugcuaagugccucugucccuacauggccaccacuacugaugcugagaugagaagacaccaaaaaaaggcaggaauuagcacaauauugaagagauaccugugugucaugggucuuuaggguugcuaaaauauuucacaggauaaaaaaaauuaauggacuaaaacauaaacaagaaauuccaaaccaaauaauucuccucaccaaacauuugcugacagcaagcucagggaacagcagaggcccgucucgguauuccggaagcagccagaccuaagaucaaauccaggcuugacgacagacugggcuggugcccuggacaagcgguggcuuccagaagcugggggagccccugggcaucacguggagaugagagaagaugcuuccagaaccugacacacaguagggauccggaaucgccagagcucuugcaccucagagggaaacaggguauccugaaguucaagugcaugcacaccguggauacucuagggucccagcaaccccagcuauuacaaucacacugucacugggugaacgcugugcacucuacaggggccuccucauuuagucaucauagccacuggggaugcaggugccccugcagccucauuccacccacauccggugcacagcacacacaggaucagcagugauaggaacagccugccacucuuuacagagccgugagacuguggcuaaaucauuuauccagcacccaacaacguggaaaucaugacacuccaccuacaggggcuaggcuagaaaggcauuuaaucaaacauuuuagaaugauuuucauuuaauuaucucucggagacuuaacugugucauaugaugaacaacauuauuuccuccuaaauguacugaauccggaagcaacccuucauggccauagccuauuuuuuuuuuuuuuuuuuuuuuuuugagaugcagucacucugucgcccaggcuggagugcgguggcgccaucucggcucacugcaagcuccgccucccggguucaugccauucuccugccucagccucccgaguagcugggacuacaggugcccgccaccacgcccagcuaauuuuuuguauuuuuaguagagacgggguuucauguuagccaggauggucucgaucuccugaccucgugauccgccugccuuggccucccaaagugcugggauuacaggcauaagcuauugcacccggccugucauagccuaccuuauuccaaauauccaaaaccuggaacugggggcagccugccaccaugaauauccucucaaugucaacacauccacugccaacaucagagugaaaaugccucaugauugguccauccuguacaauagguuuauuuguuuuguuucaaaugccaaguagagauauuuaaguacagggacagagcguggugcaaugaucaggacggaggugccuaacaaucccaauaaaaugcugacaugggcuaaucucaagcagauauucugauccccucgcacaaccacggcacuggggugccgaaaccagaagagacaugcacacgaggcagggcgagugguguuuauuacagcuguacaacuguacaacgggagggcagcgacacgugcuuauuuguauuaauguuuaacagacuaagggccaacauuugcuuacuggcuaagugauuuucaauaggaugcacugaaacaaaagccaauuccuugagugagaagcgucauggguagaaucacggagcaagguccugcccaccugcacugguggccucccagcagcucucauagacccuggacccagcacaguccagcuggggcccagggacuggcacagcuguuccgcucugcucccggcaugucacaggggaggcacacaccagacgaaccaaaccagcaacagagcggagagccugcagggacgcagcuggggacuaagcagaugggagaccggcaguccuggggcucgggagacaggggagacagagaaggaagaggggucccaucagaggacucccugcagugcuccaugaauuucucccgaauuccauccguaagugccuuucaauccaugccacugagggcauuucugcuccuugugacuaagugaacuccucuagggcgucccucucucuaacacagaacuucucuuccagucuccucaacaaccuugggaaggagcauaaauucagcaacacacugaugcuggcccaggcugugcgcugugaaccuacucccauuccaguacaagcauccccucuuuuuaccccaacugggaaauucaaacagaugaagccucauccauucaaaucacugauaaaggaugauccucaaacucucagucuagagccuuccugagagugcgcuguagguagcuacuggccacaugugguuacuuaaauugaaauuuaauuuaauuuaauuugaaauccaguuccucggccacaccauccauguguugauguggcugcugacaagcucaacagucaggcaugaccaguggcugccccgaugggcauugcugcuauggaccauuuccgccaucgcagaaaguccuggaguggaggaccaaggaggccucuucuuuauaaagcccucuuuguaucccagugucuuuuccucuuuuuccaaaugagcaggaaaaaaaaaaaauucccaacugaacuugacucugcuccacccauguggaugaagccaggcugagcuucccugcagaacaggaaugaagacacagaaguggaaauagcacaccuuuguuucccggagaaccccaggagcuguaaaaacacccgaacuccccucuccgguucuuacagaauuuuuccgacugcucuuuccuucuuuauccucuuccauaauugcacgcugcgugaugggagggagaagugaaagagaagggaaagaagcucguuuuccucauuccguacaucguguccacgcagugccaggaagggcugcagagaggaacgucuucgggguccaugugggaccccucccuagggcaagggcccuuagcucugggcuucucuuuuccuggggcugcccguccagaaggacaagcccugcccccuccuccgggcuccaagagcacugcucauuccuccugcugcugcugcucagccgggucccucagccccggcggggagcaaggccuuccugcagcaaccccucaggccaagcauagccagcaccccucaugccccucauggagccagccgggcaccacccccuuacucagcggcagaaggccccuucuggaaggggguaucucccucuucccagccucugguucuaaagucggucucccaucccagccacgacgaggggcgaugguggggcguaugcagcgugggaacugacccugccgugaacauuccuccugccugcugaguccucgaucugcucucaaaguaacagcuccagggcgagagcagcagcccacagccagugaugccaggcgaggccagugaugccaggcgaggcucccacacuggcccacauuucuaaauucugcuggugcuuucuuucuuuuuuuuuuuuuuuauuuuucucucuugaaacagggucuccccucugucacccaggcuggagugcagcgguaugacauggcucacugcagccucgaccuccuagcucgaaggauccucccaccucagcuuccugaacagcugggacuacagacgcauaccaccaugcccagcuaauguuuuuaaucuuuucuguagagaggagguguuccuauguuguccagauuggucucaaacuucuggccucaagcaauccuccugccucagccucccaaagugcugggauuacaagugagagccacuguaggccuauuucuuucuuuaugaaaaaaaguaagaguaaauugugaucaaauacuacaaugcuacugcggugugauuccugaaugguaaaaaccuuaccaugcuuuguuucuccaucagaugccuugcuccucacuacugccaaggagauuacgccuaagacugaugguacaagucuuuucuuuaaaacaaacaaacaaaaaaacacaacaacaacaaaaaaaacaggcagggggugggggauucagaguccuuuacugugaggucaagaauaauuccuagccauggaaaauaaucucuaaugaugcuauaaacagacagcucaccaaaucaaucagaaaacauucucaguaucauucucagucugucaagaacagaaaaccuaacuccugcaggcuuuacugugaaaugcuuagaacucuguccugauuggagaacauggccccuugugauggacaggcaggcggcggccaaagcccagaacccagcauuagccaaaggaggcaucaagcugaagucucgggugaguucauuucaaagucaagggcaaggccacccuggcagcaaauucuucuggcuacucaaauucgaauauugcagaacuagcacuagaguugccaagcuauaaaacacgagcagagagaggaggcccuuccacaggaauccagauuagcaaaaccccuugcucucuucaucaaaacucagauaaguuagcugaaaaccuggggacggaacagcuucccccaggaaggagaauccacguggggccaugaccaagcacuccaaacacugcagcgggcgcugccccucuuccagcgacacagugggagcagcccagccauccagugacuuuuuguggacauggcccagccccucaacccucgagccaggacccaguccaagagcacagcacccuccacucucccugggccugagcauggcaccaaugugcuucacgcagagcguuucgugggcgcaccccugcaggaagaaccaucgcugcucaaggcagucaucuaagaacugcucacucuugagaagggcaggucaucuuacuccuccccaaaagagucucucaaguuaggcucucacccauaggagggacuugcugggcgugcggggaauggcauuguggugacagccccaagcagggggccacacaggcucaggcccggagcaccuuggcagggagaggaaaggugugggcacugccugggcacucugcaugcugggcugggcgucaccccugccaccucgggaguccucaaaccccccccgggugggagaggucaucaccuccgcguacugaacagaagcccagcucaggguucagggugggccccuggauucaaaguggcaacagagccugacuccagccucagggcgugaggcaccuggcccuggccuguucccaucccacacccggcugcucaggccuggggacaggagggcacagggacaggccuggaggacaaggucccuggaauccccgacagcuugacaaugugaaauaaguuucgcuuccuuuuuaucuacgcucccggauugacuuguccuccucugaugccugguuccucugccaucaagacccgccgucuggugugaagggaaacgucccucacccuucugcagucgccaccgagcacucgugguguggcccacagggcauccugcgagagcgucacaagcaccccacgaacaagacacggcagcgugcuuccucgaucuccccgcuccuuucucgggacagccuguggcuuguucucccuuaagaauccucucaucaauguuacguugucagcuuucucuguuuucuuucuuucuuuuuuuuuuuuaauucacaauugaggaaaccaacagguugagcugcugccucaaguaaaaaauucaagucagcccugaugcuguccauguuuuuuguaaaacuugcucacuuguaaacaacgucgggcagcaacugcaggccucaccccucacucuucaaaagcgacugcgacagcugcaucccccgugcucaacugcagggcgcggcacucgccuaugcucucaugaagccccgugccaagggcuucuccgggaccccagauacccaccagacccuacaggccugccccguggcccugggaaugcuuggcaccaaggucccacuucccaccucagucaagcaccugccucccaggccucaccagucuucaucucagcccgccagguccucucgagccccuggagugcccugugagccacagcuuauaaagcagauaggaccagcucugcaucagaccccugugugcaggcccagcuccccgacccguaagcaguugaccucagaccagcugcuuaaccucucugagucagcuuucuuaccuauaaaugaggauaaaagcaggauauucacaaagcccagagcuagaaugccucaagcagugugagcucggggaagaaguccacacaggacacaaagcccagagcugggaaggccucaagcagugugagcucgggggaaggaguccacacaggagcaguaccuguugcaauauuuuuauuacaugcugggaagauuaaaugagauaagccguguaaacaccaggcacauagaaagcaugaaaugauaccaggugguggcaugguguuacuuucauuauuaauaauuugaaaaagcagauuaacagcucaggcccugcugaacucagagcccccaugaggauagaggcuauaacguaacagacaugaaacguccugaaagcuccacgugcaaagugaguugcuuaugccugcguaaacuucuuguucuucaaaagauaugcuguuuuuaaaagggacugacuggugaaaaaaccucacacacaaggcagugccccuuugccagguccuguaaacacuaccguguccugcccucggcuccuggggucaggagcucucaacgaaggugugacccuugugcccagcgugcagacuccagggguaacugcuugcuucugaaucuccuuaauggagcuuaggaaugacacgcuauggacgcugacuguccaagcagaaacaaggcccccuugggggcuuucuaaaguuaguaaauacauguauauauaauauauauacacacacauaggagaacgcgaaugacugggcacccagggucucuguggggagccacauggcccagcagagaacacaguuagcaucacagaguccagccguccccuccccacgucaauaggacagucccgcgcuuucuuccagccggccuggggcaugucaggaggcagggccuguacugcaggcucuguguucuuagacagccuuugcagggggcagaggugcccacugccacaugggcacacacaggaggcucaccacguuucuucaaaugcagaugacaaagcagcuugaguaacacaaauacggccacacucaucugaggauugcugcuguguuuucuaacugcauggccaugaccaagcagucgguuuucauccagguugguagucagguuucugaaagcgauggcagucgccucagggcugacacggggagucugcuuggcacaccuucacccucguuacauuuucuggacaaugguagggaacauuccuuacuccgcuggccugucagcuuggcuaagccuggugcaaguggcucgcuguggguccgcggcuccauuacgggggagucugggucaucugugagcccaacagcgcccugcaggcacagacagcccuggcuucugccucuuucuuuguggaagccacucugucaggccugggauggaggggcaagaggcuuucaaauuuuuccuuauuguuguauauuuuuuaaaaaacuauuuauuuuaauggugaaauaaguucuaaaaguuucuggacuuguagguaaaugaauaagaacugagugugguuuuuaaucauguucacauuauuggugacggugcggcuuaguuucauuuagugacuaaauucuagccaucccuagacugauggccacgaaacguguauuucgaguugaaauacauuuauuuaacacacaugcacacacaauuacacgugcacacaggaagcuuuagcaaguacuucucugaccccauucccuaaacacgacugggaacgaggcugccgcugcccacacgggcccugaaucugacagcauucaaggagaccacggaggaaccgugacaaagagcugguagccaccggcauuucagaugaaugcagcacccugggcaagcacagugucugcgucucccccacgcugaaaugauuccuaguguccuagacugccuggcuucacaugagaaacacucugcuuaaguaacuacuucaucacucaaggucccaaagaaugcugcccaccucggucagccuugcuucuagaaaccgaggauucuggguuuggaggcaccccagcucuucccugggaagucauuuuccugaauagaucugacuuccacuuauuuuccuaucauuucccaucuuuucauacauuuagaaggcaaaaaaaguucaucuuucuagugauuccaggagcucccuggcccauccacaggugggugagcucccacccagguccagcaagucagugacuacaacagaggacacagccuuccaguggacacgaggaccucagaggccaccuggccaggccccauccacggaugugucccugcccaggugccagcaaggacugacuaauaccugacccagggccaagcuauccugugucccauacucggcccguagagccaucaaaucaucugggccccgacacacuuguuucguaccuuucccggucaugauacaaaacauaagcuggaaagggugcucuucaccuaaacaaggucaaacacaggcacuacaucaggcaccccauguucccccuauaugccccccacacugcccaggugauggcagaacccagguccucgggcgcagagcauccagggcccagggcccacaggguuuuacauggugaaaagggguagggggugaaugcuaaggggcgaaggcaggaccccaccccagccaacaaccgggagacccuggccugguuucccacacacccccgaggagccagacaggaucgagagaaccuucuggaaggagcugcagggaugcaugggggcguucaggaauguccaaggagggccugagccucccgugugcaccuccccaagggcgccugcacccugggcccaggguaacccagaagcagcaggagccgcaggaccauaggggccaccggcagggugggugaugccauccuucccacucucgcccuccggccuucauucagcacucuggugagcccagaggcccgagucguccggauggcccaucucaggccacacccuccagcucugugccugccguccauccugggugcccacgaggggucuggaaacccugacagggagggagaagagagcccugggcacaaagcccagggccuggggcaggcuccgugccccaauggucauccucagaugagugggggcugugcucaggacccucaggggaccaugggcuacuuucagaaacaagaggguguucuguuuagaagcagagagccgaggagccggaggccccaacacaagagcggcucuccgugaugcccagaggcggccacugggccccaggagagaggggcuugaaggauggguaccccaagcugucaaaagaccaaguggcuacaaaagggaaccccccucccaccacuaaucagggaccugccagagauacgagggcccaguggucacuaaggcccaucucugcagcuccguccucucaccuagauaaagugagugucugcuuccuggaccucgcagacucaccagggacccuaaacuugguuuuccaaauagccaaacgacaacuccugcucaagaaaacgcaugcaagagaagcccuccucacucagaugacguucucaugaccgcacuuggucuaagcaaaugcugcugggaugauuuucuucaaguucucuuuuagaacaagcaaaauggaaugaggaugucggaguguuucgugcuuucuuuccagaggguuucccagccugaaacgccaccccacagccacuguggauuuggggacugucacacacgucuccacgcaccccgagccacaucacguuuugccacuaucucagaauuccugaucuccaccugaaaacggaacacaaggcccggcagcaacagccagcaaaguguccccaucccccccaaagugagcggccacacagcaaugaguggccacacagcaacgagcugcgaggagccaaggauggcccaucccacccccaacggugagagccgggcccaucacaagcccucucugggccuugucacucacccuuccuacaccccaucacucacccucccugggccccagcuuccucaucugugagauggggguggucagcgugcaggaagcccuccuugacgaugagcuaucagcuuagggacaagagagcuagagacccgggggggaguccacugccuuggggacacgagggagccagggucacuuucuuccucaucaagcuggcccccuggugacacgggacaagaggauaaccugcuugguacucagcaacaggcuuuccuaauaagaauuccacacuuccaugaggcuguaaucaacuugggagugaggaguuccuuagcuuccuguuuucagagagucuucuuagcaaagugaggaaucugcagaucucucugaaagaucagcuaccaaaggaaaauaacaauaaugaagauaucguugguggaauacauaaccuccauccacagccagauacugcuuccggaaccacacuucguauccaggugagcucguuuuuuguauuucaaaagcacaaagaucuauguucaugguguaguccaggcagagugugguuaacaggccuccgggugucccccccuuccagcccagugcagggguucagccgcugcagaaacuccgaaucugcuaacgugaagugccaagacugcuguccgccagcgcccucacucccccagggccuguaccuguagcaggaggcucacguuccgaguccucauugcucccagacccaagggcaaggcugucacaggcgaaagacggguuccccuuccucuacacccaagcccucggaagcacgcugcaggccccuggaggugccacagugcucccagcucccccagaggcugaguucaaacauucuaaacggauucuugauaacaagccgccggcucgcuggaagacacugagcaguuacauaacagcacagaaaaucccuuacaaguuucuuaaaaaagaguuaaucguacugacuuggugcuuuaccuucagcccagacuuucgcuuaaucccggaaacugcuccaaaggcguuuuucucagggcguucggcgccguaacucaggagaaacccaaguccugcucucccggcggccucgcuggggaagaauucagccgcuccacccugacaucugguuucuauuucauauccauguugucacauuacauaacaagcagaugauacgagagaucaccacaguguuucggcucgagagucacaaagaacgcccagaacacuguuuauauugggggccaugaacguucaccaaaccagacuuagugcagaggcugcacccuuccaggcugaaacccagcaccuacagcaaaugcccaaggaagcaagaagcgggaccccgccuucucagccaccucucacuaacacucagcuccacuccugcuuccuuccucucacuccacauccgaguuagagggaaauacgauuuaucucuggccugcauuuacuucuccugcaccuggcgggaggcucuggccuugcaggcgugcaggagccccugccagugagggccagcgaggggcccagggagaagauggaggucaagucauagggccuccaccgcaggcagagcuccgccagcaaguauccugggagcuggggggccucaagggaggcaauccccccacacaccauccccuuccccuucgcucaucuggggaagcugugaggacugguguugauaaaacauuccaaccacacacucagaccauggauguggccgugccagcagggaggccagcagccccuagcagaaggguguucuggaagcugcccccucccaugcugcugccuggucccauggggcaugaagggaggguggccaggguggcccgagccagcaucaggcacaaggcccaaggaguuucuccagagcagccuguccucuucgguccagaaaaagucagauuccacagcaggguuagccguccaguuagggaacccacuaaggggcucugugcguagaggugcucagaaucaaaccacuaaaccccaggacccccugcugggggaaugguccguggcagucauucagccuuggagugaaccguucugcccaagugcaagugagaacacaauacuucuuauuauauacagaauugccaaagccaacgugauuaguagaaaaaccgacaugucagugacuugggggucugguuugccccagauguggguggaaaccccaggcgucccucaagccugguccagagcuccacagacagcagauacacaaacucugagugacagcauugguguuuagcagauucuggauuuugcucccccccgaaccaaguauagagaauguuucacagaguagcuucaacagaaaauggccacagugugucugugagagagugugauguucccggggggauggcuggggccaagggaaggccccucccaugagcccugccuccaugagacugcguagggcaggacugccaggcagaaagaacacagcacaggcacaagggcagacccaggcuggcagggcuaaauggcuucaggagcuccccccucugccccccagggaguaaaggcaaugaugcaaauaugauaagcaaacagaggucccaaaacacagaaagggccaggacccugaugccaaccaagcagacccaaaacugggucugggagcacagggcagggucgcugagugcagaggggccucacucaauguccaacacuucccuccaaaacagacaugcuggugagaggcuucaacccuuccacuggccugacaccuggaucucugcugcccugugccagguuagccacguccaacaccaccacggccaccggccauuuaagaaaacgaacccugacguuaaccugcuugagcccuaauacuaagcaagagcagcgccacaauuccaaaacugcagagagcgccuuuuaaacauucugcugagaucugcgcggucgcggucugacaggcaggccuucuuggcuaccugugguuucauuccagcauuaacaggcaccuaaaaggccugugagcuuuuguggggucaagcagcaucagcuccacuuuacaaccccgcagagugagguguuagcucugcagcuccagggcagagccuugcagccuuagggccagggggacggccuggccccuuccgagcucucagcagccugaacuccacguguccccugcugugucacuggcaugcuggucuugcauggcacugagauguguggcacaagcaggcaccaagcccggagacacccgacgcucaccguuagacuggguagcauuugucaagcgccgagcaaacaguggaugaaguguccucagccggcgucagcuguucugauccgcagaacacauaacuccuggcacuccuuuccaagcauccgggaaauguagaauccaaguguuacaccauccaguugaagaugacagauuuacgauauaaaacggcacccgcgacugaggacuuuguaggaauggaggccgcugucauuauuucaugggugagggggagagggacacugugacccaugacaggaaaggacagcucagccccuccaaaaccacacacaggggacuccguuucucacaaaacuucaaguuucuguucuacgcaaacauuacaacacauuuuaaacuacauucugacacgaagcucccgugcuuuuuaauggcagguguuacaaugaucauggaacagugauggggcggugcuuccucacggugacauggcagggagaagucuggaccggagccagcaggguccuugaccuaagaggccuugggcagcccacggggcagcucugagcaaucuccugugaaaggaagagcucagaacggguuccucuaaagguuccuuccagagcagggguucugugguucccuggggcccuagacuaacaugaggaaggggaaacagagaagaaugcccacuaaaagccuuacccaaaaauugaaagccaagaaaaaucacaccagaucaucucaguuuagacuugaggaaccucggcgcugacaucacugucaccaucacaaaacacuggccaccaaggugccaccuaccacacugcaaccuggaaggaggggcgggcaggggcaccccugggcagggcaggacaccaggccagccagccacccacgcuacagaggaaaugcagccccucccaacuaagagaacccugguaccaucaccacagccuuggugccagggcuccuagcaccugacagggaagaugagaaggacauuggcugccgccaagaggccugcugcccacccccaacugcacggugguggugcugccagcaccaccauccaugcuggcccaggagcccacacgcagggcacgcacgcacguaguuccacauuaggcccuuucuuccucaauuguuggaaagaaggccaaagccagaugauggugaaauucacgaggaaaauguccccgacuguccuccauucuaaagcaaacgcuaagaaugggcugcugggcuucagcagaagccaagucaccuuuccucuaugcguccaaugaaacgaaaacauccacacuugucuuuauaaaaacggaaaacugcaucuggaacaaggucuguggcguuucuuccagcgugucccauggacaugaaguuggucuuccuauggguccuccaaggcacaccccucgacugcaccacagcacugagggcagaauguggugguggcccagcugccguggcgccggcagacuagccugguacacggagaggggagccugcugacuguggguaggccacguucccccagugucuucaucugcagagggagaccgggagccucugaagaccgcuccagcucugcacugugggggcggccggccagcaggcaggcaaugcucucaggccccacgcuccucucacuggcugccgacgggaggcagacgaggugccgggggcagccugcagagcaaggagucaagguggccagccuggggcaggguguucccccagccagggagcuucacucaggcuugggcucugucccgugccuccccgggggcguuccgagguggcggaggaggaagcugcagcccguuauccaccgcccagucucucccucucaccagcacacagauguucucagcggcagagccuggcuucugccugaauucauuucauauuuuuaaauaugcucuuaauggaaagcaacaaaaguacuuaacaaaaugcgcugauguaaaugucccugcagcagccagggacuaauuuuagaaggggcuuugaggagaaacccaagggacacucacuugcuggaaacggccuccuccccaaagagugugaggaucuggauuagaaccaaguauccccaggcugcccaggagcccgcuccuccaauugggggcuggccaucccaccgagcacugauaccgcaggcuggacucuuccuaaccucacgagaggugaugaccggaaucaucccaguuuuccauggcacuucgcaaacacagcuggucaggcccuuagcaccuccugaccccccgaucucccagacucucugcuggaaguuaaggacacagagaaaguuucuuaugaaaauaagcgccucaaaagaaagccaacguacagcacuggugacagaaaggaagauucagaaaagccuucacgccuggcaauauggcacacgcacuuuuagagacgucuaauuauacucagggcugaguuggcugaagagugaggaauauacuccaaagacaggaauucaaggcagggcaaauagaacaugaaagccagccuggagcccagggccuguccuggggcagccaccugcacugccucuuaccacugcaccgucccugugagugugcguggggaggggcuguaguucccuuggcaggggaagccagaagacaggccugcaagggacacauccgggccugggcuuggugcuggcuagaaggggucaaaucgagagaggacuccccucagaacucauaaucccagaccccucgcaaugguuuggggagaauucagacaacccaugaggccugaugagcaucccuagcaccugcaaacacaggcaugucccagguggcaccucccagcaccaggcagaaaccuucucuagaggaacacgcuaugaaccucaaaaaaacauccaagaaggacggacauaaagucacaaucaagaaccauggguagcgggaguaagucccggaaagaccucaguuguaggaaaaucaggcacugacccaaaacacauacgaaggacacucgacaaaacaagagaggucauccagggucaggcuggagcuagaggccuccagauccugucacuuagugacuguacaaaccugguggcuuccucaaccucccugugccuuagcuucccauuugccaaaaagggggauuagaagagcccacacucucccuggagcaaggcuaaggaagaaaggagacagaugucucagcuguuauuauuaauaacuaucagaagugucacauggaucugaaugauccaaauggaacuuguagaaacaaaacugucaucauuaaaauuuaaaacuaaaugagugaguuaacuaaucaaguauuaauagacagagcugaagagagaauuagugaacaguaaaauagcacggaagaaauaaaccaggaugcaacacauaaagguaaagagauagaaagcuggagacguuagaggacuggaaggacagaggaagauaugcuaacacacaucuguaaaccaaaaauaaaauucuaagcucccaaccaucugaauggaccccuccucucaagccaagggcauuccaacauuaaccugaaaagcuaguucaggucgugauggggacgggcauucagaugugccucaugauacccuccucccuuuuggaauugcugauagaacagacucuuuaagucugaugagaaacauuucagucuauucucucugaagccugcuacccggaggcuucgucggcaugguaaauccuuggucuccacaaacccuuaucauaauccagacauuccuuuguguugauaauaacucuuucaaccaacugccaaucagaacauuuuaaaaucuaccuauaaucugaaagccucacacuucgaguugucccgcguuucuggacuggaccaauguucaucuuccacauacugacagacgccucaugucucccuaaaaauguaugaaaccaagcuguuccccgaccaccuugggcacauguugucagcaccucuugaggcugugucacaggcacguccuuaagcuuggcuaaacaaacuuuuuaaauugagugagaccugucucagauacuuuugguuuacacaccuguaaucagaaucccagaaagaaagaagagagaugaugggagagcaacgggcaaugccgaugcacgagcgcuagagaaacauucaaaaugaaacccagcaugcccaaccacaugcuaaaacacgccucaaagccccuacgcuucagagagcacgacagacaccaucaacccggcagaccaggugacagugagaaaguccagaaacagaaguacagacggaacuccagggcaggauaaaggugcccaucucaaccacugggacaaacagggauguuuuaauaaacaguacuggagacaauuggguugcugucugggaaaagauaacauuaaauccaaaccuaacaccauacacaaggguaaacuccaaacgaauuggggaugcaaauguaaaaaacgaaaccguacaagcacucaaagaaaacaucuucuggaagucaaggaaggcuuucuaaccaggacugaaaauccagaugcaauuuaaaaaaaacaguaaguuugauacauggaggaaaaaccuuuuacagggugaaagcagcaugagaaagaaugucaaaauacaguggacaaacugugagcaguuacuugcaauacacaugaaagacaaaggccaaaaucucuuccaucaguagaacucuuacaaacugugugaacagagaccaaaagccuaacagaaaagccaaaagcaaagacagaaaaacggcccuuacaaacugaaauauccuucaucuaccaaaucagcaaguaaguaauacacuccacuccaaagccccgugggaauaggcucgcucagacacuacuggcggaaaugcaaacugauauaaguuuccuauaggaaaucuugagaaaaaucuaauaaaaugauauaaucuacuuaucuuuugauagaaaucacuccauaaaccaacucugaagauaaaacucagauggcaggcccggugacucucaccuguaaaucccagcacucuggggggccaaggugggaagaucacuugagcccaggaguuugagaccagccugagcaacacagcaagaccccaucucuacaaaaaaauuaaagauaaaaaaauuaccuaggcaugguagcacgggccuguagucccagcuacuugggaggcugaggcaggagaacugcuugagcccacgagguggaggcuguagugagcugugauucuaccacuacccuguacaguauaccaaugggcccuagguaagagagcggcuggaugaauugcagaguguauggcuguccacaggaaugagcaggagccuguggacagacguggcgugguuuccaggacauacugcuagggaagaggaguucccuguaggacauucuuuccgugcaagaaagugggcaaaugaaagcacacaaggccacccaggaaagaaaggguagcucauggggacaggguggaaaggacaggggacagcagggguaggggacccgcuucucugagucuggcugcuacacaguucuggcuuuugaagcugcaauuggguuucacaucaucaaaaagugaaaauuaauacaaucaaaaaguacacagggggaaaaauucuaaacugaaauacaaacagaaacaaauaaccaaaccccauuucagaugaguaacaaccacgcuggggcaggguggggugugcguaagagcuugccaaaguggcuuuuagacccgguaucuggaccauacgccuucagcgacugcuggacucuaguuggggguuucuuuuucacagaggcauagguuaauaaucucugaguauucugggauugagacugaacaaauaaguaaguacaugauggauucugagagcuccacgucuccuugucagcagagggaguaacaaaugugaaaggagaaggccagccgguggccuuugugaggcugggcuggaagugaacugccauguguguggguggggccggcgugugugggugcaggggccgaucuacacacaucuauucacagcucuggcggccgagagcugguuucuaaauagcauuccccgagaaaggaaccaggccgccuugagaaaaagcugauuccaggccaggacaggguaaguacaggcgagauuaggacauuuuguguauccaagagaguaaagaagggucccaaaacgggagggaccugccagaaacgccagcaugaaggggcucucauuggccaaacuggaacaauuugggcagcagaauagauauugauaauaaaagguuauaacccaguuaauaaauuaggaaucuaugaguucaaacuaauauaaguaaacaauaaggaaacacauaaauaaggaggaaaggaaagcucuuuacaggagaaaguuaacuacaggaguccacauuucacguuguccacagguucuuggaaaccgcaacuuuaagccaacgacagaggguccucaagcaaugccagucguuugacuauaacacuggugcacuggugagaaaaauaaccuugguuuuauucuguauuauuucacuuaaaagucaguuuccaagaaccuccugagguuaaugagggcuucccguccugaauguagcaagaacggugacacuagaugaccauuucacuuaaaagucaguuuccaagaaccuccugagguuaaugagggcuucccguccugaauguagcaagaacggugacacuagaugaccaguagccaccaccacgacaacaacagacuccgacaaagaaccaucaaugaugcugagacuugugggucagugcucggggaguagcaggcugucugcacagucccagauuaucucccuaccagauaccugcuaauuaugcaggaaacaauguaacuucacaguggaaacacccgccagcaucaccuucacugagagcuuccgggcagcaucagcagcaacgaaauacugcgguggccgccaagcccagcggcaucacuggaauccaaucacgaggaaacaugccgaaaucccaagcugaaaaacauuuuacaaaauagcugccccuacgcuuccaaaaugugaaugucacgaaacauaaaaaugacgaggagacugucccggagcaaaggggacuggggaggacgugagaauugaaggcccugcagggccugucaucugcuguugauaacgagacaucacuagacuaucagcgaaacauaaacaaggccuacagaugagagaacaaugccugcucgcuguuauuuuccaacucuacucacugaccguaguugaagagugaccacgcuuaucugaggcaacauggccuggauuauuaguugggggaaggcaucacaucuaacacuaacuuucaaacgauucugaaaaaaaaaaaaaggaugcauaucaauaaacaguaauucuuuggacuauuuuuugcugauuuucuguaaguuugaaauuacagcaaaauuaaaaguuaaaaagaaaaaaguuaaggaauaaaauuccccauuauuauuggaagacacuaaucuucagauucaggaaguccaaaaaaauaucaacagggguaagugaaaacgcuuacaaaaauguagaacacuaagacuacaaaacaccuagagagacacaacggauuccugccaaggaacggaacagccccaguggaacugagugaaccaaucacauccucagagcccuggggaagagcagcugccuccccagcacugucuucugugagggaucauucaacaaugaaggaaaaggaggcaacucucagacgaacaaaaaacggaacuucugcaggaauuucuaaaggauauuacuuccaaaggauauuacuuccagaagaaaaguaagagcaaaaaaccagaauaucugauauucaacaagaaacagcaagcaaguaauauccacauauaggaaacuuuaaggagcaguggccauaggaagcugugacaaugaaggcagcacacggccgcagccucccguuagcugcuggaaggaagccacacacacccagauauuucaauucugcaaaugauuaagaaaacgaaaccaacaacaaacauaaaaaugggugacccaugucagaagacacugacagccacagcaggcuggcggucaggcacaggccaggcgagggccaccucccgggaccgagcaaggcgcccuggucagccugaagacacuggcacuaggucuaagacgguguggccgugcuggaggucacgcagaguuaaaaguagcuuacccgugacccggcacucccauucccaggcaggaaccuggcaaagacccaaguuugcgugugucagaaaacacacaaaagaauguccacaacaucauguuugagagcagccacaucugaacaugaaucaaaguugugaaaauucacaaaauugaaugcaagacacuaaugaacaccagucaccgacagcuacaggcagaaaccugguucucaaaaacaguccugccugaaaaagaacccacgaaauagaaaacguauaguauaauucuauuuacaugaaguucaaaaacauaaaacuaaaaucauauuguuuaggaacaugugcauguaugauaaaacuuuuuuuuggaaacagcagaaugaaaagcaaacauguaaauguccuuguaguggucucugucucacagagcacacggucacugcuauuguauugcuuuaaaugaugcagauaaugucuaugaauuguuuaauucuuuaauuagagauuuauaauuaaaauuuaaaauaaaugcguguggaggggauaaaaacagaaugacuaagcgggcugagaaagugauaaaucaccuguaaucccagcacuuugggaggccgaagcaggcggaucaccugaggucagaaguucaagaccagccuggccaacauggugaaaccccgucucuacuuaaaauacaaaaguuagcuggcguggugggaggcgccuguaaucccagcuacucgggagggugaggcaggagaauugcuugaaccugggaggcggagggugcagugagucgagaucgcaccauugcacuccagccuggggaacaagagugagacuucaucucaaaaaaaaaaaaaaaaaaaaagugauaaaucaaacaaacaaaaaaauuuagaaggaauuauagagaauggaaugcugaucuccaccagugacaaaugacauagguaaaucuaaauuugccaaauauggaaauaaggaaauugguaggacucuucuguuauguaaaaauauguauuuuaaucaaaacuauuuugcuguugaacuuuucuagcuauuaauuauuggcaaauacaaaauccaugauucuaguggguuucugauaaucuauaaaauuuucugaaucuuuuugagucuuuuuaugugaauuuauuuugguucuucccaucuuaaugaaacugcugacaucucaagccauacugaacacaugugcuaccguaaggucaaccucagaacacagcucuuguuaagacaaggccucuagaguuuuccaaccaugaaaaagauucauuuuugcuuucaaaugauccccaacuuguaagaacuacauauucucuccaacuuggguauuuuaaaaucaauuaugaaaacugaaauaauuauuuuaucuaaucuuuuuuauuuuucaaaacauucucucauauuuacaugauuuauaccgcuuuccuuguauaacaacuguccuguaauaaaaccuuugauaacgaauaacuacauaauguacuguuauuuucuuuuccccaauauucuauucaggguuuuaaaccuauguuuacaaacaaaaugugcuuauaacguuugcuuuauuauugucucuugcagguucuaaaaucaagauacucuaagcuucauaagauuagcuugcagccaggcgcaguggcucacgccuguaaucccggcacuuuggaaggugaaggugggcggaucacgaggucaggagaucgagaccauccuggcucacacggugaaaccccgucucuacuaaaaauacaaaaaauuagccgggcgugguggcgggcgccuguagucccagcuacucaggaggcugaggcaggacaauggugugaacccgggagacggagcuugcagcgagccgagauagcgccacugcacuccagccugggugaaagagcaagacuccgucucaaaaaaaaaaaaaaaaaaaaaaaaaaagguuagcuuacauuuuucuguguuuugagccaaucuuaaauaaggugaacguguguaaauguuggaaaaauauuacauuaucccugaaggaguagcagcuuucaacaauuaccuaacuggguccuuugugggguucucagaaguucuuccuuuuagugacaaccaacucaugcugcuuccugucagaguacaggaugcuuuucuucuaaggucugacauuuuauaguuacuugcucuggcccagucaaagcccuccaaagcccugccauagagcacagaacaucacagcucccgcccacaccaggacuuccccuagacacuggcuucaucauucucagggcagcaucuaucccugauggcacauccgguuguuaagggggagggucuucacugcgagucguccagguucuugacauguugaacaaagaauuggacaaaacacacaaacaaagcaaugaaagaaugaagcaacgaaagcacagauuuguuuaagcggaaguacacuccacagagcaggagcaagcuccagagcaagcugcucaagacucccacuugcaaaaucuucuggggguuaaguacccuuuagagguuuccuacugguuacacccuauguaaaugaagacuuggcucaugaccaaucagaggccaaagugaaguuacacccuaugcgaaugaagacuuggccugcaaccaaucaggggcugaagugaaagcucagccugcaaccaaucggaugcugaagugaaggcccccugucuccagauccuauucuacugccuugcaaugacaaguuuaggggaguaaagccuuacacuucagagcgcaagcucacugguuaagagucaguugcuuggcacagccccuugggccagugacuuccuuucucaaugccucuguuuucucaucuguaaaauacagaugauguaagguuaguaggacccauccguaggcuguuguggggaucacagcuguaaauauguagaaaacacuuagcaaagugccugugcagggcagacuccaucacugccagccauauuuaccauuauguaguuguuuauuuacccaucuacuguuugacuuucccacuggcacuggguguggcaaugggugggggcuuuuccugugugguucaccaguagaccccagugcuuacagcagccuggcauguagcagaugcucacaagaggugucuugacuggcugagugcugguguguggacgggaaccagccuaaggaaagcacucuugagacucuucauccugcccggguguggguagccugggucugucacucggccccacacccggggccccacuccuggcuucgauaagcgacgucaccaaugucugccccagcaccuggacagacucuuguggcccuuccuucucgggaagcccagaaagaacugcagugacugagacaaacccagcgcugcugcgggguguguggaggcaucuugccauaguggguggggugcacgugccacaaacggcucacucuugaugaugagggugacucacgcauccccuuguccccacaguucuguuucuuggacuuuauccuaacaaaacaaucaugauaagaacaaccagccccaaacauaaagacacaugugcaacaaugcucgcugagguguuauuuacuauacaaaaaauuuaagucccauuaacagaggauuuuuaaauacugaaauauuacggagcuacaaaaaaaucccauugcuguucuaucguguauguaauagguacagguauggacauggggagacaaagagggaaagagagaaaaagagagagagcuccugcuugagaaucuacaaaaugucaccugugacuuucucugaacugugugccucccagcuaaauguggucuggcaggguaaagagagcauuuuccuuucuuucaucuuucagcauuguuggauguuaaguaaagaaaagacuacaucuuaacuuuugaaacuggggaaggggaguauuuucccauuuauuuaauaaacugcuuucauccaacaaaaucaaagcaauaaauggggcagauccucggagagccuguguguggaaggcacugugcagugcuaggugagagaggaggcgucugggagcucaggccacgcccuccaagaacccgcggccaacgacuuaggugugugcgccuggaaagugcuucuucacguguggacaugggagagguaaugcugaauucaugucuccgcccaaucuggauuuaaggaggaagaugccggugagagcucaaaaagcauccccugucacggggccccggggcagccaaucacacacaccugggggccugcacagggaaaaaacgcugccacucaagcaggcagaagcgccacaaaaacauucauuuuuauuuuuucuaaaaaaagacaagaacauccauugcuguugaaauauuuaacuuaaaaaagaaacagugcaaauuucagaaugaaauauauccucuauugcuuccccuagaauccaggccacagaaagugcaucugaacgggaccacaugcgcuacgguaugcacugaugaaacacugacaaaggcugguguaacuuuuaaaaugcgaaggauuagcacaauugaaggugugaaacuagaaggcagcugaaaaaauuaaaaaguaacuaacgcacauaaauaagaaaucuggggucucuggaaaauauuuucaaacauagaguacuuggacaauccugaauuugaaacccaaauuggacacgcaaaggcaaaaauguagccacaauuagcugaaagaaacacagcccugagccauccuacaagaaaaccaauccugccacaacucaccagugcgaacuuaacauggagaaagagguccucaccgcacaguauccugaacagaaaggcuggugagagugaaaauuaaaagccaagagaacaauagcaauuuuuaaacuccuucagauaaaguaaauaaauccuacucccuguaaagccuauugccauuauguguuugcucuccaggggccaagcaaagccaaagugccugcguggcaugcuguggcuuccugcucagcagcccacccgcuucagugcagcagccagcacacucaggacccccaggcagauagcacgcaggacucugacgcaaguggugacaggauggucggaagagccccacucacgaggcaccacagcucacagcacaacugggaacccacgcugcagaaagccuguucucugucuccuguggaaacccuggucaguuguuguuaaacucgccaucccuuggagaggccauaacagaagggggcgugggcgaggugcugcuguagggacgcagcgacagggacgggagccaaagaacaagagacugaauauggcugcagcgcccuggcuuaggaagagcagagucuacaccgaccugggaaggaagaacaacugcagcucagacacuuccaaagcacaacuucagaaaugagcaagaucuuuccucuaagacacaugcucucuuacagcagcuaaaggcaagcaacauccucuucaacaaauggugcuggaccaucaaauugccacaggcaaaggaaugaaguugaaccccuaccucauaccauaugcaaaacuuaaggcagaauacaccaaugaucuaaauauaagaacuaaaaccauaaaacucauagaagaaaacacaggggguuagucuucaugaccuuggauuuggcaguggcuucuuagauaugacaucaaaggccaagcaacaaaaaacagauuaacugcacuucaucaaaaugaaaaacuucugugcaccacaggacaccauccagagagugaaaugacaaccuacagaauagaaggagauauuugcagauuauauaucuauaacauaugaaguaccccuacaacacaacaacaaaaaaacaaacaacccaauucaaauaugggcaaaagacgugaagagacauuuauccaaagaaaauaugccaacggccaauagguacaugaaaagauguucaacaucacuaauuauuaggcaaauacaaaucacaaccacaauaagauaccauucacacucacuaggaugacuauuauuucaaaauuggaaaauaaaaaauauuggugcggaugugaagaaauuggaacccucauacguggugggcaggaacauaaaauggugcaguguuguggaaaacacuuuggugguuucuaaaaacuuaaacacagggcugggcgugguggcucacgccuguaaucccagcacuuugggaggccgagacggguggaucaccuguggucaggaguucgagaccagccuggucaacauggcaaaaccccaucucuacuaaaaauacaaaaauuaaccgggcgugguggcgggugucuguagucccagcuacucgggaggcugaagcacgagagucacuugaaccccgggggacagaggcugcaggaagccgagauuguaccacuguacuccaggcugggcaacagagugggaugaaaaaaaaauaauaauaaauuaagcacaaaauuaucauaggauucaacaauucugcuccaagguauauacccaaaagaugugaaagcagggacucagagacguguguacacauauguucacagcagcauuagucacaauggccaaaaaguuaagacggcccaaagguccaccaagagauggaauaaauaagaugugauguaugcacacaauggacugcucauccuuaaaaguuuuaggaaccaaauucugaccaugccacaauacgagugaacccugacacauuaugccaagugaaagaagccacgcacaaaaggacaaauacaaguccauucacagaagggcccuagaggagucagauucgcugagaaagcagaauggugaauggugggugccgcagccagagggagggaaacaggauuguuuacuagguauggaguuucuguucgggaagaugaaaacguucugggaauggaugguggugaugguugcccaacaaugggaaaauauuuacugccacugaacugugcgcuucaaaaugcuuagaauuauaaauuuauguuauguauauuuuaccacaauaaaaaagcaugaugaacaaagaaauuaauauacauguugguagacagaaacaacacccaaguguuauuucaagaauuaaaaagaaauauguuauuuauuaaaagaaucagggauugcuuuauuaacugauaugaaauaaucuucaagacagaauaaauggcaaagcaaggaguuggaagaaaacaacagauggcaguauguuuuaaacucucuaugauuugcuagauacuucuggggccaugggcaucccagcgagccagcagcuggcugcuucucugguccgagacccccacauccaccgcaccugaggccucucugaaugcugaugggagccuguggggcaguucacaugccacccccaagcacacagaggucaccccugucauacugcuaaagagaagugcacaacaggcccagggguacgaccuucccaggccaugagugcaggcaugagaggcacagucugaacgagaccacaucacucacuggcggugcaccuguuucuggaaaaaaacccugacuaggaugauucaccaacugccuucgcugaacaaauguuucagaaucugagaagcagagccccaaggaagccacaagagccuggggucagaaggcggcagccucgccuggcucugcuggcagcuggguuuccuggggcaccuggcuuugcccugggagccuagccguacccaccugggagggagggugugccuuucccacgggguggcccagggcucggcugagccaauggcaugaauaaggcaagccggggcccgaugaacguuccuccccuuccccagggguugggaggcacccccaugcagcucagaaacuggggcccagguccccugcccucagaaccugcucugcagagcccagguguccagcgagugaaacucagcuguucugccccucagcuacaauacggaagucuuuucucaauuuuacacacaaaguuaauuaucguagacagccuggacuuuuuuucauucaugaaacucccuuaaauuugguucauaccacaguuuaugugcauaggcagaaaacaagucgaaacugcaaucuugaaaucagacgcuagcccccagccagccagcccagacuuggcccgggacugcccuucugccuacagggcuuucccagagagacugccuggcucacaggaugggacucagaaccagggccugacagccuccccaaagcgugccugugcccugcaggcccucggaaacccagagcaagccuagagacacccuggccaaauucaugggcauggccaagcccugccugguuccuggcccacacugcucccugcaagcuaacauccagcagaggccccuggacagucucuggacagucuuccuucccaugcucuccccgcauacacaccauccaggggccugggguggcugccauuucuucugaaugucuguacaggcccaugccuggcccuguccacaaggccccucacugcacaucccuccacaucugccagugacugguccccgcccugagcaauguaagcuggaugacacgcugaaagccacacauucccaccauccaccuauagcaggggcucaaucaauacuugccaaaugccugaaucagcccugaaaugacuggaggcccaaguucuuucuucuagccacccuggaggagcccuggcgcuggcccaagugugcuccccgguaacccaggacuguggggaacccagcucccaggcuucuggccucuucacggguaccccagaugaaaaauguucuacaaaaacaagggcaggaugaauguaguccgggaccuccugacgaucucaaacgcugcugaaaaggccuuaagaugagguuugcugugagcaacaggaagcauucuguaaggcauucuguccuugagaucuggacagugagguacuugcuguccagccccugaguuucccagaccugaauguaacacugugcaagccucacacacagggaucuuucuuaaccccuacagaaugcccacuggaaggaggcaaauacucccaacgaggaaaacauccuauccaugagaguggggagcuggugggggaggaaaaagaaacaccaaacauuucaggaaauaaaucacaucugugcccggcauccucccccagcgagcacagcacacauccgaacugccaggcucggcaccucugagaaaaggacuuugucgggugcagccauacgccugaccucucgggcgcccgcuggcccucuuuaucuccagcagcccagcccggagcucagagggcaggccagcccuggccaagagucaggagcgguggagcugggcuugguguuuaugucugauccagacaacuggggguuuaugacgauuuacugacgcaagagcuccccgaagcagcaugccagaaauuaaucaagggaggaggaauucuuuuuaagaaaccacuuggcugcugcgaaccugccugaaaggcugggaguguaagcugagcuccuuccuccaggcccaggccaccaggcagcagcagcacacccaggacccacaggcagagcccagggccaacuccuggccccagauggaggcaggcggcauggaagguccugcaaugccaaccccccacaucccccccagugcagcuaccuccccaccagccgauccugggcuagcccacucccagaaggacucagaagggguccacggggaccccaccagcugugcagaccccaaaggcggguccuccuauuggaaugacaggaacccuccauuaucugcuaguaaaauuccuuucucaggaguugaguuuuaugguuuaccaucacucaucaccaaaagagaaaaaaagguaaaacauacaaguuugauucugccccgucaucucagugagacaggcacagccucugcagcagcagcuugggcugggagggcaggggccacgucgggccagcagcuccucuccagcuuucugcacaccccuccucccaccgggacaccccuccuccuugcucccccauuccugcuccggcugggggagggaagcuggcaucacacagacacccgugcuccauuuguuuugugaucugauguccaaguuauucugaaauuucaaacacugaaggacacagguuauuuauauuuaucaaaaagggcaugagucugacaaggcugacuaaacuaaaccuugccagacacucagggccugggcugggcuacaaaggguucuggaucccaacaggaggacagcagcugacaucccugggcaggaacaggcgcugggcuccgugccugccucacuggaucuucacgacaacccuauaaggugaagucucuuaggagccccaugucucagagaagggagcagaagccuagugggaggcggccacgggugucugugugaugccagcuucccucccccagccggagcaggaaugggggagcaaggaggagggguguccuggugggaggaggggugugcagaaagcuggagaggagcugcuggcccgacguggccccugcccuccaagcccaagcugcugcugcagaggcugugccugucucacugagaugacggggcagaaucaaacuuguaggggccuggaucagcggccacagagccgauggccggaggccguaugcaggccagguacagcugccuggagagccaugggagagccacaggagagccagagggacacugggaguggugccaaguggcccaacugccagcuuuccauaggagcaucgggaaggggagguccaaccaggccccagggggacccugugccaaaggaagagaugccucacaggagaccccgcgagggaguggcagcugcuaacccugccugguuccaaaggccugagcaagggccacuggggccugcagccagcaaccuggcaaucaggacugcaagagggcgacaggaaggaguguggcucaccaaggacaccugaacucuggccccaccgaacacuggccuggacuuccgcuccaagaagcucuucuccaccaacacugaacaggcugccagugaccgcgcacagugguugaaggcagccacguggcagaaguggcacaggucagccaaccuucacacucuguuuucuuaucucagaggaggaugcugauucugacaaacaaaauggcugcuuccccauaaugcuaacauccccuggucaugaggccuggccuucuacagggagaaaaaucgcuggcuuccuuacuagacuaucuguaauucaaugugucaauacaaguauauuuaucuuuaaauguuuuaagugagcaauuauacugaauaaaauauacuuuuaaacguaguauacuaaacgugguauuuguaacccaaccacuuugguuuaauguggcaaaagagaucucacccucagccuucuccaucccaaaaaggccacugaagaggacaggcugugcugccaccccagccccacaugccacgcugcugacacagaccugcugcccugugcgugcgcauucccaaccugccugaccuuggcugcccgaaauucggaguggggaggaaggcagauaugccugaauacagcccagaggacauacugagagagcggccaagugaagcucucagccugcccaggaggaagcggggcugaugggccaucggagcaaagcgcggccagcacugucgugacauugauggcacgaaacucaacguccugcacaugauuccuaaagcuaaaucuggaaugaauucuuccuucauauucgaggggaaaacgguaaaagccacgagaaggaggcaggaugggggagggaagacaagcaggaaggggugggguggcccugcccacugcauuucuggucagggagauuuuagagcauuuauaaggugcgacauaaaucaccucauaaaauaucugaauaaaagugcuauaagagcugcucaaggcugcagauauauuucaguccacuuuaaaauaugcccaacaguuauuuuacugcaacauaaagaugaaugcaagccuggaaagcaagcugggacucgugaacuaagccgcccagauagugaguucuacgggggaagccuucaggaagcacacacgggccaggugagcgaacugcaaugacacgucgccagggcugcacuggacccaccgugcggggacugccagguaaaccucagcuuccacucugggcuacagcgggccauacuaacccuccagccaggaacacagaggacaggaugcaaucuaaaacacggcgaugcacgaggagcccaggccugggagagaagggagguggaaagagggcacacucggcccgcguguccuccagaggcugaggagcggagcagcaccggacggcucggacccugggaaacgaacgccagacugagcgugggggugaggagagccccgugccaggagugagggcaacacggaccugaccaguccucacagaauccgcagcuugagcguaagaagggauacaagagggaaagguggacauuucacaguaacaaaaaggcaguuauuccaauuuuauggaauaauuuuaugcauaaaauucuaaaucugccuaggcuuaaaauagcuucaaaauaaacaaaggcuaaaccugacagagcuaaaaagagaaacaaugccaauccacaguuacaucagggggauuuuaauauuccauucccacuaucugacagaaaagcagacaauaaaauaguaaagauaacaggagaucugagcacaaugauuaauuugauuaaauggacauguagaacuggcaaaucuccacggcugacuucuucucuucaaguauacauaaaauguugacaaaacugaccauauaaucaauaaagcaaaauucaaagaauuucuaaaaacugaaauuacauaaaaugagugaccacagugaaauuaaacuagaaaucaauaacaaaaugaaagcaaaauacuagcaaauucauaaagcacugaaauuuagaaauauauuucuaauuaacacaagucaaaaaaagaaacuagauaauauucuaaaccaaauuauaauuaaaaugacauuaaaaagcucacauaaucuagcgaaagccauacauagguggaaauuuauaguuuuaagcacguggauuacagaagaaagucugaaaaaaaaaaaucagugaucuaaauauuuaccuuaaucaguaaaaacaacaaccccagcaaauuaaaucccaaaaacaaaaauaauagcaauaagaacagaaauuuauuuuuuuaaauucaauuuuaaaaaaucaagaaaaccaaacacaguucuuaaaaaauauuaauauaauaaauaagcuccuagcaaaguccaaugaaggaaaaaugagagaacaaacaauaucaggaauuuaaaaggggaugacacuacaaauccuacagucauuacaaagauaaugagaagguauuuaaacaacuuuauuucaauacauuugaagaugcagauggaauguaaaaaauuccaagaaaaacuaaacacacaaaaacugacacaagaaaaucuuaaaaaucuaaacaguccuauaucaguugaggguguaauuuacaaaucuucccacaaagaaaacuccaagauaaguucauaagcaaauccaucccaacuuaagaaagaaauagcaucuuuccuacauaaacucuucaagaaaaucaaacaggugucagcaaacuauggcccaugggccaaguacaaucuguggcuugauuuuauauaaccugaaaaauaagaugggauuuuacauuaagugguugguaaaaaaaagaagaaagaaaagaaaaaagggaaaaaaacgugcaauagagaccauaugugguccacaaagcaugaagucuuuacugacucucuacagaaaaauuuuggcaauccuaggaauagaagaagaaagcaacuucauauuuuaagagauuaguauaacuuuaauauuaaaaugugacaaagcauuucaagaaaaaauaacacgucaaucucauaucuuuagaugauaaaaauuaaacugacuauaagcaauguaaauucaacaguauauaaaaagaauaacacauuauaauaauuauuacagaaguguaagguugacuuaacauucaagucaaucagaaaauucaacacaauaaaauaaagaaaaaaagcauaagacuauuaacagaugcagaaaaagucuaauacauuaaguugaaccaaaugaaaauaccauuuuuuguagauggaaaaagaucaaauaucugcaauuucacaugacuccaucuaauauuuuaacagcugcuuaucagaaaaacucagcaaacuaagaacaaaaguaaacugcauucaucucauggacuacacagaacuuauagcaaauuuuaucuauaaugaugaaauacuaaaaauuuuucucuugauauuagaauaagacauagaugccuacuacuaccaaugacugauauagaugccuacuauuaccauuugacugaagguccuaggcagugcagcaaagcaagaaagacauaaaaguuuuaaaaauuagcaaagaagaaaugaaacauucaccguccauagacaauaugcauuaaaaacccaaaagaauauauagauaaugaguauaauaauaaacacugugcgagguaucuggagacacgacaaauauacaaaaaugaauugugcuucuaaacauuacaaaaauaaaauucccccaacaaaacagcauaaccuagaaguaaaucuaacaaaagaaauaaaagaccucuaggccaggcacgguggcucaugcuuguaaucccagcacuuugggaggccgaggaggacggauugcuugaggucaggaguucgagaccagccugaucaacauggugacgccccgucucuacaaaaaauagaaaaaauuagccaggcaugguggcaugugccuguaaucccagguacucaggaggcuaaggcacgagaacugcuugagccugggaggcggagguugcagugaguugagauugugccacugcgcuccagccugggcagcagagcaagacuccaucucaaaacaaacaaauaaaaaaaaacuaagaccucuauacugaaaauuacaaaauaugaucgaaagaaauuacagaugcucgaaaaaaauagagagacguagcauauucguagauuagaagacuccuaauaaacugauuucauaugcaaaucaguggaucccaauugagaccacagcagguauucuguugaaauugaaaagcugauuuuaaaauucauauggaggccgggcgugguggcucaugccuguaaucccagcacuuugggaggccgaggcagguggaucacaaggucaggagaucaagaccauccuggcuaacacggugaaacaccccccucuacuaaaaaauacaaaaaaauuagcugggcaugguggcgugcaccuguagucccagcugcuggggaggcuaaggcaggagaauggcgugaaccugggaggcggagcuugcagugagccaagaucgugccacugcacuccagccuggaagacagagcaagacuccaucucaaaaaaaaaaaaaaaaaaaauccauauggaaaugcaaagggcuaaaaagaaccaaaacaagcuuugaaaaguuuuaaaaaguuggaagaccuacauuauuagauacuaugguuaacugcaaaucuauuaguuaagacaguguugcacugguacacagauaugcaaacagaccaaugaacuagaauaaagugcaaaaacagauccauuuauauaauuuauuucacuuaugacaaaguugcauuggauagcagagaagaaaggaugacucuuuuaaauaaauacuguuaggccaacugaauuuccaaacggaaaaguaacucucaaucccuaccucacacauaaaaaaaaaaaaauucccaguggaucacagaucuaaaugagugauagaacaaugaaguuuaucaaaaauaauauagaauaucuucaaauaggcauagauaaaacuauuaaauuggacuauuaaaauuaagagcaucuguucagcaaaaaaaaaaaaaaaaaaaaaacaccauuaagaaagggaaaacgcagcacacacauagaaaauagcaacaaacaacaaaaagcucauucauagccaguguacagaaauagcuccuacaacucaguaagaaaaauaaagacaaaccaauuucuuaaaugaauagaaacuucuccaccaaagaugacaucuaguuggucaauaaacguaugaaaagguauucaacauuuuuaguaaucugggaaauacaaaugaaacuacaauaguuaaaaugaaaaagaauuacaguaccauguauuggcaaggacagagcaacauucuauaggucagaguguaaauugguacaaucaauuugaagaacuguuuggcacacauacaccuuaucaaaagaauugcauacuuauaugaaccaauugaaauauacaagaauguuacaguagcauuauacauaauuccaaacuggaaaccaccaaaaugucaucagcaauugaaccaauaaauaauuugugauauguucauacaaugaaauauuauauacccauuaaaugaagaaacuacuacuauaagccacaauaucaauaaaucuaacauauugucaagugaaauaauccagacaauaagaauaaguauuacgugauuuauaugacguucaaaaccaggagaaacucauguuagaagcuagagaagugguaucuagagggugugagagugaggguacaguaacugagagaggacauauacggggcuucuggguguugggaugucccauuucacaaucuggguagcaguuacaggcaucuuccuuuugggagaguucaucaagcuaagcagucaugauucuugcacuuuccuggaugccugugauacuucaguuaaaaaguucacuuagacauuggcggucuucaaggcuacauguuuauaauaacaacaauggaaaggcugaaaacaaacucccuguccaccaacaaugacuuguuaaguuacucuaccacauccaugcacaaccauaaaaaaaagaguccccaaaggaaaaacuguaaaagcuaggugcuaaaguaacuacaguauacagccauucaugaacaaacauuaagcaaaagagaguaucuauaaauguacuucauuuugugaacucaaaauucuugacauauuuuauuaaaacuugaguagacaguagagagagcugccauauacccuaccaauaccaccugcacauuccccgcgauuauuagcauccuaccuuacuacgguauguuagucacaauugggaaccaauacugacauuacugucauuaacuaaaauucuagaguuuaggauuuccugaaguuucccacuaaugucuuuuacuguauuccaagauccauccaggaucccauccaggaauuccacaucacacuuaggugucgcauguccugagaucccuccugguggugacaguuucucaaaggaugcuuguuucugaugaccuuggcauaucgagugggccuggcaagaguagacuguaggaagggugucuacuggaauuugucugauguuuuucccaugguuggacuggggcuauggguuacugagaggaagaccacgggggaaagugccauucucaucauaugaauugauuuuuaaacacauggacuagaauuaacacacacccacuccacuaaacugguuuuacugaacagcagguugucacacaaacggcuccaagggagggaguggaggaaauggcaaggcucggagacacugcugucagaugcacgugagacucagcuguacucaccggcgaaauaaacguuuuggcuccgggaaggcagaaaacguccacuuugagagaaacucacacccugcauaagccacuaaccgguggggacucccacgccacacaucgcaccaauacaagcuccauucacagaaaaccccacugcaagucgguuaucgcugcaaacuuccucucucuaacaggaagaaaucaggacucacgggaguaagcaaaaugaggccuaaauccggcaagcgaggaaaucaaacacuuccaucuuaaucacauauuauagcgaugagcaaccgagucagauggccgcugcuggguuugacauuuuguggcucuuccuuuccucugagcucccaacuugcuuccaagaaugaggauaaauuaacauccacauaucugaccagagccaacuucugcucccaaacauacggcgacgggggagacaggaugcacccaaaguggccccuggcugugcgugacaaagcuuuccaggaacagagcgagccaggcaggacaaccggcuucggcugagaucugcagacugggcccuggcagaauaaaugagcggacuggacccaguccaggcucgggacaauuacaaauagcaagagaacaagaaaugcuggcuuguuuuuguacacugcuaucucuucgggggcagaaagacaaagaaaaaggggagaaagagguggaucuggucuggaaaucccaggaaagccaggccaugcagaaggcaucccccagcacaccgaaagccagggaaucugcagccuugaaggugaggcucagccccgcccaccagccaggugcagaggcugcucagagagcacaggcagguacuccagacaagcacagagagacaacuccgcucccagcuggcuuggucugugccaccagcuggacguguuuuaucucagucccaaaaugcacgguuucuagaccucccguggcaccucucucgcgacucaaagccagugcagugaguuccuggaggcccaugcagcuuccuauccaccacgucccucaccacccucuaauacaacuggggcagcggcagccucuacucguuacccucuccucccgcuucccuucauuccaucagugccccaaaaucccuauuacaggaggccuugucugaccccugcagcagcccaguuaucccugagauucucacaccgaccuucguccaacccccuagugcaaacaucaaaugacaccuauuaaaauugacacacuaaaagaacggcugcaucugagcucaaaguuuauucacacugagcuuuuaaaauccaaaacuaccauuugauguucaaaauuuaaauagccacuacauaaaauaggaaaaaauaaauuccuuuuauuuuucuaagggaguucuccaaauccucagcagcugcuaugagauucccguggauuuuuagguacaaaguucagacugagaggaccacaguauucaaugagauucugagcucaguccauccagaagauuccauaagcauccaaggcagaagugagauucagccaccaaccacauuucaaaagccacugguggaggauuccagagcaggugucauccagggcucagggccuccaggcuccccccaaggcugagauucuaccaaaagcguagguucgguuccccaguggcugaguuuuguuuccggagagcauguguguuaaacugacuugaaagguauccaaagaaacugugaaggcagaggucaucuguauuuaagaaaacuauguauuuaguuuacauaaaaucagaaaauacagaaucuggcuuugaagaaaacaaugguaaagauguuauauugacaaguaauuuuaaccaaugucucugaaugaauauaccaacucagauacaucagccaccugcuguuccuauccaggugaaggccggcugcccugcccuccccuucugucauaagagggucugggguugccuguaaacacagggcugccccacugcucacugucccagugaaguccuuugcucugccaguuuccaucagcugcagggccaggugccgacagaaggcaaaagucaaagcccaguaucuuucuaaagaaacagggcccgaugaaaggaagcaaccucagccccaggaggcaaugggcccaguccaggucaccccggacacagagccaccccugggcagugaucucccagcuccugccccuguccauuccccaggugaagccuaaaugcucugaucuggacaugggugaggagcaccaaagccaugcucucucgggugaugugagcaacucaacggagaccuacguuguucuuuuguucaugaagauaguacugaaguuugaaauaacaucccucagcagagcuccagagcagaaucuucccagagaaccacacauguggcccgcggcccccugcaaucuccuggcuaaggcauuaaaaacaccaucuccuuagaaaaugcaguccuugaggccacacccaugcaaaucaguccaccaaauccacucauaacagcauccagguaacuuccaaagaaauggaaacacugauaaacacaagaaacacccuccccacaugugauucucaugcaucagguccugcagaccacagagaguucaaggaaaccgcagccaagaaccaagaaagccacauccaugcucaggccagggccaccggccuuugugacugcuucccucagcagaagugcuagcagcugaguagggagacaucaagacaucaugacagaaagaggcugggggccugaacacaaagcaagaagagugggauguguccccaccccagauacccuccuaguuucuaacacauucaggccaggauggucccugcagcaguuggggcaugggguccugcuggugcugcugcucccucaccccaggacaccccagcucuucccugagccucagcuacaccaagccagucacagggcagugagcucagcuguucacaguaggcugugcaagcauggacacagccccacccgucuuccugaaccaucgagaaauuacgucuuaccaaauccuacugaggacuggcgaagaacaaaagggaaccaaaucacagauagaugugaaggcagauagacaauucaacuguucucagaagcuacagaggggccccagugggggcagccccacugagcuccagucugccacccaaaugccuguuggugcaucuccuaaaggcugggcugcaugggacagaggaggaccaugguggggugucagcacuuccaggcuggguacuccaucggugcugcugcuuagagaugccucuguacccuuccagcugucagauggccucugcaccuuaucauucuguuacaacagccuggacauggagacacacaccaucucucaaaaacagccuuuggggaugcucacguguauguuuguguucagaaaagaaccaccugccuugaaugaagcaucugcuucaaagccacagggcuccccgugcugagggccacacugagaggacaucugugcccugcaguccucggcccaaguccaccccuccaggccaggcacccuggccccauccugaugcugcaagaccaaggaugagaagcccaccagagauaaagggcacugaagaucuggcccccucuucagcagucacacccuagucccugucacucagaaaacugggcucacugcagcacccacuaaacaucucuaaggggauccuaaccucccaucuccaccaucaucagagccaccauuaccaucaaggacucggcuuucaacacguacaaugcaucgggcacuacaaaaacuaaaacuccucaucucucugguuuaccaacgaaaaccucugcuuuccaugucuccaguuuccccuagggccuccucaaauguucuagaacucuuuuuauccacuaguacaucagaaagaaaaaauuaaccuugccuuccucccuccccgauccuuucacaaaaacaaggcagugcuauggaagcacaugagagagacguggggcgaaggccgccuuugcucccgcacagccacauugagacugcagguguucaggcaaagacagggccaggcagcaccucggugagccugcagcaggaagguuuguguugugcagugucagaccgggaugaggagacagggcuggaagaaucagccccaccugauuuggauucaguccaugugaaaacaaagagugucaagaauucugcaucacacuaccuaacagggagggaggaacuuccccucaauacggccuuacccuagaugugaagaggugagaaaggcuuucaggacaacacauggaaacccugagugugcucagaacagacuccacauccuugccugaaacuccaacagcauuucacaaacccuacugaaucaacaagucacugagaaacacaguguuaauaagcauccaauuucuacauauuuccuaggaaaacucauagguauuuaaaaaggaauaccuuuggcuaugaaugcaaacuaauugaaagaaaaccauuagcucuuauaaugaaagguauucucuuggcuuuagcagcugcuguggucugaauguuggcgucccccccaaaauucacguguuaaaaucuaauacccaaugugacaguauuaagaaguggggccucuggagagugauuaaguuauggacucucaggaacaggauuagugcccuuauuauagagguucaagugagaccccucaccccuuccaacaggugaggacacagcaagaaggcaccaucugugaagcagagagcagcccucaccagacaccaaguccgcuggcaccuugaucuuggacuucccagcccccagaacugugagcaagaaauuucuauuauuuacauaucauccacccuaagguauuuuaugauagcaggcugaacgaacaaaggcaucaccuaaacaaccacauuauggaagcaaucuucuaagaaaauggucuaagcauuuuaaaauuuaaaauuaaaaaaaaaaaacuggcuccaaucacaaaacuucuuuuagggaaaggcucugaagacaguggcuucauaauaacaaauucugacaucucaagugaauacaaacucaaagagcuaauuugaaccuuugagaauguaguuguauacagaaaagaaaaaacucccccaguuaaugaccaucacuaaauaaugaacacuaagacacacagaccaacuuguccuaauucuuuauaaaugcuauuucaaauggaacaaaaauaaguacauuuaggucauuucuguauuuugaaaaaaacaaauacguuacaauaaguuuuacuacuccuuuugaaaguacagagucuuggugaaagcuaggaaaugacagucauccugaacacuguguuucaagguaauaucccaacagcucuacagcugcccgucagcauggaaccacacuggguccugaguccguguuguagcacugaaggaaaggcagcaaggggacacugggcagagauggaggagaguacagugagggcugagggagaugagggagccugggguccagugagaacaaagccaccauaagccagccgggcucaggauccucacagacaaccaagagcccgcaggcccagcgucgucuuggagggaaacagccgccuacacugucaagggggcucccaaaggccuggcuaugggcuucggucuccaaaucagcugugccuagcucccugagaggcagaauuuaucuuuucuauuuguauuuguuuuccuaaaaagggggaaggagagagaagcaaacaugaaaauaacgccccaaggccuccauccccaccaaugcguaucacuccugaagggccagcacucccagugucuuacugauuagguggcugaaagcaaaccaguuuaaaagcucagggccagauauaauucaaaaaaguuuagguauaugccucaguugauuuuugucuuaauuuuaauuucuuaaaauuaacuguaauuuucauuauaauuuuccccaaagugcccauuuuuugccauguucucaugaaauaaacaaagagaaggaugcuaaguggccacaacgugaaaguuucagcccaaaucucagaguucgcuugguuaugccaaucacccagucacuccuucagucccaacauucuaaggaccggcaaagagagcucagagaaaguucacaaaaagacagaggaaggacagaugaaguucccugauggcaaaacccaugcucguugaaaccaacugggacacaaaaaagccuacguugcaggacagggccccagccggcggggcaggaccugcgggaggcccaccaacccuccucacaaggcuguuucagccucagguccuuucuaggggacagccucccuuggccuccacaucccucagggggcuuccaugcccagcccaucccucucguggcaugaaccacacuggaccagagugccugcugcccugccugcccugccugcccuggccagggagcucacacaagcagacaggcucaaugccucucaggucccaggugcccaguguucugccgcagagaggcgcacacuccuugagggaaggugaccgauucuagcggugccagauuggccucugaugcgcugcccagccucagccuaccuaagcacucgauagcaguaacacugguuuccucaucuacaaaacagaaauaacguguccagcucacgucacaggcuauaugcaagcacaaauggaguagcagcaagcaaaacucagaacaaaccugcuguucauuucguucucuuaaacgcgcagugggguugacugagcaagcaagucaucaaggcugauguauuauuaugaugaguuuugaacaccuauggucaaguagagccagaccuuugauggcaguagcucccgccucacacagccuggcacccggaggcagccacgcaccugcacaccuguccacgugcgaccugcccccacugccgggugccucaaucacagccuuucuguuccccgccaagcugugcucaaugguuucuaaugauucucacaccgcguuuucuaugucaaauacauaccgggaguucauucuuaaauuucaauaucauuaaucauccaacauucagcaucucagaacucagaaauuugcauuucuacaauaguggcuuugaaaaagggacacaaaugcaaauguuccacaaacuguguaagaauuuucagagaauugccaaaacaaaccaucaaugcuccauugacagcgaauuuucugagcucuucauaaugacugaguacucgugauuuuuaaaagacaaaacacaauuugaggaucaaaaaaaaaaguagguugaaaaauaaguccuuaugucuacaugauuuccagaacaaaccuugacugauuaagaucccagauaaugauggcauggagaauccaggcuagugacaaucugagagcugcagacgccccgugccggguggcugggaggaugcacauucagacaggcggugcugugcgucagaaaacguacacaaguauuuuugaaaccuugccuuuagaaagcggaagcaagcaguacauggggaucaaaagcaucucccaccccaacaucagccggaacuauccaggcauuucuguuguccuucucuaaaaccuccaguugauguagggcuggucuacucucccacguucucgggguucaaucucacucccuccuauccagaacccccagggcugcccaccgcaggggccaugaacaagcucuucuccagcuggcaccaagcaugcucucaggcccugccaccuuguccaagcuccccuggacuccugccagcuggcugcaccugcugccuacacacccccuccuccugggagcccucuugggccuccugcaaagccacucucagcucccaggcuuucucauuaccucccgccaccuuguuucugagcaagggccaugcucagaaucugcaacccaccugucaccagaagcucagaaucaaggucuuggguuaauugcaggucuucaaaauuccuuuucugccccuuaaaacuuuguaguacuccuggccggauacaauggcucauaccuguaauccaggacuuugggaggccgagggggcaggauugcuugaguccaggaguuggagaccagccuggacaacauggugagauucggucuccacaaaaaauuuuaaaaauuagcugggcgugguggcaugcagaggugcaugccagagguggucccagcuacucgggagccugaggugggaggaucgcugaagcccaggaagcugaggcugaggugcauaccaccacacuccagccugggcgacagcaagacccugucuaacacacacacacacacccaacacacacacacggacacccuaacacacacauacacacacccuaacacacacccuguguaaaacaacacucucaacccugucuaaaaaacacacacucccuaaaacacacacacccaucucacacacaugcacucacccuaacacacacacccuaacacacauacacaccgucuaaaacacacacacccccgucucacacacaugcacucaaacacacauacacacccuaacacacauacacaucgucuaaaauacacacccccgucucacacacaugcacucaaacacacacacccuaacacacauacacaccgucuaaaacacacacacacccccaucucacacacgugcacucacucuaacaaacacacacauccuaacacacauacacaccgucugaaacacauauaccaccgucucacacacuugcacucacucucacacacacauccuaacacacauacacaccgucugaaacacacacacccccaucucacacaugcacucacccaacacacacacacccuaacacacauacacaccgucugaaacacacacacccccaucucacacaugcacucacccaacacacacugucuaaaacacacacacccugucuaaaacacacauacauaccuuaacacacacauauccugucuaaaacacacacccauacuuuaauacacagacacccacacccuaacacacauaccacacccuaaaacacaaacacacccuaacacacacgcauacagaccauacacacccgucuaaaacacacauacacacaucuuaacacacauccugucuagaacacacacccauacuuuuaacacauagucuaggacacacacacccuguuuaaaacacacauacauaccuuaacacacauccuguccaaaacacacacccauacuuuaacacacagucuaagacacacacacccuaacacauaccacacccuaaaacacacaaacacaccuucacacacacacacacacacacagaccauaacacacacaccugucuaaaacacacauacacaccuuaacacacacacacucugucuaaaacacacacccauaucuuaauacagucuaaaacacacacacugucuaaaacacacacccuaacacacacauacccuaacacacacgcucuaaaacacacccugacacacacacccugucuaaacacacacccuaacacauacaccgucucacacacacacacccugucuaaaacacacacacaccaccuaacacacacacccugucucacacacacccuaucuaaaacacacacacccuaacacacacacccugucucucacacacacacccugucuaaaacacacacacacccuaacacauacacauugugucuaaaacacacacacgcacccuaacacacacacccugucuaaaacacacaccccaucacacgcacacacccuaacacacauacacccugauucacacacauacaaccugucuaaaacacacacccuaacacacacucuaacacacacauacacacagacacuuugugguauuccugagacauucaaccacugcagagcauuauuuaaaugccauaaaaaugcaucuuuauggaucauuucuauauuaaaauauaauaaucuuggcggccacaauaguuaaaauaaacagauucaagaucaaauaaaguuagagcagaacaugaggacuggaagcaaucccagaggagagccuucucccuggacucacaggguuaacacucaacaguggucugaagcaacuguauuaccaugaacucacucaucaccaagucauuguggacagagacuuuuuagcugcuuuuauguggauggggguagcucagacugaacagaauauuaagaaaucauagaauggcccaaaugaacacacugaucuuaaguuacacacguuucccacaaaauccuuuuuuuuuguuuugagacaacagucuugcucugucggccaggcuacagugcaguggcaccaucucggcucacugcaaccucaccucccggauucaagcgauucuccugccucagccucccgaguagcugggacuacaggcgcgugccaccacgccuggcuaauuuuuguguuuuuaguagagacgggguuugaccaugcugaccaggcugaucgcgaacuccugaccucaaaugaucugcccaccucggccucucaaagcacgaggauuacagguuugagccaccgcacccggccacuuauuuuguuuugaacuaaacauuauccguaccucgcaccaagauuccaggagcgagaggaugcucaaguuaccgaccacugccugcucaaccagcuuccuaucgagagcaucaucccggugaccauagacacgucccagcaaauccacgucccagcaaaugcacugcuuccuaucgagagcaucaucccggugaccacagacacgucccagcaaauccacugcuuccuaucgagagcaucaucccggugaccacagacacgucccagcaaauccacugcuuccuaucgagagcaucaucccggugaccacagacacgucccagcaaauccacgucccagcaaaugcacugcuuccuaucgagagcaccaucccgcugaccacagacacgucccagcaaauccacgucccagcaaaugcacugcuuccuaucgagagcaccaucccgcugaccacagacacgucccagcaaauccacgucccagcaaauccacugcggggcuccuugacacugagaacuuuucugggcaagacuuucucuaggcacgaacauuccggaagggaaaguaaaugacacuggagggacgggguaguguuaaguggguggccaaguaacaacgucugccuuuccugcuggccagucaagucaccaguauccuaagcccuuaaccacaaggaaagacaaggacaguuacuuggagaacuguccuuggaggaaaacaagggaaugggagaaaaaaaaggaggcguagcuuguccugccagcaggcccccgugggcuuuccguccacacucccgguuucaugccagggacucuggcuucaaggcagaggcucuguguccugacaaacgcauccugcccugccacagcgcauccccucagggaggguguggagggcuggccgggcaaggggcguaaggcuccagggccuccuuucaaaggagagcccuuccaggcuaagucaauccagguucuucccucaggccgcucacaucauuagaaaucguucuuuagagcaauaaaaucccaacaguuaagcagcuuugacgucagagaaccagggccuggcucuggcaaaguucagcgggaacagcaauaaaaccguaacacaaaacucacccagcagcagaggacuuucacagaacacaggagaggaaagccacacacacugcacuagaagggcacuucaucagcagggcaaagccaagucacaugacaaaugugagagggggcccaugggcggcuggacucccccagcccggccugcccagggagugagggcggcacgggcacccacaccaggccacacaggagcagggcccccaugccagaugggcaggcaagggugagccaggcaggcaagagugagccgggugggcagggcgaaggacagggccagcuagcagaggacggcacgagagacacacggagggaggggaggugcagccagguaggccccgaacaccacguugccaggacucggcuccucggcucaaggaaaagggacagcgguuccguggcugugcucugacacaccuagaaauuucccgcucaagagagcaaacugaauccuuuaguauuaaugauuucucuuccucccaaaacccacuaaaaugaugaaaagcaggauuggaaagcacuuccagcaaugccugggagcggacggacaggugcaucagcugacaagaaacacagaggaacuucccgaaacuagagaucucuggggauggagcugcuugggaaggcacacaagcgagugggccucgcccaggagggagggcacgguucugggcaagccccaucccccgccugagacgugggcagaggccgcugggccaccagccagugugugcagguggugguaugcacguguugggcacaagggguccugccucccaagggaccuccgggcggaagggcagacacggcagggaaagaugacagcggacagggcagaggaggcagccagcagacuucaggccccaggcaaaccaccucagcuguacccccugcacagauggagagcagagaaugggcugggccaaggggcagcccugcccucaccagugcggccugucuucagccuccaacccacugagagagagaauggagaggucguggguggcaauaaggcgcacacaacccaacucacaugggcaggacaggcccgggcaggccggugaucaaacugaaccgcagcggcugaaauucccacagaaaaggccaaacaaacccagcaccccgcgguuuccagagcugagccucaaagaacccggccugaaaagguuagagacaagcggauggagaaauauuuguuagccaaaagaaaccaaggguagaaauaccucaugaaacacuauaagcucucggucaaagaaacauuaaacaaagagaaauauauuauauuuugauaagagaccugaucuaccaaaagaacagucauuaauuuuuaagcuuuaaaaaaaaacacugaacuauauaaagcaaaaaaugguuauuaauguaaaaagaauauuauaagacuauaaucacaguagaaaaauacacuuuuccaagaaaucgagcagacagaaaaaaauaaguaaagcuauacugauuuaaauaacucaacugaguuaauauauaauuaaaacaacauauaaagaaaggauacauauccuccuauauauaaauaaaauauauauaaaugagagaacuuuuuuuuuugagacggagucuugcucugucgccaggcugaaguacaguggcgcaaucucagcucacugcaaccucugccucccagguucaagcgauuauccugccugagccuccuggguagcugggacuacaggcacacgccaccacgcccagcuaauuuuuguauuuuuaguagagaugggguuucacuauguuggucagaauggucucaaucucuugaccuugugaucugcccacccugaccuuccgaagugcugggauuacagcugugggccucugcgcccggccgagaacuuuaaauacaauauugauacauacauacagacgucuuuagacugaaacaaaauccuaagagcauacuuucucuucaaaugccugcagagcauguacaaauuaugauuauguguacaccaagucauacaaaaauaugcacccccauuaaaauaaucaaguguacucaaacaauaauuuucccauagcacacugacaaaaaugagagagacugaaccuacccagugcugguacagcacaaaugaaaaauaugcauccucuuacacuggaauuaggaagaucaguuggaacgaggcuucuggagcaauuugacagucaaccuaaugauguuuuaagugcacgggcucacugacccagcuuccacuuccuggaauuugucuaguagugauacuuagaaguuuacaaaauauauguauaauaauuguuugaugccaauuuggaauugguauaaacacugcuacaaccacauaaauauccauucgcaagguaucaaaagagcaaguuauauuugcacacauacugauaccaaaagaugcuuauaacacauuaaaauggacagaauguaaaacacagggcccugccuauagaauuauacucuaugaaaaugcucacacacaucacacuauguuuagacacagaaaaaagauacacucucacccaacagcagcccaguguaggagggagagagccagcuccauucaaugucuauuuagacacuuugagccauagcgcuuaauuuugucuuggaaugaucauaaaccauuucuuuacaucagucaauacauaaacaauuuaacucaauaaaacuuucauaucuaaaaaaaccuggaaucuugcccucuggaauuuucagacaaagacgauuccacccagggaaagauguguguaagcguuccggcaaucucaaagagagugacccagacagacccugagccucucugccucugcucuaaggagcaggacccagagccaaggcuaacagagccucaggugccuguccaagcgucuguccaguggccaccgucuucucucucauguggacgcaagacagaagucgauggcuaagugcccuugaaggccacggugcgcuggaaguggcaggaagcugggcagcacaggacuggcucugcaggagccccacacucaggcaggucggcggcaggccucgagguuucauuauggugcacgcucucggugacuuuccaaggacagaaagugugaagucguaaauggaugggcccaugacaugcuucugaagcucagagcaggacaagcuugcuucccaaucaugugggucccccaccuaccagcucugugaccucaggcaaauuacuucuucccuccaggccugagaugaucuggggcuguacuaaaugcuuguaaaaugcuuagugcagccccucacagaggcccucaaacaccaggagcaacuguggccacgaccucagugggaacaugagcuucuucccagacagcccagacgcccaguuggaggagcacucccaccccucacacaaccccucaugaaacaacaaagacacugggcaagaaaccagcucuccacaucacaaccugaccuuucaacaucacccuugucaaaaagcaucgaggaaaccugugugccucucaagucagccugcaaaccggggucgcagacuugacuccacauccucccagguuuuaucauucuucuuucaccaagaggaagaauaaaccauccauuuugcacuuugugcugucaaaaaccaacagugaccacuaucaagaaaaacaaaagucucaaauccagaaagcaagcugcagucacaagaacuucuacuuugggcaaagaaagccccgcugugugcccagagaagaaaugacccggccuuaccuggauggcuuugggagcucauugcuagcaauguccacuccuuuaagugauucgaaauggcucaaaauuuccacggaaacgauagcuccaacgagcuccaaacucccaccaacacauacaaguaccgggacggugagggcugggucacagacguucaagcgccgagccucgccggcaaggucucaugagccagguaacccacaaguugaacagaggcguccgcuggcuucugcagaugaaccugcaaggucagaaggagaaaagagacuggaguuacaacauggaaguuccgaucuggaaaacaacauccaacuagggaaaugaugacuuccucuuuuuuuuuggagacagaaucuugcucuaucgcccaggcuggagugugguggcacgaucugggcucacugcaaccuccaccaccccugcaacccuggguucgagcaauucuccugccucagccucccgaguagcugggaacacaggugcaugccaccaggcacagcuaauuuuuguauuuuuaguagaaacgggguuuugccauguuggcccaggcuggucucaaacuccugaccucaagugauccacccaccucagccucccaaagugcugggauuacaggcuugagccaccacgccccaccaacuuccuucuuuauccuuguucugaccaaggacugauagaacaguucgacggaaucauuucuacaaauacgagcagugggauuuuuguuaguaaaucacagacauguaaaaaugucuccagagagcaggguuucucagccucaguaccacugggauuuugguuugcguauuuagguguugggguguagggcugccauacacauuauaagauauuuagcaggauccugggccuccacacaccagaugccagcagcaucuuccaggucaugacaaccaagaaugucuccagggagugccaaagguccucugggggauaauaucauccccugguucaaaauaucugaucuagagacaccuuccuuaccccuuccagaaguuucuccaacauuaggcuuuugaaaggaagcagaguaucuuccaacuaauauaaauuuauucugucauauuagcuuaugaaauaaauaugaaauaaaauguuuuaaaagaaaaaucacuuucagcacauucccaccacaaaaugucauuacugcacgcuugcaucagccuggauccauagacauucguagucacaaugucuguguaaucacagaauuuaauucuaaaguccgcauuccucacguaacaugauaaccuaaaauaguucccucauguuucugucuucauaaugaccauuuucucagguuuucauuuucugcuuauaaaagcaauacaugcgcaucacagguuaaguauuuaaaaagucauccaugaugccaucacacacagacaagcccuugguaacauucugacaugcuuccuugccguuguuuuucuuugccuuuugcccauacgaaccucuagugauacagcugucuaucacguucucugugcugauauuacagccaggcauuuuccaauggcauuaacaauaccugguaagcuucguuuugaagggcuguuuccuauuccauguguggauagacagcugccccgccccacuucaggagcuucggaugagccugcugcucccagggaagugucgggccaaagaguggcauguggcaccagcugagcucaucaaguucucuuuccaaggccugccucuucaauagaucagucacuagaugaacccaaaagagacaagucucagcacuccuaccacugagagucccuggcugaucccagcucaagugcuuucagaggcuucuguguucaucuuucuuuaaaagugugaccaauuccuuuucuugauuuaauuagucuagaaauuuuuuuuuuuuuuuuuuuuuuuuuuuugccaauugcuuauaaccaaagaacucuaaccaguucaucauguaaagaaucacccccgcccccaaggcuggcuaucuagaugcuuuccaacuuuauguucauuguaucuacaacucugauuaauaucuucaugacuguuguucuguaucugguuaucuccuuaggaaugacaaugacuuauuugucuucagggucagaauguuuauucaucucuuggucagaaagagacauuuucuugaagggaauguagauggcauauuuuucaaacccucacaaaucucagaugacaguauccuucacacaaaaaaacacaucucagcuggguauaaaaaucuuagaucacaaauaugccccccucaaaauuuuuggaugucauuccccccucaacauuguagggaaguuuaaguccagcucaauuacagcuucuuuccagguaaaacuuugggggccgagucuugauguugugguuguuaccauuuucuucugccuggaaucuacuggcauuuuuuucuugaaucuuaaaauucaaaaacguugucagaagauacauaaguaagagucuuuuauuuuguucaaaacaugacucuuucaacaaauauaggucuucuuucugcucaggaaaauguucuucaauuaugucacugauuauuauuuuuguuaaacuuguucuggcuucuucagaguuccuaugcuauuuggcugaagucuccccaucagaucuggccucuuucaccggugacacaucuguuguuuauucugcauucccaggcagccucucaaguauguucuucacuucacugcugcuauuuuccacaauauccauuuuauuccuuauggcuucaaauacagauuuuaacuaagccaugaacucuuuguucucaaccacuucccuuuaaacucaucucaucaucuucucacucggccuagucccuccucauacaucaccuucugcuucucuuuguugagccagguauucuucuagccaaagccuuuugaaaauauuuuuuccugauuuaauuucauuuucagaggcauauucuucugcacuucaggguauuucccucuuccauacauucugggauacccuuuuuuugacagguccaaaggugagguuuguuucuguuuauuuaucuucaaauaggaauaagcucuaguccagaccugaggacugccaagaggcuaugugugcucacuccuacccuguucuguguucacuuuaauacuggucaauuaugcuucucaaagcuauaauucuggcaagcugacaugcacgguuccuagccaaauguccagugucuagcaagguuucaccuaacauagugcugacagcuagaaacggauucuucucccaacugcagauucaauagagcacaggcauuuucacuauaauagaaauguucuggaagaaccucacgcucuugcaaaacuguauacuaaaaacacaagggcuuaucuuagaaaaaagaaaaguugcaguagacuauucaaaacuaugcuauuucaucaccaaggcauuacaaaaacauuacacagagaacauuacauuaagaaaaacaucacauaguuuuaaaaauauauauauaauaguccugaucaaugaaaaguccaguaaacauagaaauuuaccuuuuaaaaaggugaaaacaguuugacggaacaguaaaaggaagaauuaaagcaucuaaguugcagaacuggagacagccaagcccaacuauaucagugagcauaucaaacugucucaacaccccauuuaaagggcagggguugucagacuggauaaaaaagcgagacccuacuuucccagaguauaaagaggaaucgugugaggagggacuaaaaagcuuuuggagagaggaggcucuguguuuuauaacguacagucaaucuuccccaagcacuauacacccagcuaugugcugccuacaagaaaucuaucuuguuauauuuaaaauauagaaauagauuaaaagauggacaaauguauaucacauaacuaaucaaaagaaagcuguaaugguuauauguauaucaaaguaaaauuuaaagaaagaauacuaccagcaauacagaagaccacuucauaaugauaaagggguugguucaucaagugggcacacaguccuaaacauuuaugcaccuguuggcagggcuucauacuugaugcaagcagugugcauagguauucacucacaccacgauauuuccauaugaguuuacauuucaacaaucaugagucuauaccgagaccucagaucccaacaucacaagguauaaaauaaaauaauaauauaaaauaauaaaagcauaagaagaaauggacaaaucuacaauuauaacugggaauuuucacacccugcucuuaguagcuguuagaacaaguagacagaaaauaagaacagagaagaccugaccacuaccacccaacuugaccaaaaugacauucauggaacacuccauaaacaacggcugaauacacguuauucacguucuuuuuuaaaaacacacacagaacauuuaccaagauagaacaccuucugggccauaaaaccagucucgaauucaaaaggacaagucaagucauacaaaguauguucacugacaaaacugaaauuaaauuagaagucaauaacaaagauauuugaaaauccuaaguauuugcaaacacaucaugaaucaaagaaaaaauuuaaaagaaguuagaaaacauuuugaaacgaaugaaaauacaacauaaaaaucugcagugcuuaggaggaaacauaaguaccaaaugccuguauuagaaaagaaggccucaauucaaugaccuuagguuucaccuuaaaaaauuagaaaaagaacaaauuaaacucaaaauaagaaaaaaaaaacaguaacagaagacaacagaacagagaaaaaucaaugaaacuaaaagcugauucuuugagacuauaaaauugauaaacuucuagcagagcugauaaagagaaaagacaaagauuaacaauaucgagaaugagagagggggccaggugugguggcucacaccuguaauuguagcacuuugggaggccgagguggggggauugcuugagcucaggaguucgagagcagccugggcaacauugugaaacccugucucgacaaaaaauaauaaaaaaaaauaagcugggcaugguggugcaugccuguagucccagcuacucgggaggcugaggugggaggaucacuugaacccgggaggucaaggcugcagugagccaaaaucacgccacuguaccccagccugggugacagagcaagccucuguuccaaaaaaaaaaaaaaaaaaaaaaaaaaaaagagagugggaauuaacuacagauugcacaaauauuaaaaggacaauggggaauauuaugaaaaacuuuaugccaauaaauuugacaacuuagaugaaauaaacaagugccuugaaaagcccaagcuaccgaagcucacuggagagagacacauaucaacacacgucuucgugggccugaauccaucagagcagccgggcugugacacucacugucaugauguuugccuaguggugacauccaaaucaccuccuuuuugcugcacuuauuacuuagaauuccaaggcaaggaugagcuuucacugcuccaucuucccagugacucaguaaucugcuuccguucguguggacucacagauaguuacguuauccgcuguguuauuagucccauacugccaccauugguguuggugcuaaagcgccggccgucgggagcuccugcaaaccagcuccuagguuuuucuggcaagccuccaauccagucuuuuguuuguuuguuuuugagcauuugcuuacuuucugauuuuacaagaugucccugucacagucccggaaucaauggcuucuccagggaacccuggauccauguuugggagaacuguguucggacccaaucuagugcuaggugugcuaacugcugcugggcgacagagcacgcagggcccucucagcaggcagcgcgcguagggacucacucacaccucaguaucucuguaugaguuuacacuugaauaaucaugagucuauacugagaccucagaucccaacaucacaagguguauuuuagucuuccucuuuccuuguuuuuauuaaauaucuuucuaacagugggaaaccugguuccuauuaucuacaguaucuuuucucauuuguuuaauuccgguacacacacaaagucauuucagaaucgcuaaccucuacacaugagaaacacauucacaagaccaccauuuauacacgauucuccuuguucucagccuuaccguauccagguaagacacugguuuccaaaguuaucaggugagugcauuuguaagagaguuaaauuccuugguuagcauauguauuucauguugaguuccccacauacugguugguuuuagucauuuguuuauuuuuuggauauguaaaaaguacaaauauuuuaaguaaaaaaaaaguguuuucauauugauauuugcaauuuaagauuucacagguuuuaacaugaauuucucuuuaaaaacaaagcuuuuauauuaugaaaacuucaaacauauacagaguaaagagaacugugugacagcccacggcaucuagcuucaacgccagccaacacccuggcauucacgcugcgucgguaccuccuuccaccuacacugaaacguccgaaaguuaacggcacuauuuugaaaaugcauauacccauguaacucuauuaccaugugaguuccuccucacuuuuacacgcacagccaagcuaaugggaaacauguuucacaugauguggccagaauccggcugugucaugaacaagagggcuucucagaaucuuguguccucugcgcugagggaagcagaagccacugaaggcuucugagcaggacagaggaccuggggucgggucuaggauaggccgagaugacagaagcagcuuggguggggaccccuucccagagcuggggggugggggcuccagcuacuggggagugcauggagaacaugccccuccacucggucacauacucagccuucgggucaccuuuucagccagaaauggucauucccuggugccucuggugaaggcucacugagagccaggucaccaggaaccacccacagccuccugggaggaagccagugggagcugcgauuuagagaggaagcagaagacucgggaaucuguagacgaguggaucugacaugaggaggcuaagaagccagcuccagaaccugcuggacagaauaucaaugcccacagucuaugaacccuucuuucuggaaaccggcgagaacacagaguacuugagccaaaggaagugagaauucagguuuuacagagcaggcaugcuagacccaagguacaccuguuaggaguucaugguugcaagcaauagaaaauugacuuuggauaaucuaggcaaacagaggaagcuccagcgagugaacgggguagcuggcaaagcagguggagggacccagaggcaggaauuaacggagagucccuccagaacacuguccaaccacaccugauggccugcgcugagccacagcccuugaccagggaagccaggacacccugacaggcagcgccgccaaugugggaccaaugggaaugagggucauuccucgaaggaaaacugaagaaucauuaccagagggggaaauaggacaaggcagacagacgccacagacagccgcaaggggacccggagaccccagcccccgugucacagcuggggagacugagucagcagccaugaugcucaguugggcuaaaaaaguagcuccaacagccacagacaggaccuucagggucugcccaggcacccugccuuccugcagcaggaccccaagcuguucuggcucuggcugggucuguugugacucaugugcucgcuuaucugaugagcaccugccccgugccuggcugcaaguuccacugagagcaaacgggaacauguaucucuucacacccccggacucuggcuuggaaaaaaguacuagauaggaagcgggggcacccgagcuccaccuggucccuuaggaaagaguacuagacagggagcggggacgcccgagcucuaccuggucccuugggaaagaguacuagacagggagcggggacacccgagcuccaccuggccccagcacuagcccaguguguucucucacccuggaccaguuccuuaucaccccugagccugauucuuuucuccccauagaaguacuggguuggaguucaucggcaucccuggugugcuguaggaaaaaggcucuggggccaacgcugucugggaaauguaaguucuccagacggcuuagaggcugcagguaaggacaggaaaggcaccucucucuccaccuccacacccacgucccaccucccagaaacugcuccugaucgccccaccccagacgcucauuccugucacccuacuuucuugcccuuccaaguucuuuccuuuuucugauauuucauucuauguugacauuaaguaguuguuuguuuucucauuaucugucggccccucugccugccccuggcuggaaugugaccuccugcugcaccccuggcccaaggcacacaguaggcacacaacaaaacugugaacugaaugaacguuuuuaaggucuuccuggauuccccucagaaacuaccucacagggggcugaaguugaaagcaaauugcaaaagaaaccguuuucugccuuuugggggcuagaguuaaguuuuaaggaucugauaucaaagauuccagaaauucacaaguuugugguacuuuaagccucaggacucccaaugccucagagagccugcagagggcugccaugagaaagccagagucacauacaaugcagggaacugcuguuggcccucagaauaucuggguuaaaagaaaaacuucacauucccucaugaagaucacaggcagagaagagaaaaauuauggaguuaagaacaaacgauucuacagcugaaaacuaaauggaaccccucauaaagaaagcagcgcuaucugaagcccacgaggaaagcagucuuuucuauuggauaugggaugaaaacccaucagucagcugucugccugauacaccucucuucuuucugcccauuccgucaccuucuccuuagguggugugucuuugaacaacccaacgcaacacucacaacauaaaaaccuacuagaaauuaaaugguuuaauaagacuuaagcaugaucuaguucuuuuuaucuugauguaugugucuaaugauacuucacuaaccagauuagagaacuacgaugaucacuuuucuaagaaaacacauggaaagcacaugcuacuaagaucucaaggauccauuuguuucugaaggacguuugaaauguguaucuguacaucccuaacuaaaauacauucuaauaaauaauagacgaauguggacauauuacaacuuucaaacacaaugccuuuuaggauguauuuuccccuaacuuaccagaugcacuagaaguccacacugagccacagagccugugauuuuaauuuacaagcaccuuuagcaagacagccauggucacucugccaagugggcaguuucugacacugggcaucuguuuacauaaagacaucucucucuuuucauuucugcuccacacagaaucaaugaaagcaaaugcaucacuaacgcuuacguguggguguauuuccuucaccaaacacuuggaaucuaagguuaccuaugguuccuccucccgcagcuuggaaauuuugaaauuuugguugacuuaauuucauggaauaagccauaaaccuuccaaagagcaaaagucuuagaagcuauaaauccaucagagaacauucuucuaaaacaucuuaccaagcuaccacaaagaaaugugacaguguggggagggccaguuuugucccuuaccacacacccuccccaccccauuucacgggcagugacuauagcucaaagugcccaccauggccucagccugccaugcuggugacggaacggccagugcuagugaaccaaaaggagaacccagagucacacaaaggagagcagccugcagaacccaguccagaacgccaaauacacaucaucuccugggcaacagagagccuucaccaaacagggagugaggccaggaugcccacucucaucauuuccauucaacacccuggcagagauccuagccagggcaguaaggcaagaaaagaaaagaaagcaaaaagauuacaaaggaaaaugucacuauucacagaugauauaguguauacacagaaaacucaaaacaaucuaccaauaacuauuaaaauaacuaagugaauuuuacaggauugcugaguaaaaggucaauaauguaccaaaaucaaaagcuauuguauuucuauacaguggcaauaaacaaauacaaaauaagcuuugaaaacaagauaacauuuauaauagcauacaauauuagcaaauauccaguacuaaaucuaucaagagacguagaagaauucuacauagaaaacuauaaaacguaagugaaauuagagaucucaauacaaggaggaauauaccaugugcauggaccggaaaccccaaugagauuccgaugucaauguuuugcaaaguaaucggcagucaaugcaaucgcaaucaaaaucccagcagaauuuuuuugaaaacugacaauuuuacauuuuaaauggaagcacaaagaaccugaaauagcaaucuggaagagaaacaagcuugggggacucacacuaccaaauaucaagacuucuucuaaacuuguguaauuaaaguaaaccaaggagaauaugcuagaaugagaccaacacagagucaucugauuauugugaggauuccaccccaaauccauagggaaaacagggucuuuucaauaugcagugcuugcgucagcugcucuuugaugcuaaaugaaccacagcccauacagcccgccaugauggaaauuaguaugagcuggaucacagaccuaaauguuaaagguaagcaaugaggccuggucuaaaagacaacaacaaaaaauaucuucaggugggcaaagauagacagauguuaaaaagguacugaccaugaaggaaagaaaaugauaaauugugcugcacucaauuaagaacacucauuuaucaaaagaugcagaagagggaaaaggcaagccacaaaauagaagagacccugccacacauacacccagcaagggacggauauucaaaauguauaaauaauucuuacaaaucacuaagaaaaaggcagacaaccugaaugaaaaauaagcaaaacacaucaacagguacuuuacaagacaggauuccaaguggucaaucaacacacacaagguccugcgcaugugugacugcagggaaacgcgauaaagccacaacggaacacuccauacccaccaaaauggcuaaaaucuauaaacgaaaggauaccauguguugguaaggaugugguuggccggcacucacacacgagguuacaaaacagucaacggcacacacccugugggaaaccccucgguggcagguacuacagccacacaagugccaugccccagcaaugccagcccgaggcaucuacccaacagaaagacaucuacgaagacacggcagcauuaucuguaacagucaaaaaccagaaaccucccaaacgugccaaaagcugcacgaauaaauaccuugugaugucaucauaccacagaacaccauacagcaguaaaaauaaacaaacuacaccuauaugcagugacacagauaaaucacagaaacaucaugcugagaaaaagcagacacacacagcagcgccuacuguagggcuccgugugcauaaaaugugaaaacaggcaacacuaauccgaggugggagacauccagacagguuccccugggaggggugggggacggccacugaaggaagaacaagggagcgguggcggggggaacaccugcuccuugaucuguggaagagaaggcagagccuucacuugcagaaagucagcacccgcauaucccuccuggcuuguguacuuuucucauguauuuuauaauucaauaaaaaacuggugcagaccaaugacucaaagccaucuugcaccaagaaagauccaaauaauacugaucugacugguccaugcagcuugcacgaucuuaccuggacuuuccagacagugaggaaguauuuuauaauucuugccaccauuucuuacaaccaguacauguaggagaaauagucaccauacuacuccucuuaaaagaaaccucgcagaaacggaaaagaauucuuucagaacccacgagggugcaaacacagggugcagauuuuaaauggagaaaaaacagggaauucccaaagagguacuaagucagguuugucagacaaaauauauaugaaaucauuuuuaauuuguguaauuaaaugauuaauuuaauuugaauuuaggguaauuaaaauugaaauaaauuuuaagcuuuagaaagcaaacuguugcuauaugacauuucugacuccugucuauacagugaguuuaauaagcacuguuuuccuuagugaaauguggaguguaaggucuggcuauuguguuuuauaagagugucauuuuaugauacguggccacauggcgcaagacuucagauauuuuuccuccauaauuuguugggacagauuuauacuuuaguuucauaauggacucuacacuugaaaguaauaaaauuccauuucacugugcuguaacgggaauaaaauaggaaggauuucacacaauccacaggcuuaugcugaacaaggccaaaacaggcucugcugagcugaggccaccauuccaucugaggcucugauucccccacccucugauucuggaacguucggaagaucagauaccaagaggauaaagaggaagggccaugggagccagcaaggcuaggucuucagagccaugcaugaggcaccaggggacacacacacacacuugcacaggccagggucaucagggucaugcauguggcaccgagggacauggacagacaugcacacacaagccaggguugucagggucaugcguguggcaccaggggacacacacagacaugcaugcacagaccagggucgucagggucacgcacguggcacugggggacacacacagacacgcaugcacagaccagggucgucagggucacacguguggcacugggggacacacgcagacacgcaugcacagaucagggucaucagggucacacgcguggcacugggggacacacagagacaugcaggcacagaccagggucgucagggucacgcguguggcacuaugugacauacacagacaugcaugcacacagcaggguugucagggucaugcauguggcacugguggacacacacaaacacgcaugcacagagcagggucgucagggucacgcguguggcacuggcggacacacacaaacacgcaugcacagagcagggucgucagggucacgcguguggcacuggcggacacaaacacgcaugcacagagcagggucgucagggucaugcguguggcacuaugugacacauacagacaugcaugcacacagcaggguugucagggucacgcguguggcacuggcggacacacacaaacaugcaugcacagagcagggucgucagggucacgcguguggcacuggcggacacagacacacagaugaacgcacaagaauaacuguccguuagcagcaacagagcaucagcuuucuccauggaggaaaacagacgucagcacugaacuuucuccauggaggaaaagagaugucagcacugaggcccuuuugcagaugccuagguguguuuauugccagucugcguaagcauaagaguggauaaagauccacauucuggccuaugaucucuagcauguacaaacuuauugguaaaauaaacucuggagaggaagaguccaaauggagaaggcauccagauaaaacaagacuuguuuccguuugcugugaaauaaaagaauuucagagaaaaagauucagacagacacacagaaggcccaaggauuugacuuacggugugaaacgcugggcucaauggaucauuuaacaucaacugccaugaacaccccgagagagcaaaaggccaguggggucccaggcagauggcugcaaccccacgaaggaaaacaugacuuaucccugacuuaucccugcccuacgcagggcacccccagggcaggugacaaacagccccagaaccuuaugucaguaccagacuaaguaaggaaagaucucuuccaccauaaccaccaugcacccaagcacgcguagcuucaccaacaacgggccugaauugagcuucaccaacaacaugccugaaagccuccgucacugacaggcacuugcggauggaaaacaacccuuugacaaaagacccuaucggccaaauaagugaucagcccccaggcccccagccacacagaaacccguuucuaaaacagcgguccucauaaugcgaucuggggucccagaggguccccgagaccuuuacaagaggugugugaagucaaauuuuuguucauaauagaaaaaugucaugugcccuucucucacagggguacaguggacauggacugaacgagagccggugugagaagcagaaauacugucgccauuaagccacaccuuccauagacuggcaaaggguaaaaugaugccucucuucucacgacgcuuuguguuuuaccgaacgguuauuuuuuguuaaaaauguuaccuaucuauuuaacauguaauggguuuauucaguuucaaaugaguaagcacguuuuuuagauguguguuaguuucuaauacaauaaauaccaauacagguugagcaucccuaaucuaagaauccacaaaccaaaaugcuccaaaaucugaaauuuucugagcaccaacaugaaaacccaaguggaaaauuccauaccugaccucaugugaugggucacagucaaaacuguuuggcgaacaaaauuauuaaaaauacuauaugaaauuaccuucacauuauauguauaaggugaacaugaaaaauaaauuucauguuuaggcugggugugguggcucacacuaaucucagcacuuugggaggcugaggccgguggaucaccugagguaagccuggccaacauggugaaaccccaucucuacuaaaaauacaaaaacuagccagucauagugguguaugucuguaauuccagcuacucgggagggaggcugaggcaguagaaucgcuuaaaccugggaggcggagguggcagugagccgagaccacaccacugcacuccagccugggcgacagaguaagacuccgucucaaaauaaauaaauaaauaaauaaauaaauuucauguuuagacucaggucccauccccaagauaucucauuauguauacgcaaauacuucaaaauccaaaaacucugagagccugaacacuucuggucccaagcacgucagaacgacagucagccugugcaucucaaucauugaagcuaaagcucuuuggaguccaugcuaauuugcaggagugugaagggcuccggaguuugagaaccguggcucugcagguguguuccaacccucuuccuucggagacacaggagggcccugaaugucagaugugagggauguggggcccgcagagacacaggaacuuggcugugaggaauucagggacuagcaaagggggcgaugagaagacccugaaaugcaccguccaaagcacaguaccaucuugcguggcuggcgcugcugcauuucaccuuucuucacguggagggggucucaucaaggcagcagaacagcuucuugaaacaaacucaagauugacagggugccaagcaagaaaaacuggaaacugacgugucccagccgcccacccacuuccuucuccauugggggauaacagggggguacaagugaagggccuccguccugaggagaggggcacaggcuguuuccuccagacacagacacuccucaguggucaggaccguccucuccaugccugucucaagcugcaggugccucuccugcccaggugaggugggagaccugggcaggcagcccucccuguucugcaggugaggugcuuaucacugcuggaguggacccuccuaaguguugcguucuuucggaccaaagcaguaaauaaaggugcuuugauuccaggugauagcccaaguuccuccccaacucuacucaaaacuaucgaugucggcaucgacagcugaggcugcccugcagaugggaacccgcagacaauccugguaccugcugcugugauuauucacagccgucagagagcccucaccuggggggaggugaaugccaaccccacgggugacacaccacuccccuggugaccccagggaagcugcaggaaggugacaaaggaccugcacacacaggcaguggacaggcucgccggcagggaggaauccucucuguuugacaagacacagacaggcccucucuggugacagucuccaagaaaggagggaaggcuuggacagaugccaacaagcgggaaggaagacagcagcacggcccauuccccgacgguccccuuucaucuuuccaggucugaacugcccacaguucugaguuuugggucccaauaaauggacgucuggaccaagagcaugucuacgguuggagcucacaccugcugguggcagcaagccgacugcccggcggggggugggcagcccgggagccacagggcuccccagagacagccgcuugggcugcaaugucuccaagcuacagucccgcuaacccgguugguuucccaagcaugugagcgaaacucagagguucguuaaacuccuacuuucuaaguuuauuuauuguugcaauuguuuacaaaaagcauuuuuauuuuaauguaaaaagcaaagcuauuucuauuuuaaaauaaauuaaaacugcugcagauaaucaagagacgggucaagcccugcucucauuuccgcguacacgguguagcugggcaugaaguacuuauaaacucaugaagucaagaaguguucaacacagcgccucggaagccagguugcuggaugacacggcccaugacgucucagcaggccugggccaccuucucucaagcagaacacacagaaucguagccaccuuucauagaaaacaacggaaaugaagagcuuaaaggagcugaggacagugcagggugcaugaaaggaaguggcacagaugccugaaggcuuguacugaaaguggcgucaugcccugaugggaacuucccauuccucccuggugggcggagagaaucauaggaccgccacauccugucaucuccacuuuucuuucucuuaaagaacagaugauugcagcguggcuggcgacacacuucaugaggcagagaaaagcacgcccagaugcacggggcccuguacaggacggcaggccgucugcccuguguccccgggacuggcaggucagugaggguagcaucccgacuuuucccaaggggcucugcggggucaaaacagaguuuaaaaaugcaaagacaaccaugcaacccuuagccaugggccaccaacaaccgucagagaguggugcuagagguccaaaaugcugcgcugagggaggcaccccacagcucugaaauguuccaacucccucgaucccacugaaagacauggcucggggcucuccuguuaaaggguagaguaaaagcagguaugguucucgcaggcaggagacaggugccacaccaaucaagaugcaguuuuaaagacugcuacuuagcagacuuguaaaacuggauuugcccagagacagaccaaacccagucagcacgggcacucuggacucccugcagcgccccccugaauccaggccucccugcucccugccuugccagcccuggggccugugaagcaugucugguguuuuucaggaggucaugcacuguaugguuaacggcaacagauagugcagagcugauccugcacagcggccuccgggagagcaggacucuugugcuggccaggcaccugguggaaaggcuggugcaccugcagcccugcggcgccuggaggagccgagcagaggagcugguugagcacccacuggacuugggcuugaaaaccugucuucacagcucauccccgcaucaugcugggucuuuucaaaaugaugaugauuacuuuaagaacguuccugggaugaauuacagacagcuaaaugagucauaaaggugaaggaccaacaugccccucaucuccuaguuggauagucgaugacagcugccaucuagggcaauugcucuaacccucugcccuuuggagccacugaugugcagcugcuguccacaccacagggcuucccacagccugucgcccccagagucagucacuccucagcuccuggcagccacagggcaggccccagcugggacagggaaucacccaggacagaguccaccuuuguccaggcaggaacccugcgccucaggccaccuugucugugcagacaccuguucuggccugcaccacggccccguccacucaggccaggcuccaacaaggaguccaacauauaaacacgugugucacucacacaugaccucaaacucacacacucaaucacauacacacauccuuauacacucacacacacucucacauaaccacaaacucacaaucaugaacacacucaaacacgcacacucaaacccaugcgcucauauacuaacacuuauacacuaauacaaacacaagcaugcacuuacacaaccucaaacucacacauucaaucacacuugcacacucacacccaggcacucacacacacuaacacaaacacacaaacaugcaugcucacacacauaaccuuaaacacacccgaucacauucaugcaaacaugcacucaugcucacaguguaacacacccacagacauucacaaacacucaugcucacacauucacacucacaaauacacucauauaaccucaaacacacauacgcacggacucacucacacacacacguguguggcaacagcacaggggaccuggcucaggcauggccgcacaagcaggauggagacuggagccucugucggcguggcccgggccuuuaccuguggucccucaaagcuuuugcacaaagaugaggaucugggccugcgcauccggcccugccucauucaccuguauuguuaaaucggaaucaagugauagcacaggcauggacccaaaacagugaagagcccguggaggggcagggggcagcauccaucagagauuucaacaaugccccacaaacauccagcagcuggcggacgggagcagcugcacccgcagagcugcaaagcagaccagggcagggcgcguggguggcugcucggccagaggcauccucaaggccccagacugcugggggucucuccaacgagggcaguagggugaagcaggaacccauaggaaccugauggggagccucccugagggucucugucucaggaacuccuggacagugggccccaggacucuccucugcagaaccagaacagaacccacugcccgaggcagcagguggggaguuugugauccagagaaaaggcccucaagccggcacuggaagggcccagcuacucauccgaccgcuccccauccccgggcccuccuccuuacuccugccuuuaagaagcaacaccucagccaugcacucccauuuacaaaagucguuguuaccacaagaguaacaccaccacacaaagacacacacaggugaucucugucccuggcucccuugcaaggccaccaggguccuuccuugggcugggcucccgcgcacacacgcgcgcacacacacagacaggcuucgcuucugugagugcccaaagacucgcacuccacacgcugcucugcagcucccacuccuacaucccggccucccgguacaccaggagcucugguccccucucucuacagaguguacgcggcaacacgcacaagcaagcaguuuauacacagcgacagaacagacacacugcuucauguucagagcaauagcuucuuucucucuuuccugcucucuccaccaucaaacacccaacaggaaaccuuugcgugguugcuguccacacuucccuccauuccauacacauacacacacacgcacacacaugcucacaaugcacacaugugcacauauguacacaugcacacaccagguggucacugccuccaaaaaugaaauuguauccuacagacuucucagcaucuuccguuucucauucaauaccaugucucgggggaguccgucacguggcugugccaacauuuagccaagcauucucccacucaugggcacagacuuuccuccaagcguuugacucuuaccacaacacugcaagagacugccgggugcaaagagccucacguccuggggucuguggcccuguggagcacagcccugggagugggggcugagugaaguaucugcuuauuucucacaucaggacaugugagcagaacgaccucuaaagaggcugcagccgcgcguaccuccuccagccaugcccgacacugcugcggccucuacauccucccuuguaauggacaccaucucucuugccauauucugccaagcuagguaaaaagcacgaucucugcugacuuuucugggcaucucccugggggcuggggaguuugggcaugucugcaacgaccccucuucccugggcugccuggucacacugagcguucauuuucuaauguuggucuuucucuccaguuuggaagagaccucuccauaguaaacuuuuuguuguuguuguuguuuguuuguuuugagacagagucucacucugucgcccaggcuggagugcgguggugugaucucggcucaaccuccaccucccagguucaagcgauucucucaccucagccucccaaguagcugggauuacaggcgugcaccaccacgcccagcuaauuuuuguauuuuugguagagaugggguuucaccaugcaggucaggcugaucuugaacucccgaccucaggugauccgccugccucagcuuugucaaauguuacacauauuuuuccaaaacucucauuucuucauugacuuuguugcuaauaucuuuauccacucaaaaguugucauuuuuauucugucaauugcaucuuuguccgcuucuagagauccggggucaaugaggacggguccuugaugccccaauugucuuuggagauuucucuugcuuuacuuuuuacaguuaagccuugaauccaucugaaauguaucuuccccucauacuuagauaugaacaauugaccagccacugaaaaaguugaagcaagaaaaagaaugaccaagguacacagaaaaacugagcccggaagacacagagguaauucaagccccucuaaggagggacacugagaacagugaugcuauggcguccgcagaacaggcaccaacggaugcaaagcagaggcgaucaggcagcagggccuggaacuucagccggugaacagcagaacaaaacugcacagaggaccugggagaucacauugaguaaauaucagagaaauaaaccaguagccaaaauggcauucacaggaaucccaccaaaggaaaacacaggucagaggugcugcagggaaaugacaaugaugccgacaaugaugacgagggugaccaggagaggaggaaaccaccccagaugaauagaaaacaaggcuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccaggauggucucgaucuccugaccucgugauccgcccgccucggccucccaaagugcugggauuacaggcgugagccaccgcgcccggccaacaaggcuuuaaaaauuaaguuaacucaugugugcuaaaugggauaaauuuuaaauuucagaauaucaaagauaaucagaagaucucaaauuucagauaaaaugaaaauaagacaccuaaaccuggacgagagccaagcuggccacagguccugucagcugcacaggcccacccuggcgguacgugaagggcagcgugcaaaucgggcacccuguguaagucagagacccgaucuaaagagagggacggucccuaaggcucacggccugaagacccaggugaggggugacgcugccagggcaccuggacgggugggugugagcuagacagacucaggaguugccugcugcgggcaggaagggcagccgcaggggucugaugggucagcugggagaacacgcagagccaggcaggguccacagagcugugaagaacacugacauugggaaccaggcagcaggaacgcccagaugugccuggggcagggcagccacguaggaagaagucagcagagccaggggccugggaaucagaggagcagagggugccccgggaggugccagagccugcuuggucucucugcuguccugcaggccugcggacuccgcccacccacccucccauccacgcaugucccuaaauguucccugaacaccugccaggccacggaccguccacucacuuguccucaccgggccagcgaggaugccugguggcccacggccagcccaaccccaccgugaggaugugugaagcgaagccccugccucaggccugagcguccuccaugcagauucagccccaccagggcaacaccacugaccucagcgaguggugacgccucacagcguccacaggauggcacucacgccuaccuggcacacggacaccacggacgcuacaggccaucacagccuuccaguaugacugcaggagaggguccugccaacucagucacgcacaggcuccaguggcgcagcagaagggcagucugggguggaagaucgcauggggacgcugcuugccauggagcacccacugccaggugcucuggacgggcguuuccuccauggccccccagggggccuggggagucugggcucccucaaccagugagugcccccgacugcaggcaaucuugcccagcccaggccucuugccggcccuuaugggggagggugcuggagaagaggggggugccuggcagucaccccacccgacugcgagugucaccuggaccacgucauguccuguccacagccugcuggacgcccuggggccagccucgucugacucugcuucaauguguccuuugauggucccuaaagcagggcuggcagguucugggcaaugauguuccaccauccaaacagcaaggcaggugcugugugcucacaacccuccaccauccaaacaccaaggcaggugcugugugcucacaacccuccaccauccaaacaccaaggcaggugcugugugcucacaacccuccaccauccaaacaaggcaggugcugugugcucacaacccuccaccauccaaacaccaaggcaggugcugugugcucacaacccuccaccauccaaacaccaaggaaggugcugugugcucacaacccuccaccauccaaacaccaaggaaggugcugugugcucacaacccuccugauggugcccagaugugaggaaggugcugugugcucacaacccuccugauggugcccagaugugaggaaggugcugugugcucacaacccuccugauggugccccagaugucaccaccgcgccaucagaggugggacacagacucugucgaccgcccuggcccgaaggcacgugucuacuaccaucaguaacauggccuccuggccacaccacacacaccaccugccgggagcacaacacccgccccagggggaggugaugaacgccauccagccacagauugcccgggacgccuaguuuuuuguuaguucagaccguguguuccugaauacagccugaguggccacacuugaguaacgauuaaaaagccacagugcucaacagaacacgccacugcuaugacacaaauccucauaaugcaggcauacggcugggaggcagggucucgguggaaccagacucccugaguaagcacagcacaaaauguuucugacacacugaugacaacuacagcacaaacugggguugcacgaugauagcaaguuucaauaauaaguggcucugagugcagguccuuauuggaaggggagcuauuccacgcccgucccuccuggacauagaccacuuccuuacucacaccacugcccugccagacacggucacuuggaaccaacaccuuacccgugagcgugcuucagagacauccccagccugcggggccucugccuucggugcccagaugcuguccucccaaagccggggugggcugcgcuccucuauggcagcccaaaggcuaccucugcucacucugacucugaacuugaaaccaaaagcaguuccccaggcgucagcugccccagcucaggcgucgccaccacagguuacgaggccguccacuaaccgaagccacugccagggcgcuguccacacaggugcuggcucacaggccacgugugccucuggaggccccaaaauguccagggccucugacuccgugacucucuguguugccagcaugagaggccugcuccaggcugcaacacagcaccugucacgagggcugccccgacgccugcauccucucugccaccaaugggccucucuggacccuccuggaggcccugucuucuaugcagaucuccacaccucucagugcaucaccacaauggagggagcacgagauucuccuuccccaaagggaccuaugauguauccugccucacuucgcccagaccaccaaccuggagcagccgaggugcgggcaggaggccccagggccacagucucaccacuggcuucucacaaggggcagggcugacagcucaucuggcugggaccaguauuaugugcagagacccaacguggugaaaagacccccaggacccuagagcaccugccaggaugcaagacggacaucucagacacaacugggcacggccaggcagacaagcccaggcccaagacugaucaccgcgcugagcucagcugccgccaccuucugcugggacugucuccauaugccacagggggagcgccccaccugcuugguuuuacacccaccucaaggaccucuaauuuucccugaaauaggaguucuauggacaucaaaaugccugguuuucaaaaagaauuauggccauuguccuccaggggagacgucgcguccugaggcauccccucuguccagcaaacgcggugccccuccacucagccaacauccggggaaugccagcggcaggugggugccccucucagccuggggacaugcccugugcacauagaucuggcccgggagacaccucuuggacccugaggcgucugucgaagagcagcccagugggcauccgugacagcuuggggacuuccuuccuuccugggggagacgagcacccaggcacauaaaguccagcggugaccaggguggggagggcacuaaagcagaguccaggauggagacggaguuggcagcugggguccacacgaugauggccuggaagagggaaggcguuggccccggggaacgaagagcugagucacaugcucaacgugaccacggcuguucugacacugcgccagggcuggcacccacacugaacgugcaccacccagauggcagcaucacaaggaccaucguacuguugagggccauauccagaggucccuguccucaccucccacucuccucugcaggccuccaugggcuccccucgcucucaggagccagagguggccugaaacggccccgggaaccaagaaccccgggaaccaagaaccccgggaaccaaugaccccgggaaccaaugaccccgggaaccaaugaacccgggaaccaauaaccccgggaaccaauaaccccaggaaccaaugaccccagcaaccaaugaccccggcauguccugggcucuucucuuguucacuugagggauccaugcaucuccuacucuccuuccugccuuggcagagucggacaauuuggccugaggcaaaacagucuuucgaacaaagaggacacaccaggccuccucgaagacugccaagcucugucuaguuccccaggaagcagcccucuuuccccucauuuccaaggaaaagugucccaugcugggcccgcucacucacuggcacacagcagaaucuucagugucagccgcaggggugggacgggaagguaaagaggaagugcccuagggaaggagacacaaagggaagaaacgcuccucaggcuaaguaauucagaagugacagggagcccaggggcaagucacuccaggaaggcaggagcuggggguggaggccgccaagaaaagcuguuccucggaggacagagggagaguccagccagggggagugggcgcuggggguggagaggaaggaagccaggugaccaacccaggaaggugggucccugcaagugcuggcucccgcgcaggugggcgagccccggggagacgcaccaggccggugccaggagaaagcagagcgugugaugaugcugggcaugcuggcagucacugacagacaccaagacucaccccgucuacccguuguggagccacugcccucuucugccugucacccuccagucccucaagcacagccccagcccagccccaucaaggucugcuccuucuuacccaaggagguccaagcucccaggaggggucuggcagguccccucggccugagcuggcccagugcccgcccugcucucagggcaccggcuccuggcagggccucccuagcgcuccccacagcccccaccuugguggcccagucaucuuacccuaucuucagagccagccugggcaccauuccccuggcagccccaaggagccccagggugggguaagcgcccuuucuccaagccccccaucggcugccggggccccuugcucauccucuccacugggaaggccagagagcagccccugccccaccacggggucacacucaccacagggucacaggaaacaaaggacagaagaacaccaagccaggcucagcaccugcacgcagacacugacagugggauagggagacaguggaaugcuccggaccuggcugcggggugacucggggggaagcggaugcagacugcaggcuccaucuggcccgugguggaguguggccagccugccauccagccgggggcgccaagacuccacugggcugggagggcgugcacgaaaaaggggaugagaccuggggucgggggcgcggcgugggcccaugggugccagagccaagagggcccucaugaggcucgauucauucagagaaagaaaacagcacaaucaguucuggagaucuggaccagaggaauaagaagaaaucccacugcggaaugcgcgagcucugcaauggcccgcgucuuuggguaaaucgaggaugggcauaugcacacacacguccgugcacacauuuaacuucuuauauaauucauguauuuaauguacauuuacauuaaauuauacauauguuauaaauacacauuuacuauguauucuauauugauaauauagacauauuuuaucuauguguagcuauaguuauuguauguauaaacauuuguuuuuucccaucuuucucucuauaguuagcaaacauuugaguucaccacgggccugacaguaaccuuguguuucagaagaaccaccugccuuuaaaaacucuaauugaauagcuauuuaauggguguauguuaauagcuucaguuuugcaagaugaaaaaauucuagaaauugggugcacaaccacgugaauauaauuaacacugcugaacuguacacuaacaaaugguuacaaugguuaauuuuguuagguguuucuuaccacaauugaaaauuuuuuuuauauuuaaaagccggaaacacacacacaaucaaauaaauugcccaaacugcuuguucacauggauucuuucccgcuuuguccccaacuucagaggcauugcugcugccuaccgaucuccacucggccuucacgucccaucucagaaaacgagggaugcccgguuuaaacguucccguacacagcgcacacuuccuguggaucgaggucaccccucagcagcgccucccggaugcaaggagcaaacacggguucacguccugauagcugagaaaaugacuggcagugacugaaacaacagcaucccacacacaacacacacaucaggauguuuaaaguauauuuauggugacugagcugucaccugaacacgugacguacacgcgaugcucugaggaaggaaaccgucuaggaaccaagagucacggagcugccucccgcgaccgccuuccucaaucacuacaaugaaaacacgcagugagcugagcugcagugaagacaaaugacucucagugcuucguuuuagcauauucuaaaaaugcaauuuacaauucagcaauauccuuucuuuuuauguagucacuacaacacaaacaugccucuuuguuaucucgaacuacaucugcaugcaaaacacgcucuggcugggaaaauguaaguucuggggaaucgaaacccauuuuucaaaucugaaagagauggagaaaugaaaagaaacgaaaaggagaggagaaagguacauuuuauucacaugcaaaaaaauguaaaugaaagcugguuucauuuccucacccccaagcugguaaaugauguauguaacuugucccaagaguuuucaaaauuacuauuuaaguucuaugacuguacaguggaacaaaauccauacugggcaaaugcggugccauuuacuucuaaugcuaaauaaaugcucauguucuggacuuaaugacaagagagcuucucacccuagguaccaaugacauuugcgacggacaauucauugucccaugugcuguagaauguucaguggcaacccuggcuucaaacuacuacaggccaguaccacgcccccagaugugacaaccaaaacugucuccagacacugacaaauguccccugggggaggagggugcaaaaccuccuaggcgagagauccccuaaaauagacucaagccagagugacugaagucaccgccccccaguuccacgucacacacacacacuccaucagcugagacugcucacugggcuuuggaagccagggcaacacagucccaguugcucaggcccccaaagccaacagugauacagaucacauacggcucccuagggccaagggcucugcuuccccaagggcugggaucuccauauuccucagcacaaucagcgacagcacagacucacaccagcaggagcugccuucccaaguuagucaggaccugcacccacguaacagauuaaaauuaggcacgcuaauuguuaaacugucgcugcagaagcugggaauaccauuuuuuuaaaugaauagaauuaauggauucuuuauuugcgugcauuggugauacucagccugucuuuuauuaucaaagcaaucauaaaacgucgcuucugccacauaugcaaauuaaaucauuaguauuuuucccaauuacagcaacugcuuauuuguauugcugaucuauucuaccaauuuaguuccucuaauauuaaugauacuggaaaugcuuuaauaaaacucucaggcaauacaagauacacauuuucuacuuugugccuuucugaucauguaauggguaggaccacccagagugacccagaugggccacgucucagagacugaaccccggagccacagugcucugcccucuacaugggcccccaaacagggcuucccugacuccuccccacaaaggggagaaacagcccagggguccuguggguggggccaggccaggaaaagccagcccaccgugaugggagcuuucuuuaacagcuuacacuuucuuuuucuuuuuuuuuuuuuagacgcaguuugguucuuguugcccaggcuggagugcaauguugcggucccggcucacugcaaccucagccauccagguucaagcaauucucuugccucagccuccugaguagcuggaguuacaggcaugagccaccacgacuggcuaacuuuuuuguauuuuuuuuaguagagaugggguuucaccauguugaccaggcuggucgugaacuccugaccucaggugauccacccaccucggccucccaaaguacugggauuacaggcgugagcaacagcuuacacuuucuaacaacucaagugaaguguucauuucacuguguaacugcccacguuacaggcaugguuggcuuaauacccaguguucuccaacacggucucacaguccaguucacggaucucaccccgcucacccaaaggcuccccuugucgaggaagaugugcuuguuucccguggccaccccugacccuggcuccagcccacagggggaauccuccaccaugaugccccucacaagcaggaggcccuggcacugcucugagcccugcaccuucccguaaagugcauaaccacugagcagauccucgcuuggaggcuggacaaacgucagugucugugaguucagaaucugaaagaaggauaaagcugccucucgggagauggagcagggcuuggaaacagaucugaugacaugugggcaggcaggggcagggguggcagaggucggcuucuuaagcacucagccggaacaggugccuccucaacuggcuccucugagcgccacagagaaacccacggcaagcgcagucugggccacaaugaagcaacaaggaagcaguuaguuuugcaaacccaauacgcucaaagagcgcccgaucaauccauuaccauuuauucccucucuguaccuggugggagaaagcgcggcaacgacaccgccucagcagcucucacucaagggcgugggguggggggcaggguagagcacugccucgggccagcugauggccccucccucaacgauggccggggcaggaauggacaacagagacuggaaagugagaaaaaugauacaaaguggaaacaggaugcagacaggaugaagcucauccacacagucccacagagucccccagacagcaucagccccgccaacaaggccagacaaggacagacgugagagccacuggagggcagggcggcuggaagagcugccaucgcuggcaccugggcaccgugcgagaggccuacugacgugaguaacgaggcgcaguccacucucgccucuaaugggaagccacgaacagcccggacacagacagagaagcagcucgugggcaacccuccaucgugcucugcaaaggcagaaaacccagggggaccuggcugcacaccacaucgaugggaaagacacccaggcuaauauuaggggaugcccagaucccagguccucuguaucagcuguucguaaucugggauaccugcgugggcugaaaagauccaugaucucccuaaagccacauucgaaaugacauauuuuaguaccucucucuaucauauggaaauguuuaaugaaaaagaaaacugaggcuaggcaugguggcuuacaccuguaaucccagaacuuuagguggccuaggugggaggaucccuugagaccaggagcucaagaccagccuggacaacauagugagaccccugucucuacaaaaaaaaaaaaaaaaaaagccagaugugguggugcacgccuguagucccagcuacucaggaggcugaggcaggcagauggagagagcccaagaggucaaggcggcagugagccaugauugucccacugcacuccggccugcacaacagaucaaggcucuaucucagaaaaaggcaaaggaaacggaagaaaagaaagagaagggaaaacugcccugcauccgaaggaauggguccuaggcggcaacaaugagucugcuuuguuucaguggacauggccccagcaccauauaccccacggcucuguccccugcuucugaucccuaaaaugccgauuuguauucaaacacauacaaagaugacacuuuaacaauacaacagcuuaaauaaaacuuccaaauacaucagcccucggaccaagcaccaggaagaugagacacaggcaggaccugaggaggggcucagggcuccucucugcaccccaccgggcccagaaacugauggggaggugcacacccaagggcuccagcgagccaggauacaggagaacagaacugcggacauuuugugcacagggacagggacaaggcuuccauggaagagcccuucccaucccuucccuuccaucuuggcucucucuccugagaagggcaccuugcuucccggccgccuccacaggacuggcacaaucggaggcccauagccccugacugcuuugcguggaggcccucuccccagcauccccagcaccucagcugaaaggucuccuccaagccucaggaagaagccuugcccucagcuucccuuagccagaggcgacacucuuggagcucaguacaugggggcacacagcgggcuggcugcucucagcaggaggaagcacuggcuggcagugucaggagguuccgggggccuccgggucaccuccgaggacugaagaaaaggaggcuccuggcccacgacucugcccagcucagcagcggggaagcucugccuccacccggcucccuguugguggccagagcgggaaggcagagcuagagcauggaaaugaguggccacaggggccccuguucccucugaagucucagccucaagcccccugccugccugugccaggagcccuugcagcuucacgugcacagcacagccuaccagugggcaaagccggccugugauaaggaacacgcacacgccugucccugauucuacagacgccaccccaggagccccagaaggaccaugugauacaacaggacacagggagccugacugcagccucguccauuacucacuacaacucacaaaggggacaggaggccaggcaagccacggugagugccgaggaagccacggaggcugugaugacccuuccugccgguacagaaucaaaaagaggccacugggccccggaaagcgguccaagacagucuccuacagcucugcucugggagccccaaacaagccccggaggcaagguaaacagaggcccagggacaggaaagcucaggugugcccuaaacaagggcuaaacaauguggccagacccaaggaugagggagaaggaaucugggucggggaggcugggccaaacccuggaagacccggcaggcaaggcagaggggccugcguuuuacucuagacaaugaugagccacaggaugccaggaccagggcagagaaggaaggcugagagucggagcacagggaagagaggcuggggccugugucucggagguucagagccacugucaggucccaguccugacugugcugcuggggcuggggcggccgcacagggggagucaaggucacagacacugagacucaaaugcucaaacggaauuagaggcauccucaguuucuguacgaaaauggguggcacuggagggacgaggaaagaccaaagagagaugggucacaccagaggcagaugagugugucccaaccacgggaggaaccacaugacagagguucaaaaccaccuucccaagaggagcgucagcugagggugcagguccugggggcaucccgggguggccggccaggggagggugcgaggccucuggagcccacggauguugguggguaaggcguccaugcagaggcaugcuuggagcaccacuguguguuccagacaagccgccagaccacgucugggccugaaauuuaacaauguaaugcacuguaaggaaaucccaugagcaccggcuuuagguguaagagcuugacuuucauaaacaacguagucacgaccuagaggagcaagagccacaucccagacacaguaccgagaacuucugcucguaacaaggcuggcccuuguccagagacagcccaguucuaacagugaaaacacaguggucucccuggagagaagagaagcugggugagaacugugcaugagagaggauuucgccacccucaccaccaucagauguacccauuuuagagaaacuccacccuuccucauuagguggcagcgaucagaggugaguggcuguucuggguucaccaggaaucacgccagaggagccagacugcacacgacuccagugcgugagcacgugugugcagaugucuguccgugcgucuaucuguaugagggugugugcguguccggggagcacgagugugugggugggaaugcuugcuguguguggcacgugcacacgcacguacauguguguugaggaggaagaacacucacuagggcugcaguccuagaacuucagugggagcuaaagacagagaagaggggacugcucacaaguggccuggauggggucacccacugaagcagccgcgggcccacaagcaccagaauggcugcagcaggggcuggagaguggccagaagaucccccggugcacccaggccaggaggccacuuccagccucagucccgccgcugcgugccuggccaggaccacagggccggccgccaccaacgcaaugcccaggagagccucccaccccuuacuuuacaaaaccccccaccuucgccuggaagaaaccuccucuuagaggugugcagguuugagguucucugccucucccuccagccuagagacaggacgaggcacagcacucugugaccagagaaagcuccagccugucuucaggcagcaucugugccagccuugugccccagcugacagggacaauacgcuuuauacccaaaacaauucagccagggcagggauacugcaauucugaucguguggagaagaaaaccgaggcuuagagcgguugggucaauggcaccagagcagcuggaacguggcuccaccaagaugcaccugggcccuaaaaagccuaaaaagccgagcuccuccucacucuacuuuccaacaagagugcgccccuggaggagccgcgccuccugccuggggcucaugguuccaccacgcauugcaaugggcacuaaggggaguggaaggcgugggcucaggagcagcagccagcucagauccacacccccaccccaccgcucucgcuuggggccgcaguggccacagguaucagacgggaggacggguauccacgccacaggugugcagggacuaacggaccacacgucauaacauggggcccagcacacagaagacacccacugcagaaacauggcaggacgcggcugggcagguccucccugaagccgagggaggcagcgaguucauucaccucauagcaccugggguuggggaaaggcugggccauugaccuccuguguuacuuauccugacaacaguucuucaaggaggaaacccugaagucugcuuugcagauggguggacccggaugagggagguggcaaacugaccacuguggcucuccgcucgcuggagggccgcaagccuggacuuugaagcucauccaccuaaucccaaagcacauuccuucuaacacaccacuugcccgcagggaggcagaugcggucagugcggcuuccaggacuaucugggcccgggccacguuugcaucggccuucucaggcaccugcccaccucugcaugggacagaugagccaacauggcucaacccuucucuggagcauccucagaugaccagcagagccuugguccucugggugaccugggugccuggccccagagggcagcuggaccgcacggcuggaaggaccacccucugggccccccuuuggcagccauggcccugauccguccuccaccauccuguggguuggagcccccaccccgccccuuggggucacugggcugcagccgcagggacucugccacacaggcuccucccuuccuggcccccacuccccacucuaagggccccaggcuucucugcauccagccagucaucagcggagggaguguguggagggaucucccugcugagcugccauuacuucuauccaccuuucccacuggccauuuuggcacacuugggcucugacuuccagggccccggguuuucccaggaagcagcagagacacagggaggccacuguguguuagucuccacugccagagaacccugccgagggcuucucccacaggcccugggagcccgcauucugccucugggauugagaggugaagccagcuggacuucugggucggguggggacuuggagaauuuuucugucuagcuagaggauuguaaaugcaccaaucagcacucuguaaaaaugcaccaaucagcacucugugucuagcuaaaggauuguaaaugcaccaaucagcacucuguaaaauggaccaaucaguaggacguggguggggacaaauaacggaauaauagcuggccaccccagccagcagcggcaacccauuuggguccccuuccaugcuguggaagcuuuguucuuucgaucuccacaauaaaucuugcugcuguucacucuuuggguccgcacuaccuuuaagaguuguaacacuugccgcgaagguccgcagcuucauucuugaagucagcaagaccacgaaccugcuggacagaagaaaccccggacacaucugaaggaacaaacuccggacacaccaucuuuaagagcuauaacacucaccgcaaaggucugcagcuucauucuugaagucagugggaccaagaacccacuggaaggaaccaacuccggacacaggauggggcccacccugcccuccuagaggcccgcuaagggauucugaggcgagguccgcagagcguucaguguggcacccaugcacacugagcccacaccaagacuauucuggaacugcugcugggauucaugaggcacgaggagcuaaauucacugaggacgcuacuggcggcuuuccuccucagcaucuguccccuucccccuuccuuccugacaucagugaauuccauaccagggaggccaguuccccagccggcuucuggaagaggcauguccagcacccaggcugagccacucggugcgcucugcaccccggucacagugacugguucagaguucaauacguggcuggagccagaccgaaggagagugaauccaagacuugcuaagacaaagaugcuguccuuccugaugggugugaaccagccaguguauauaacccugggagcagcgggcagggccuguguaucccaugaagcugacucuccccagguagggcaaagaaacaagccccagaugacacuguggaggagcuggaucaaacagugccugaauacuuccuccuccggcacuuucuaggaaaacaagccaaacaauucccugaggccacaguaccuagcgagauccuaucugauggggagcuaccagaaauaccucccugcucaauaccucccucgaagccagccagguacaguaccucacgcuuguaaucccagcacuuugguaagccgaggugggcagacuguuugagcccaggaguuugagaccagccauggacaacauggcgaaaccucaucucuacaaaauauacaaaaaauuagccagccaugguggcaugcgucuuugguuccagcuaaucaggcagcugaggcaagagaacugcuuaagcugggagaucaagguugcagugaguggugauuguacuguagugaguggugauuguaccaguacacuccagccugggcaacaaagcaggacucugucucaaaagauauauauauauauuggaagccacccccaaaaauccccuuagagugccuuucccacccuccaccuguggaggagcugugcccacaggggcaccaugcggccgcagccccagcccugaccucucccaucucccuguccuucacugcccuccagagcggcacuaccccucacuuugcuaccaggagccgccacaugccuggagccccgagccuggaccugagcacccagccacgcagccucccuugagacacugcagccacacccgguagcccucugaccaaggcagugggcaaaaugcacacaguccuucagggucccugcucaugcaaaucagaagcagugaagacgggacagaaagaaccaaggggagggaaagcggggcagccuggauuuacgcacagccacagucucagggcagcucccucucccagcacacugggaagcaugacagacggcaaagccguggcacaguguccaucagaccgcucgagucauccucagggccaggggccucggcucggccucgauacgaaucacacuguggccaaggcgcaaucuggacaugccauagcagcugagccaccaucacgagccgggcucugcauaccggguagggacgcuggcccuucaggucccuaacaagcgcagcaugcccugggggcugacaguguccgugggaagcaucacggugcuucugagcuuucaagagucuaaucucuguaaacuaugacacagucccugcaaggacaaaggcagacgagagcuuguucucaaacuguacuaagguccuucggggagacguccaccacaccacgaccugcugcagagacacccugagcaggugcaggagcuucagaaaguccugcaggugcauccaaggcccggucagcagcaggccccgggcaggggacauacccuacuccucauuccucccaagaccugccagcagagagggcuguguguccucagagccagcgggggaggaggaagaggaaagcugagucucugcgggagagacacucacucagcagaugacaaaggacucacugaggugauggggucaugacagugaagcugggaucucaaccgaugcucacucaacaccccagagccauggaacacaggacaucacugcaaaucacucuuguccacugcaggcacauuggcagugugacgagcaggagagagcacauccaccaaucagacccuucaccccacacccacgagagcaccgaggaaccaggagaaggauacgugaaacaagagaagaggcccuccgcagcucccacgugccucagcucuggccuccgcuuaaccagaagaauucugaaaacagaacuucgucagaacgcagcccgcgugugcugaagcuggcacgcugacauggaaagacacucuucuucagggagggaccgcgggaagcacugcacaugguugguugugaacuccgaagcccaaaaggucaacauccccaccagcuugggaggugaguuggaugcucccacaccaggccccauccugcccgggccaccaugccgggcaggggugggauggcccagcccggcugcuacccucggauggcagcgggcaugcacguaacggcucugcaggucagcugcugccccagccagcaaccgagcuacgcugggcugugcugcacacucaggggcaaaggaaagcaagcugcuucagggcaggcacucgaaaggcgagaagacacaggcaccccagugacaucuccuuugaugcauccuucugaccuggagagccaaggggcggauuccaacacagagcccuugagcuggcaaacaaguguucuccaaagaauggggacugugaccaccuaugaggauuuuuucagugcaaaaucugauguaaauuuuauaguagaggggguuuuaauaugccagaaccucccaaugguuuucuuuauggcucacuuuaaagguccaaaaggucagagggccacccacauccugcaagcaaggaggcacaguuggcaucacuaauuaagauacaccccgcuuguguggacccacaggccaucuuccccuccuuguccacagcccccagagguggaaugggggucagccuccuuagaacacucuaaccccugagcuuacggggcucggacaugaguccuggggguggguaaguccucaauagccagcugggauuagccccaggccacagggaggacugaggcucaggggcccuuggccacgcucugcugaccugcugggggcccacuuucugccacuugacuuacauggcacggugccagccagcaaggccccugcagaugggccaggcugggcucagccucagacccggaauucugguguguaaaccgguggcacugggggugccagcucgggucccccagcggguccccuccagcacgguuucuacacagacuccuggcaggcuucaguccugacagcuacucuacagaauccuggaccuaggcacagaggaagcucucgccagcacugcuagaaggaaggaacccccucccuucuggaugcggcccgucucagagccacaggacugggacccccggcgugugagccaccuucuucaccuugcccuuguuuuggaagcugcccuugcuuuucaugcagaaguccccacaacagcaccaccaagcaugugccccaaggagggccuagccgcgccauggaccaccuggaggccuccuugggaugcaucugaaugggccugccuccacaaaguuagaacaagagagaucagguccaucacccagcuggagccaggcaccagugcacaaaauagaaagaacagaagcaaacucuccauuaaaugcaagaagacuacacauacaugaaaacgcaaggaaguccuuugugcagaccacaccuccaccccacccaggcagccugccaguuggcccggcucaucacuggcucacgcacucuggccucagagaccucagucaccaggccaccaucuggccacaaugcccuuuucacaaugcagccccgaaacucuggcucuggcuaaaaaggaccacaccccauucccacccacccagccuccccuuccuccuccucaucugggccuggcuccugcaccacggcucucccuaccaagcaagcccuccagccacagcccugguucucaggauggugacccgugugcaccugccuguuuagcuccuuuuucuccucugucccuaccaacaccaaagccucuugugggcagaggccaguuuuccugaucaagccuggggucauggggcuggccacugcgucuggcacagagaauguguucaacugagucucaucucauguaaaaccuaguacuugggcugggguguaaaaugaguauuugcaaaauaauaacuaaucaauuagaaauauucagggaacauggcccccaaggaccacccccccuccacccccaaccccaccaccagggaggccaguggagauaccacagaaacuucucuuccucaguuuaaaaaagaaccgcuccagcaaauagcaacacauaaaccagaugaugggccauucccaagggaaaaugcaauuccaucaccgcuugaacaauacucccacuuggaaugcugguucagacuuucagguccuaagaacugauuuauuguuucaagcuuaaacaucaauccagcaaaagcacuugacucacacagacggaguacuucauaaacaacaguaaacucacaaagcccaacacucacauuuuuaaacagagcagacuccaaaauguuuauguacacaaacauauuaauguaucauauuaaaauuaugacgcuaaauaagaagugauuaaauaaugucauuaauucuaauuuaaaacaagcagagaaaaacuucuucauaaaagcaccacucgccuccucacacgccggggcccugggcgaagcggcuggagaacaagcugcacacaccugccuuggccuuggcacaacagucgcauuugccacucgacagcuguguugaaggcccuucucccucccauuccuuucugcaucacagaauucccuccacuugcauuuaugacaucuccuuaggagcauguaaucuccaaaaucaggaccaagaaguucccagaugggggcagggggugucaggaaacaggcaauuccagagcacuggcaagaaccccgcagaggggccaggccagagguggggccucaccccagcucucccacccaaggcccgcauugugccauucacugggcuaccuacucauccauucauucauucacucauucauuuucuuucauucuucgagcaccuacacugccaagcacaggguacagagcaggcaugaggcccucagggccccucaauccuacagagccccagcuaguagaaaagguggcauuaaacaacuaaggucacaaugagcuccuuccugaaauugcacaaugggaugcuguuagaaaggaggaaaaaagcuauuaggcuaaguuuaacaggggaucaaaggaugagaggaugagcaugaacugaggggcuggagaagaggaagguaaagggaggccauuccaaggaaggggaacagugugugcaaaggccccgaggucaaaggggacuuagagagagcuagaaaguaaagcagguggcagcugaaacuccacaaacacagcaagugcuaucagaugaggcugguaaaacagaggccaggaucaggcaggccuuccagggcccugagaccuuaggauccuaagaauacaggaaagucaugccaggguuucaagcaagggaaugagagguacaaaccugcuucugguggaaaccugggagacuguuuguaggaugggcuguagcagagcccgcucagaccccgagggucaguccccaccuugaagagcuuacaugugaguuagaaaaacaaaugccccuaaauucuucuauugcaaagcauauuuaucaacuugccaaggacuuaaagaguacuuuucuuuccaaugaagauaucuaaauguuuucaaauuacuacuguaaaaaaguaauacacgcuuaccaaaagaaucucuacaauaccaccauguauaaaagaaaaguguaccccgucuccucaccucugaugguuaccuuagagacccauguacuuaaaaccaggaguggcccggggacugcuccagaccccgccuuucccucuuacacugcacacuucugccugucuacacauggaggaugccacagugcagaaaugccagcagguuuaacaaguacuccuuuuauaaauaaugcagccccgaccuccacacacgucuggauaucuacacacuuaucuucuuuccuuagaauagauuucaaaauguagaacuguggggacaaggagaauggcauuuaagauuuugacacuuaagacuuuucuagagagcaauucgguaaucacuauuuuauguuuauacauuacauauauaaacuuuuuugggggggacagcccagggucucgcugugucacucaggcugaagugcaguggcaaaaucacaccucacugcaaccuugacuuuccaggcucacgugauucuccugccacagccucccaaguaauggggacuacaggcacacgacgucaugccugauuuuuuuuuuuuuuuuguagagaugagggucucacuauguugcccaggcuggucuugaacuccugggcucaagugauccucucaccuuggccucccaaaguucugggauuacaggcauaagguaccucgcccagcccuauuauauuuuauauaauaauacauaugggucucuccagagagcaaaugauaauaaauaacagccaacauuuauaucaugcuuacuacaugccaggcccuauucaaggaaauuuccauacauuaacuuaaacuuugcaaaaaccuuacaaaauagaaauuauuauuaugaccagcaacagguaucaucaaacucgccaauaugauaggcauaaagggaaucuccuucacacugaauugauuaguaaugcuaaccuuucaucacuggcacaaugauucaauguucauacguucugcucaucuugcaauggugaucucaugcucuccuuauuggucuguaaaagcucuuuauauauugacuguuaagcuuacacaggcauaaugugguauguauuuucucucucgucucuuagcccggcugacggagucuuuugccaaagagauuuuuuaaaaaacucuuauccuauuaaaucugucaagauuuucuuuaagguuucuggguugguauugaaagaguagauuaacuugguccucaaaugcuuucuuccaauaaaaucuuccaagguaaucaacagaccgaacaacaaacacuaaaagcugcuccggcugaaguggacuuggagcauuagcucccuuccgucacccccaccugccuccaggcguccuggggacuuugcaggagaagaacaugaugucuucuaguucugcagucccacacgugacauaagacagcaugagaaagccagaaguacugcccagaccuaugaaacgcgccuguaacagcgccaagaacagucaacacagcacuagaaagucuaacgacacugaacuagaaagguauuccaaaucguccucuucucuaagaggcuguguucgcccaagcaccucgacaagcugaacuucagcuucaaggucaccaccagccuagaagcagaggcacggagaggaacuggccuuugggacuggagaugcaggggguggcacaugguccauuucauucuacccccaguuccuccagagguagagcccaccugcaggacugugcugacaccuacauggugagugcaugaaacagcacgagccccaagcaggugcucaucuggcgucagcuacgggagcacgugacagcugcucguggcaucaucuccuugcuccaggauacauccucaucccccgacagugauacaggaagucacggugggggcaaucuaugcaggaccccgaccuuccuuccaggaagugaguaggaggugugucagcaaggccacagcaaggggacauguaggacccugacccuccuucuaggaagugaguaggagguuugucagugaggcugcagcaaggggacauggccauuuaaugcugcagcaccauggcccucaugccaccccaaaacaggucccacucuucccacgcacagaagcccaagagaagaaaacugaccguaugaagagaacuuacugaccuuagugacacuuguucccacagaaacgcuuaugaaugaguuaaggucuguucaaagguagcaucacuuuugacauggcaccccucaucugaccugaaccagaaggugcaguacccgccucuaacgucaaggccaaaaacccagagcccaccacacggcagggcauaugcugaccaccugaaaucaaaacaaacacucccuccaaauccauccuuuccgacuccuuaccccaggacagacugggggcugccaacaacagggcaggggcucagucucgguuccacagccccaagcuuagguggagacugggccccuucgcccuucaguucccccauccccagcuagucaucaauucugagccucggaggaaagcccggccacagccugucgccccgcugccucucagcaacggcaguucucucggccucugcggcuccuucgcgcccuacaucagguauuaauauauuacucauggcagcuucugagcuaugaaagcccagccguuuucaauagagaaugguauggaugaauucuacaggagugaugaaauguuucuucugcuccggcaauuaagacagcauaaagucgccuuuccuuuggugccacccccaacauuaaaggauuggaauucaaagccauucaugcugcauugaaaccucacaaugaagcuggagaauggaagucgauuacugggcauaaauaugcaguaguuaaaaggaaagaguuauaacaaaauuaaacugcagcaaccccacaauguguggaaacuuccagcacuagaguccuccugguaaacauccauagggcauucuucucaacgaggucucuggccacagaguccagaugggcugccugagccgcacguggccagcgugccagguuguccuguccaucuugcuacagcaacagcccccaaggccuccgagaauauggcauuuggggauuuuuauuuugcauggcuaggaagcugcugaacacagaacauucucucuggugcagggcuccgaggccacaucuguccuucgucccuaggccuuccaggcccauaugcaguccagucaucuucccuccaccccguccccuuagcccagggcucccccgggggcaugccugcugccagcuccccuugcaggagaaagaacccuaaagagggcagcguuacaucugccugcugaguacagccggcuucuuuucuaauugauuacugcucucuuuaggaugggauuugaucucuaaaauaaaagcccagaacacagaaagcuauagaagucuuacaauguguugggguguguguuuuuaaggcaugaaaauacuucccucccacacaaaugugaguucuucuggggaaagaugccacagaucccagagaguagaauaucugggaaagcccgaucagucuuaaaaauagguaauugaacacagauuuuagaauucacaagagcuaccugaaaaaaaauuaaauuucacauauuuuugauauccaaaacuccauucugaugaaacuucuaacucgguggcauuuugcauuuccaauuauaauagaguaauuguguugccauaguuacugcaaaauucugcaauaacuuuuguugcuuuguaacugcuguaguguauauuuguguacaagcagcugaguuuucuuaauucgaucucccucccuuccacccucccucuccccagccaccaccaccaccuuuccuggcuagguccugaaaccaccacaccagccuucuuuggacagucccgaaaauaaugcacagaauuaucagaagcaauuaaaacuccaggcaaccacgaucauauuacaaaagaaaaagugaaaccaggucaaggugcaaaccugccaguauccccccaguccugcugggcuggcgcugggccaggacuguuuacaggcuuacucccaggccuuaacugcuucggugauuugugggaauaaacagaaaagccugaacagagaaaaacggggcggcaaagugacugcacaggcccuuuccucccucacggagagcaagcagaacugcucucagcaagcaauuagguaggucucuacagucaugcaauuaggauuuagugaagaaagucauuaguuuuaaaauaacuuaaguuuaauuucugcaacgcuuuauuugaaaacugugucacagcaggucaauuuacaacaugcaauaaagaaaacacucauaucagcugccucaaguuauuacaaauuuuugaugugcauuaaaugaguacacuggguuccacccccggccuuuccaacugauacgcacggucuccuccuauaacagugucaaauaauucaacgcucaauguaaauacgagauaauuugcuuaugauuccgugguguguuuucgcaacgccggcaaacgcggaucccacccccgagcgggaccgggccccgucucggccugcuggcgcccugcgggcugagccgagcgggucccgggcagccccccgcccucccgcgaccccccgggcgcucgcagcggcgacgacaagcgcggggccgcggacccccggcagggacguuuuucugcaaacucacagcauuugacaaaguuacauaaacggcgcccggccggccccggcgcccgcccgcccccgcccucacucccggcggcccggagcccaccugcucggggggcgcgggccccgcaccgggagacggcgccgcugccugccgugcccacccccgcgcccccgccccggcgggcgaagccgccucgcggcgcggguggaaagguccagaaggggccgggcggcccuggggaccggcgggucccacggcgcgcggccagcgcuggcccccgccucccacggccgcgcgcggggcggguguggaccggcggcguccaccugccgcgggcuccaaggccugcaggcugcgcggggcgcggggcgggcggcggacaauggcccgcgggcgccgggccggggcugcgcuuaccgcggcgggcggcggcggccggcucuagcccugcuccggcgcuccgcgccgcaucuccucagccugcgccgccacccgccggcgcgcgggcucgggcucgggcggcgacagccgggacgcggccacggcgccgccgggggcccaggcugggaggcuguucgggcggcggcggcggcggcgcgggcgggugcgcgggcucgggcucgggcucgggcggcggcggggacggugcuccgcggcggcggccccacaaccucc

SEQ ID NO: 192918 - RNA, 78059 nt, Homo sapiens
uuaguucaugauauuuauuacuggaguuguuuacagaaaagucuuuuauccacuguuaacuuaggcauaagaauaauuguccugugugacuucauuuuagaacuuuuacuuuuuaaaaaaucauaaaacggucuguaucugagaagauacuaauaucaaugcuuuaaaaagugagaggaguugaagagggggcuuucguucaucccucaguagcugcgaccaaauaagguguaguacuuggcaggguucuugccacagacacauuuggcuccaggcugcaguucacagagugguuugaaggggaugcaaaggcuuuuagcucccauggauggagcaccagguucaagaucuugaucccugaaauuaauaacaaauaagaauuccacucauuuaugcugcaaauugcuauuccuuuccauugcaauuuuucaaaaguuuugccaguuaauuagguuuaccuggcaguggucuuuuugauccaguccucacagucaauuuccccacagaauggaaucugaacaaucuaauuaagaaaaggaaaaguaaucaguauuuauaacuccuucaauucuauucugcagaaggaacauuugaguucuauauuaaacuggcaagcaaaaaggauaggucucccaaccuuuuuucaggcuaugauaccuuugcaaaccuacuaggaacuuugcucaguuauaaaagauaggaaagaauguuuuuccacuauccaaaaccuacgcucacagcacaucaagacacaacaaagacaucuuugcaguacccucaaaucucccauaaacuggcuaaaacacaguggcugaaaagaaguugaacuccaguuauaucucccucauuucaaaccuggacuacaccugcucuaccuaucuaaauaguuaucaggaggagaaaaggaacaucaaaaauagcaaacugauuuuuaauguguuguuaacagcaacaauuaacaaucacgcaaauuucacuuuaugccacaauguuccuaacauguuauauagguaaguggaucauuuuuaaaguccuaaaaucauuuuguguaaggaaaaaaaaaaaaaccuuucaauuuuucauucuuagacuacauaaaacaaaggccgaaucaagauacuuaggauuuuauuuuaauuuugaaauuugccauguguuugaaaaucucuagcucuggguuuucuuuuaauaaauuguggaugucagacuagacaagcauuaaaaaaaaauuuuuuuuuugagacacagucuuacucugucacccaggauggaguacaguggcacuaucuuggcucauugcaaccucugccucuuggguucaagcaauucucgugccccagccuccuaguguagcuggaauuacaggcgugugccaccaugcccagcuaauuuguguaauuuuaguagagacgggguuucgccauguuggccaggcuggucucaaacuccuggccucaagcaguccacccaccucggccucccaaagugcugggauuacaggugugagccaccgggcccagccaacaaguauuaaaauuucucccaguugugaaugcuaauuuuuaaagcaugucuacuucaaaaugagguuugucuucaauaacaauuauguaguagcccuauaaaauauuccuggagaguuaaugaggggaauagcaaaguugugaauaaucuccacauauuagaaauacaguguaaagcagcugaaaaucuagagaucuaugaagguggagacccaagagacauuggcaguaacagcaacaugcuuccagcuucuucagcagcuucucaucaacugcucucagccacagaaaaucguaaauaaagugaaagaaaaaacacagugcuacagauggcuacccacugucuagccuucuauuaaaaguaggaaguuuaaggccaggugcaguggcucacgccuguaaucccagcacuuugggaggccacggcaggugggucaccugaggucagaguuuaagaccagccuggccaaaauggcaaaaccccaucucuacuaaaaauacaaaaauuagcugcgugucauggcaggcgccuguaaucccagccacguggaaggcugaggcaggagaaucgcuugaacucgggaggcagagguugcagugagccgagaucacggcacuguacuccagccugggcaacaaagcaagacccuguaccaaaaaaaaaaaaaagcaggaaguuugagucaagugaaaaacuacagaaaccagaaaggugaaaaauuacaaaagcaauaacccaauaaggauagaaggcuaaacacugaagaauuauagaucuaaagaggauuuugauauuaucuauuuuguacucauuuuacagaauaguaaaaugaaagccagagagauuaauuuucccagcucaagaaauaagagacauauuaauacguuaugaccauaaaaauuaaagcuuuacauaaauucaugcucauucucagcaugaauuuaaaacacaaaaaaagauacagaggaaaaugcauuaaaccuagucagaagagugaucuaaauucuguauaguuugggguauucauuuaagacacuggcccaugguuuucucacuuguaaccugaggacacaggauugguuguauauucaaacauguauaccagaauacuaaaguccauaagugauucauuccaauaauuaaauaacuuugcaaaucugaaauucuucuuuaugaaacuuuaaaguuucagcucgaaacaacugcauauacccaauauauaaaaucaauuaaaucuuaaagagccauuaacuaccuaauuaggaaagccuauggaguucuaaggagccagguagccccucauuaugaaaaacaggcuuagaauaagcaacacuuuucuucucauuauucagaaaguucaaucaauugagagcugaguauguacagucagggaauggaaagaaacugacuuuucaccuuguuuuaggcagccgcauaugacagcucuaaagcuagaacaaugguuacuuuaggaacuuaccagaaacugaaauaacacagauuuucaauaaagaaaaaaggagacauacagaauuaauguucuuuagaaaguagcauaucaaacauggggaaaaaaaaacuuacauaaucaguucacaaguauuacccccaaaaugguauaauguuguaaugcuuuagaaaagccaguagaaaacaaagacuauauauauauacauauacacacacacuauauuuauauaugacauauauaaauauaaaacaaagacuauauauuuagauuauauauuuauaugacauauaaauguaaaacaaagacuauauaauuagauuauauauuuauacguacauauaaauguugaguaauguacuaucuuuuuaugugauuggcuuaaaaagguauuaauaccaugcauaaauucaaugagccuuaaaauacaauuuacuuaaauauucuuauacugaaaaguuuuccaaacucucugaccuuuccagaaucuaguaucuucugaaagucuuccauuguauuagccacaaccauaugagucuuaaggucuucagaagcccuaccaaacaaaauuagaaaacaauacauaauuguucucacaaauaugacaaaguuuuaugaaacacauaagcacaauuuaaugaaaagacaaccugggagugagaaggacucaauuugaaucucaagucuaucacucauagugaccaucaguauaucagaguuaccuuaucauugcacuauugugagccuuaaaugcaugggaaauguguuaagcacacaacaggugaucauaacuuuuguuacugcuguuaaaucucuaaugaccaucauucuuuuccuggcauuaacacauuaccuaugggagucuauguuauuuuuuaaaccucccuggucuuaaauauuuccagauucagaggaauauauauauaucuuuuaucaauauauaagugcccuuauauaagaugcaggcauuacccucucccaaacugcaccuccauccucagugguagugggcuuuccucucugcuuucugcuccagguaggcagagaaagaaaacagggugccacgcuaagccacuaaucuucuggugccucugccuugacuaccuugagaucuaugauucuaaaugacucucuccauaggugagggcggcccuaaggccuuccucuaucccucauucccaaccccagucaggagguucucagccuuggcuauauuauaauccccugggggagcuuuuaacaguauaguuuccaggcccucuccaguccaauuaaauuaguaucucuaggaaggcacugguauuuacuaaagcuucccaggugcugccaauguguacccagcagaugacagucaaugccugaagcccucacauuuauaucucauaaaagccuagauuuaaauuaacccaaauuaguccaggggacagaaacuucauuguugcaaaccuaguaggaagcagguggcacuuagaaaaauaaccauaauacaaguaaaaaacccagagaguggcaaauuaaguagcauggggguucagagggagggaacaauugcuuccaauuggggcaaccccaaaaauuccuugguaaagaucucaaaggugguggaagaucuggagagagagacauaagcaauuuuaagaaacuaccuugugaaaagggugaccuggaugucuuccaaaauagcuugaaguuuagucucugccucauuuucagcaacugucagcuuuucuccaguaucucgucugacggcuacaaacugacagcucuucauaucacguggcccaacuucaagucuaaugggaacucccuauaagauaaaaaaggcaguuaaaaugauauaugaaugucuccaguugaauauacagauguaauucauggcuuuagcuaccauaaauuauaaaaaacccaaaaaacaaaggcaaagccaaaaaaaacaagagaaaaaaaaaaaacagguaauacugcugagauacuguagaaaccuauuccaguaagaaggcauaaaccuaaaaaaaaaaucuacugccccagaaguucuucauggagaaacagaguaguuucuagaccagcauucccaacuuuucucacaaaauagcauccagaaaacguauuugcauaggaaugggguuaaacgaagacuuuuugaggcuacaagccacugaggggaucaguaacaugacacauuuuugacucauuccugauacagugguauucucugguugaaaaguccucauucuggguacucuuaucuuuagcaugcauuaugauuauaaggauuguuaaagcacagauuuugggguccugccuccagagucuuuuauuagaguagguuggggaugcgaccugagaauuuguuuuuuuuuguuuguuugaagacagagucucacuguugaccagacuggagugcaguggcaugaucuuggcucacuacaaccuccgccucccaagaucaauugauucucaugccucagccucccgaguagcugggauuacaggcaccuaccaccaugccuggcuaauuuuuguauuuuuaguagacaugggguuucaccacauugaccaggcuggugucgaacaccuggccucaacugaucugccggccucagccucucaaauugcugggauuauagacgugagccaccguacuuggccaagaguuuguauuucuaacaaguuuccaagugaugcugacacugcugguccuaggaccacaguuuaagaaccacuccccuauacucuuugguuuuuccaaagcaacuuaaggacagacuauaugcaaguuuacgacuugggaauguucaaucuugugaauguguaucccguaaggggauuaaaauccuuaaggcuuagggaaaaaccacauuuuuagggcccagaaccuuaucugauacauaguagauuuuaaguaauuuuuuugaaugaauaauccucuaaaauuaacuugggauuuuccugaguuacaugcuuccauauacaauuuagaugacagguggucaccccaaaaaugccauaggaaaaauuuuaaauauuacucuagaaguccuuauuuaccccuagggaagacuuauuuuacaaaaugauauuuaaaaaaaaaccacaauggaaccaacuguuguaugcuaaauauuacauuauuuuauugcuuuaguuauuuauccaauguauuauacuggauguauuacaugcauuuguaagauacagugcuaagugcaaugagauuuacaagaugaauaagaaauacaucuuguccucuagaagcuucaugcuuuguaggguaaauaaggcacacauauaaacaacaaaaauuaauacagaaaguuagcagugagagaauauuccucagcuggaagagagaagaaaaguuacuggagaagguaaaaauuaauaaguaaauuauucguccgaauuaaaaaacauucuauaaaaaacugaccuauaguuacaaaaaugccuaugucauaaaugauaaugaaagucugaggaacuacuucugauuaaagaaaacuaaaaggcaugauggcaaaaugcaauaggacuggauccuacacugaaaaaggagagggccacugguagcccacagcagggugucugagccucaguuaggcaagagggcaucugcacaugagaacagcuuugcauagagugacagagcccacgagggauaaggagcccauucacgcagaggaggggguggcaauggcaacgagagauugguggcauacagggugacuaaucuaauaaauucauguacuaaggauaauuugagcuaggcuuuucauugucagaaaagggaauuacaagcacaaaauggagaaaaacuagaaugcauccugcggugguuuuuguuguuguuguuuuucuugagauggaguuucgcucuugucacccaggcaggagugcaauggugcaaucugggcucacugcaaccuccgccucccagguucaagcgauucuccugccucagccuccugaguagcugggacuacaggcacccaccacaaagcccaucuaauuuuucuauuuuuagcagagacaggguuucaccauguuggacaggcugguggcgaaauccugaccucagacgauccaccugccucagccucccaaggugcugggauuauaggcaugagccaccacgccagguccacccuaugguuuuuuauuggaauuuaaaguauagauauaaacucuugguuuucaacauacauaaauagauauggaaauauggugguaaaaguguacacauaucuguauguguguauggauaucuacauauauauacauauucaguagcuccaucuacugagaaggcccgggagaagugauagcucaaaagcaaugagcauacccagcacuaaauaccauucuccacucaaaagaaccagagcuucuuagagauauggcuaauuccugggccaggguagaaaaaguacaagauaagccuacaacaucuugugccaagcagcaaggaagugcuuaaagaaugauggagaaugccaaaaggacacaaaagccagcuuuaagggauccuaauggucaagccgaagacacuuugagcaucaaaacaaauaacgucaguaacagauucuauaacccagugcuuaauacuggaaaccauggauccauaaaauaugaauuagcuaauagaaaggcuaauaaaaaaugugcugugucaagaucacgauaaucaaagaaaaccugagaaauuacugcagacugaaagagacuaaagauacauaauaacuacaugcaacacauaauucugaacuaggucauucugcuauaaagaaacacuagucagacagcuccugaaagcugaaugggggucuagaauuagacuauuguaauguaugaacacuacuauacuaacuuguauuguauuauguaggagaauauguugguuguacuauguugcuugugcugugauuauguaggagaguauguuugcagggugauggagcaucagguuagcaucuuauuuucaaaugauucaagcaggaaaauuuaauuauuuguauuggacuugcuuuguuauaaguuggugacuguugcaugauaaaaaaauuuuacaacccagguagaagaaauagcacaaguaaagacacagagguggaaaaacaggcugucugugaagaagagagaaaacggcauaugaaaggggauaaugaaaagugaaaguuggaaagguaaucugaagccaaaucauggaggaggcaaauauuuuguugacaguuuuuuucuaaaacuaguuacaaauuuaacuuuaaaagauucguguuuuguuucuauagcaacacagaauuaucuuacucuuuccacauaguaaaaagaaaaguaguuaauucacucagauuauuuuccccuuuauacuuucauaauauaggaagggguaccaaagaagaauuacaggaguugcuggguucuggccucacaaucaaacaauauuauagcucauuuauuaaucugaauaaguuucaaaaugcgcguacacaucgcucacacacuuuggucaaucgcugucaaauaaauauaaauccagaucuccuaaaauauuuuuucuuagaaauucuuugacuaaauggaauuaaaauggcauuaaaaaguauaacuaauaccuucacuagauagugaacucucuuucucaauguucuuuaacuugaggcgucaaguuuagaacuuaggugcuuuauuuucuuuccugaggaauacagacaacgaagcuguagaagacccaacucauacuaagaauaccuccccagcauaguauaggcucacuagaguacuaaaagaagagugacaaagacaaagccaagucagucuaaggaugagaaaugaauaaaagaggaaaggguacaaagaauucaggaaugaacguggaugguuuuuucuuuuuaaucccgcuaguagccagcaguaaauuucuccuuuaacauuuuauagcccagguuaaguagaaauuaguuuagagaaacugcuacuggcaucacacaauagcuauuuauaaguaagcaaaaaggagugcaauuaaaaaggaaaugacauggaaaaaaaaucauguuuagaaaagcauauaaagaagcugguauauuacauaaaagggaaacaauuaucaauauaauuaccauuccucagcacaggaaauuuaccucaggggcaaugugaaacaaauaagaugauaaauauuagcaacuuugggaacccuagauguauaaauaccuaaaaaucccaauauugcugagcuuccauaguuugaaagcaugcagcugcaaucucaauacauucucucauacugucaccuauaauaucaauuuauauagucucgauuccuaauuucuagauccaguaagauucccucuuucagcauaagaaaaaaauguuguaaguuuauaaaucagaauuaaggccacagauaaucuauuaaugacaaugugcaauacaugaaaguuauauuacaaacaauaaagcagaauuuagacuggcuuuaauaaacaaaauaaaaaucaacaaacugguaugaaacaauguggugugaaaacucaagaauaaaauuaaucucagauguuucacuauuagcuauaacaaacacagcuaagugauguccauguacuguuauucugguggucuauguaaauaacuuauuuauuuuaugaauuccuggcauaaacauuuuaguauacuaguuacgugaggguaaucauaaacaagcgcucgagaucguuuuuauucuaacauaauaaaaauaagcuuccacaaaaacuauuuuaaauuuagguaucacuauugcaaagcuaugaacugugucagugcucaacaguuuaagugaagaagaagaaaacucacaacuaucaaaauagaggaaaguaaugagaaaccucguuuuauaaaaacaugcagaggaaaaucuaaacucaaauugcagauguuggggguaaaagauaaagcuuaggaauuuaccuugagcucccagugauugaauuuccaaccuggagaauaauuaucucguaaaucagcucuaacgcggauguuaacacugaguaaucgccuucgauaaucauugcauuuugcaaucagcgcuucuuugucuucuucagaaagugcauugguaaugccacaaggaauaaucaccaccuagaaucagcacaaugucccaaauguaugcaaagaaacagauauagaaguaaugagcucucagaagucgaaaccuaccaguggcuauauuauuaacacgaaucagcugugugauuucuaaucuuauauauaaugucuacuaauuaccugcaaaucacuuacccgugcuaaaugcauuuucaucugacccacuauauuucacuuaaucuauuuuucauauguguguguauauauauauauauauauuuuuuuuucccccccagccucccaaguagcugggacuaucagugcaugccaccacaccuggcuaauuuuuuguagacuagauuuugccauguugcccaggcuuagucucaaacuccugggcucaagcaaucugcccgccuuggcgucccacagugcugggauuacaggcgugagccugcaugcccagcucauuuaacauacuauaaaccguuuuuaaaaaaugacuucuaaaaauguuuauauaaguagcuuaaaaauuaaaagaguaagaaacaauaaauaaauaauacacacagucacaaaacacuaggguccagacugcauuccacguuguuuuuauuaucagagaaaucugccugaaugauauucagaaaaucacccuuucaaauuuccuuuaguaaauauggcuuguauuuuauaaaaugagugauaaacaggaauauuuuccuuaccugaacacaugcuacacggggugguaauacuaaacccauguuguccccaugaaccauggucauaacaccaauaguucgaguugucaggccccaggaguuuugauaggcaaauugcuucucuccugguaucuuuggaucuucaaaaacgauuucaaacauuuuggaaaaauucugcccuaaaugaugugauguuccucccuaaaauagagagagaaaaauaagcuucauuuuuaauaaccuauuaugcccuugaaaaugauuacuauaagaucacaugcuuuaaaauggcacuacacuuuuuuucucccuuuuuuuacauuaaauaagguuuuuaauuauaagcauaauuaccauaauaagagauuaagauuagucaaaaaauacuauuuacaagcauuuugcucugggcagccccuuuuauagcaguaauuuuaccuacaacaguuaaaaaggaauucauauuuuaguaguaauucaggauacauacuaugacuuaacgaaccauggagacagaggaaugggauagauuuguuugaaauuauuauacgaaaguacaugaaacacuuauuuuuuaagagucuacuucugugaugacagaagaaauuauuggaucuguccauggacugugcuuacagugaccuacgaauccuguguggcaguuugauaccuggauagcucuuccacuagcagauauaaaugcuucuauuguaguuguauagucuccuccugcaaauuuuuccuuuuccgucuuucuuccuuuaacaacaggaauugccaggaguucuucauauaccugagcauauaagucaaguaucugcaagaccuguaacauuuuaaauguaaauguguucaaauuuaggguacauuuauucauuaagaucuauaaaacugcacuacuuaagacuaauugugugggaaaagcaaucugaacaauaaaaaccucuuuuuaugaaaagguuaaagcagccagugugaacuuauuaagaaagauauucaaugaagcaauguaaaaagaagucaaauaacuuuuuaaaauguauauauguuuagaauauaagagaaaauaaauguuaagaaagauauacaguaucaaaaugcaaauuuccugaaaaauaauuuuuucuacacauuaaaguccagaaguauuuucaccuaaaaauuuaaaagagccuauuuccuuaauaauaacauuccaauaagcaguuacuuaaauccaugaacauuugaauuaauuugauuuugcuuuuaacagguguuacauacauuuuaaauaacaaaauugcagaaccugaacaaaaauaauggaacauaguuaauauggaaaauaacuuuuuauaccucuuccgcugccucuuccaugguagcaaaagcacugugcccuuccugccaaagaaauucacgaguacguaggaaaggcugaggaugcuugaauucccaacgcuggaagaggcaagaaaacaauuuagucauuauaaagagcuuuucaauuuuuuuuuuuuggagacagggucuugcucugucccccaggcuggagugcaguggugcaaucaugacucacugaaaccucugccucccaggcucaaaugauccuucuaccuuagccucccaaguagcugggcuacaggugcacgccaaugcagcuggcuaauuuuugcauuuuuaguagagaugugguuuugccauguugcccaggcuggucucaaaauccugggcucaagugaucugucggcucgaccucccaaagugcugggauuauaagcaugagcugccacgcccagccacuuuccaauuuuuauuaccauuuuauauaauaaguaaucaaaaauuacaauuuaucuuaaauacuucaaaaacaguuccauacucccaauccuuugaaaauaaaaacaaaaugugcuuuaaaaaaaaaaaaaaaaagaacaugaauaauaauagaauacaagagggggugaauaccuaccaccacauugcaccacugauugagcuugaugggcaggucucugugugacuguacccauuuugcauaugcaggauacauuacugaaagacacgggaaaauagagacagucauuuaaggcuuuauuucuccuuuagggauguaacagcuaaaccagcaagauaauuaauaggaauuaaaauguaauaaauaaauuugaaaaauaaaauguauguuuguguaaauauauuuccaauguuuauaauaagugaauaguauuaucuauuucaugaaguguauuacucaaggauacaaaucuaaacuugaucauauuuuacauucuucacagauuuuacauucuucacauaacaguuaauguacuucgacgguuuucacauuuuguuuuuaaaaacacaaauaaaggucauguucuauguuaaguucucugcauucauugaccuguucaauucucacauucaacccacaagaagguaucauaacucaguuuuaaagacguggaaagcugaguuuauagaagcuaaacaauuugcugaauccagcaguuauguaugagaagcagaauuaauuuauaucugaugcaucuacucagaguaugaaagcucuugcaaugaagugcaaagugaagauaccugucuuagaauagccugcucaugaucuauaauuaguaaaccaaaacaaacaaaacuuugccaaauagucugagagaaaaaaacugguaucacaauauuaauaauguauuauacaaaaguaucacuagaaauaucaauaagaacagacaauccugaacucuacagaugaaugaucacuuugaaagacacuguaaagcccaaaaccucaaauuuuccaacagcauuuccauuuaccauacguaauuucagaaaaaucauuuaaucuuucagagacuuuucuuuaccugcaaaauggaaaucacaguaacuuucccugccuuccucacaacacuguuguaagaauaacacgagaugacguaaaaguacuuagcaaccuaugaacacccuacaugaaugcaaaccuaaauguauuauuaaaauuuaaaaauaauuauggcauaaaaauugcauuugcaauauuauaaucaauuccaacaauaaaaauuauucuaagaauaaaacuccuugaaaaguccuaaaaauuuacagcauaaaaaugaguauuuaaauuaaaaauccuauaauuuaaugauaaggagcucuacaaugaauauuagagaauaaaacucuagacaacuuaaguuugcauucaaucuucaucaacauucaugaaauguuauaucgucaacagagauuauagcuaucacaaagcaaaagcugagacucaacuuuagaggcugucucuaacguucagugagcauucucuugcacuccaaugccuauucucaccuguuucacuaguaggacgaauggcaauugguucugccagcucgguuuugccagaucuuguaacccaagcaaccuaguaagaaaaaaucauuuuucauacuuuuuuuucaauagcauuuuggagcaacaguacaaaugcaggcaaauuuccucuguuuuaauuuuugcuauaucaauuuaggcaaguuaaaauagucgcugcuguucacugugaggaaagguacgcacuuacugaccuucuaaauauuaaaagucaguuaauuaauguaacaaaaucauuacuugcuauaaagguagaaacagaacuuuuuaauaaaaauggcuuuauauuuuucaaaauugguuguuaaaaguugaaaauauauuuuccaguuugucagagaacauugcaaaaaauaaaaaagcaagcucacuuaccucuggggcaaagucagcaacaugagucuucucuuucucuaaugcacuuugagacacaaacauggggaaguagcaguuuucaacaccaaguuucuugaucucagcaucaaaaaaguccuugauggcuucccaaauggcauaggcccagggacgaagaauauaacagccacuuaugucaugguauucaaucauuucugacuuugugaugaccuuuuuaaaagaaaaauagucuuuaaagcuuacauugaaccaaaauucuaguauaaguggcaagaguaugauaaccaaaauucaaaucuggaggcuucuacuguugauaacauccccuuaaugugggaggucauaauggaaguaaaacagaccugacuauacugaaaaacaacauauaacaggguuccaaacucuccauaaaacuugaauuccaccgggcauuguggcuuaggccugcaaucccaggacuuugggacgccgagguggguggauugcuugaggucaggaguucgagaccagccugaccaauauggugaaacccagucucuacuaaaacuacaaaaauuagccgggcgugguagcgugugccuguagucccagguacucgggaggcugaggcaggagaauugcuugaacccaggaggcggagguugcagugagccaagaucgcaccacugcacaccagccuaggcaacagacugauacucccgucucaaaaaaaaaaaaaaaaaacuugaauuccaauccugccucugcuauugacuauaucuuuguggcuuugaauuaaucccuuuaucucaccuaaaaaaaaaaaaucaaucacuaucucaugguacugcuuuucaauucaagacuuuauguuaacauguugaaaaauaaugucauguuaaaugacuacacuguguauuauuaaaggcauuauacaacauuauuacuauugccuuugugcccauauuuuagaaucugaacauaaaaagcagccauugacagacuuaaaacauaaaaaucaacugaaugcauacucaccugagaauaccaaucagcaagauuuucuucuuuuuuugccucaagacccaaccugcagaugugaaaaguaaaagauaaauaucuucauucagcaacugcuuuagguugaauaaaaauaaaccucuaaaguucaaaauagauuagucuuucuucaguaugaguuauuucuguauuuguaacucuucuauauucauucccaagauaacguuguuguuuucuuguuuuguuuuugagacagggucuuacucugucacccaggcuggagcgcaauggugugauccugucucacugcaaccucggacuccucagcucaagagauucucucaccucagccuccccaguagcuaggacuacaggugcauacaacaucuggcuuauuuuuuuauuuuuauuuuuugguagaggcagggucucgcuauguugcccaggccagucuugaacuccuggccucaugcaauccuccuguucuggccucccagagugcugggauuacaggcaugagccaccaugccuagccccuaagauaauguuuuuaaccuaaaaaaacaguagaaaugcugggcacaguggcucacgccuguaaucccaccacuuuaggaggccaaggcaggcagaucaccugaggucaggaguuugagaccagccugaccaacauggagaaacccugucucuacuaaaaacaaaaugagccaggcgugguggcgcaugcuuguaaucccagcuacucgggaggcugaggcaggagaaugaaucgcuugaaccugggagguaaaggcugcagugagccgagauugcgccauugcacuccagccugggcaacaaaagugaaacuccgucucaaaagaaaaaaaaaaaaaaaagaaagaaacaaaaacagcagagacaucucuuaaaaaguugagagauauuguccacaaaaucuaggaaagccaaauguaacaaaagcuaugauucuaugcagacaucucuuuuacaagguucuuuuuaaggcaauguauuuguaauagagacacagccuguucacaccuauucucccacuaaaaaagaagaaucuuaugccaguuaaaauuauaguaagaucacuguuucacugaaaguaacaccuaaaaaguaauaaaaacaauggcuauaaauacacacacauauguguguguacugaugugugcauauuagccaaauuuauguaaguuuuucuuuuucuuuuuuugaaacagucucaccccaucgcccaggcuggagugcacuggugcaaucuagacucacugcaaccuccaccucccagguuuaagcgauucucgugccucagccccccucccccacccaaguagcugggauuacaggugugugccaccauuccugguuaauuuuuuuguauuuuuaguagaggcggagcuuugacauguuggccaggcuggucucaaacuccugaccucaagcgauccacccaucccagccucccaaagugcuggcauuacaggugugaaccaccacgccuggccucaaguuuuucuuuuaacuagaauaaaaguugcagagauagaugcuuguaaaauaaacuaggucuccaauaaaaaaacuauuucagacaauaaucauuuucuugaaauaucaacaauuauucaggauagagauggucucuuuuuggaguuuaaaaacaagguuuuacuggcuaaaaauuuuaauguauuugcauuugcauucuccauuguuucacuaugacauaccucaacaaaauaacucugugaaaccuagcacuuucacaggcacuaagaaaguaaaaggugagaaguucuacauucucuucuacccugcuauaacucugguuauucaguuuaauagucaaaaggaaaaauaacuguugcauucucuuguuuaaagagacauuguguauaugacaugagagcuaagaggcagcaaaauuugauacucagcuaaacaaauguaaaaccaaaguaucucaguaacagcuuuuucuucuuauuaaguaagccauuaagggaaacccaucacaaaguucacuguaauuguggaaacagauaaaaaauuacaauuaugcgucacuuaaugacaugaauacauuuucagaaauacgcuguuaggugauuucaucauugugcaaacaucauagcuuguacuuacacaaaccuagaugauauacauauauuuuuauauggaaaaccaaauaucccagcaacauuacugaauaucaauaauuucccccacuugaucugcgaugccaauaucaagugccauauaucagguuuccauacaugcuccauuauaaucuuauggaccaaugucauauauguaguccacuguugacugacacaucauuaugugguguaugaccguacauuauuuauacagauuggaagauccuuaaagagcccucuauccaaccauuuugucuuuagucaguuuugucuuauauuuaaacuaucaauuuuuaaauugagaaugaagcucucacuuaguccccacaaaagaucuucaucugaaaaaaaucugcuuaaggugcaaaacaauguguauaauuaggcuaccaaucauguuuaaaaaggaggagagaaaauauguauguguguguguguguguguguguaucuguauuuacuugaauaauaaaugaaaaucgcucaacagauacagaagaaacuguuaacaguggcuacugacugauuacggugguggggaaaaccggaaagaugggaaacaugcacaggaacuucuuacauucugagauucuugaaccaaacaaacguguuaccuauuuuuaaaacuaaauggaaaaucaauaaaugcuaucugcugacauuguagcuuuagcguucucuaacuuaaugugaugguuaaaccagucaaaauuuguuuuaaaaacuauuaagaauugaauuaauucacugcuuugcuucaaaugaaguuucugcgauucauuaccuggucuguuucuuaggccccugcccuucuccugcuccacuugaugagagcccaccuccuugguuuuuagaagggucuuuccuuuggccaucauuuuguuucugaggcuuauucugcuuuucagauuuauuuucuuuuucuuucuucuucuuaucuuuguccucagcuccaguggccgacacaggcuuauacucuacuccuaucaaagacuuguacugugccuuuagcugaaggaguucuugaacagcuauaucuacuugauccuuuaguuuaacaaaagaggaaaaagagaagacaguauuuaacucaagucauugucuaagcacacuuaaacaaauacaaugcucaaagcuuucuuuuuuccgccaauaucacacggggaaugugcccagguggugauaagguuugagggaggcauaucucacauaugagugugaaaacccaaccaucacacuuaggaacuacaaaaggaucuguccaaaguuuaaaaguagaucugcaaacacaauuaaagacagggguuuggggacagagggguuugggguagguguuacaccaacuauugaaauuauaaagauuaugauaaacagggauagaauugugcaaaacugugacuggaaaacagcacagucuauaacugcauuauccaaauaguagucauguggcugaauuuaauuuaaaguaaauaaaauuaaaaauucacuuccucagucaccacaaucacauuucaaaugcucaauagccacauguggcuaaugacuacuguauuagacaauauuguuauagcauauuuccaucacugcagaaaguucuacuagaaagcacugguaucuaacauguauuccauaggaaucuaaguuaagagccauuaaauuacauaaguugaacauuucacaauuauaaagaugagauaaugguuaucaaguucuaauaaaguuaaauuucaaaacuacaacugucuuccacucaugugaaucuguacagaaaaaccuacuccuaaaaagauaacagaauucacacuuaaagaacuagcacaaacuacuaagagcucaaaauaaaaccuacuauuucaguuugacagagcuuuaggagaaagaaugaaaaacaagguaaauauuaagggccuucaauggggugagcacugugcuagggucuaggucacuauucuggaucuuacagguuggagggaaacaaacaauuuaacaauuaaaauacagucuguuuaaguacuaugucagugaugggcggugucauaugaaaacauccaaucaaaucuaguuggcguaagaaacaaucaacaaaguuucucuaaaaggcaagguaagagaauuaagaacugaaauaugaguagaaguuagccagauuugauggggcacaaaacacuugaggcaaagacaauacccugaaacauaaaaaacaaaagcauauaaacaaaauaacacacuaaccuuaggggcuuuuucaguuuuaaguuuccgaacuacuuccccuugagaagcuacuuugucaaaaaguacuuucgcuucugguguuucuaaaccagcagguucagaauuucugguugggcuugaauccgaacuuugagauaaugggggcugaccagguauguacuccuucccaguuuuuucuuuauacugagccuucagggacaguaagcauucuacagcuucauuuauuuuagccuaaaauaaaagagagaaagagauauuuauaaaacuuuggaaauuucuggaaauuucaaugccauuuaaaaaucuuuaauuaucagcaaaucauucccauaaguuaaucauggggaaaccuauguuaaaucaucagccuacaauaagugauaaagcuaaauuaaaaacauaaauuauauauaagcugaauaaacaaaaauacaauucaacauacaacaguguaacuuucuauuuuacuuaaguaaacagacaaauaauagaacaucuaaguaaacugucagugucaagaccuaggucuauaaauagugaagucagaauuuacaaaaucagaacaaagaucagaucaauggcuuugccuauacaaaccuuacuuuccacagcuuauuaaacagaaauuaaauacaacuuuggggaaaaaaaggaaguuuggguccaacuaaugaauaguuauaucaauuuuaaaaacugacaaugagaugagaaagcauguugaaguuuuuagacacuuaccuauauauuuuaaucugauacuucaacauaauaauaaaaaagaaugauauacucagccccaccgagacacuugugacucucuagcagagaaugauagcaacacaggcaaagggcccaagcuggacaccuuaccugaaauggugcuacuaucucaccacaaaccaguguaccacugggaacuuggagguaucaaucaaaauagauaggaaaagugucuccaaaucacccuauccaauuuuuacugcuacauucgaauaaugcuccagauagcuaaaugaaaccaggcagaagccaugaagaauacucaaaugggcaucagaggaaugcaggauaccaaugguauaccuucacaaaauuugcaucuaugaggcagcaaagcacauuuccuuguccagcuacuuuauaacguuuucugccuauuagagugucauaccagguaccacacaaagguaguaaaauuaagagaaaauguacaaagagaagaugagaguagauugucugauuuguacuccuguugugucucuuguuuauucuguuuuuaggaaagaguuuucacagcagaaacuacuuuaucucaagaaaaacggccaaguuaaucagacauaugagaaucaaggggggaaaaaagggaaauuuccaccagcuaaaauaaaaauggaaaagaaggaacuucccugcaacuauuucuagaaaaaugacuauuugaugacuauuugaaagaagcuccauuuuacacuauaagcagguauucauuagagcuuaaagucagauggcacacuuuucacacggaaaaaaaaaaaaaaaaccccguucgccaagauuauaauuugaaacguuauaaaggagaaaauuaaggugagcaaaccacucuguuauucaaugagauacucuuaauaaagcuauguauucauauauuuccccucccauuaggaaauggaauauucuagauaacuaaguaaauuacucagguuauucuuccaaaaagaguaaaauuauacuaaucaccacuaugcaaucuucccugaugauuuagaagguaccuaaagauucuugagagaauuugaauuauaauaugaaaaguaucauuaucauuuuaugguauauuuagucugugccagacacuacacuaagugcuuuacgugguaucuuauuuaacucucaaaacaacccuuagagaaguugucaaguuuagaaagauuaaguuccuuccccagaguuacacaauaaguaguagagcuaguauuugaaucccgaguuuauuccagaggcugugaucuugaccacuacgguuugcuaaggauuacagaaaacaaagaucuaaaugugcauuuuaauccuaguaacaugcuaggaaaacugcuuuucgaaagagauguuugacuauuacuuugaauuuaucucuuagaauacacaaugaagaacaaauggauggagaacaaauuaucucuuaauauacuaguuuucuggaucaaaaggcauuuacaaagaggaauugggugguauacuaugauuuaguacaauaucauacaacagcagaagcugagagagcauugcuaguagauuuuaaguuguuaguggacaaagacuguuuuaaacuuaccuaacauauaccaauacaaacagaaaagguuuucagcaaauaauugcugauguggauuaaugagaaaagaaacaaccuauacaaaagacuuugguaaagguuuaagaugggaauuggaaauaaguaaaagugaugcuaauguuaugacuaaaaacuggaaaguuaaauaaaauggagaaaauggacaauuuuuuuuuauuacauucugauuacauucagaaugaguacucaaacagcuauuuuuucagcagccacuagauggaaacauuucuccauggggaaaggagugaccuuaaaaaaaaaaaaaaaaaaaaaccuggaacauuauccauuugaaauacuagaaccuuucaaaauagccuggauaucucgauucuaaaugaaaaaacuuuuuucaaaaaauacuuuuuucaaacuuguuuuuuccaauuuuauuaccacucaccuuugcuccuuacuagcauaucuaagagaacuauaucuacacacguugguaaugaugacuccugaaagcagagauucucacuugguugggagggggaugaaugaaagguaaucagaacagaaaauccuuccaacugagugagggaagagagugaugaugcuuguauuauauuuuuuaaagucugcuaggagacuaaguaaacuagaaguucacagguugcaaagagaggcauuuuaagaaaauaauuaaccaguugugcauagcuuaaauaccuacaccuguaaggaauaaccgauuacugaaaccugauucuaggagccaauacagcacaggguagagccgagauccugacaucaaaccuaaauuagaacacaacaccuguucuccugcuuaucaacugggcugauucguuuaccuaaaucacaauuuaccugcuauuuuucucugauacaaaucaauuaacacaaauucugaagauuuuccagaagauccccaagcugauguaagucuugugaaguauccugaaccauaaucugauguaagauguauuuauauuuguuuagaucaaaaucaauuuugcauuaaguacuaaauagauauagcuggaauucacuacacacaucccaaauaagaauuacaaacaacaucaagaaaaagauaggcuuuuuucuuguuuccuucccugcaacauuuaucuuuuggccugagacaucuuaaagcuaucuggggugagagugcaggguggcggcuuccuagaacaaccugcuuaauggacaaaaggguacagggauguauguccuuuccugauaaacugugguuuggguuuuaaaaaacaauaacauugguguaaaaaauaaaagagcaaagauuggcaagaugaauuauuggggacauaaaauacaaggugccgugaauuaaaaugcugcaacuacagaagcaaauggugauucaacuccccuccacauagacuggguauggcauagagagagaacauuagugacaaaacaauugugaauuauuuuuauuuaauaaucauuuuauuuuguuguuacuugauuuuuaaacaacuguuaacuacaaugguucucaaaacucuuucuuccauggagggaucagcaaacuuuuucuauaaagggcuauauaauaaauauuuuagacuaugugagucuugguugcaacuauucaacucuaacuguagcaugaaagcagccauagacgauauguacaccaugaguguggcuguauuccaauaaaacuucauuuacaggccggguguaguggcucacgccuguaaucccagcacuuugggaggccgaggcggguggaucaccugaggucaggaguucgagaccagccuaacaugguaaaacccugucucuacuaaaaacaaaauacaaaauuagccaggugucguggcacgcgccuguaaucccagcuacuugggaggcugaggcaggagaauugcuugaacccaggaggcggaggcgccaagaucucaccauugcacuccagccugggugacagagcaagacuccgucucaaaaaaaaaauucauuuacaaagaacaggcguacggccaggcccagcagcucacaucaguaaucccaacacuuugagaggucaaggagggcggacagcuugaguauagaaguucaagaccagccuuguuaacacagugaaaccccgucucuaugagcaauacaaaaauuagccaggcauacuggcaugugccuguacuuccagcuacuuaggagacugagaugagaggauugcuugggaggucgaggcugcagugaaccaugaucaagccacugcacuccagccugggcaacagagcaagacccugucucaaaaaaaaaaaaauuguuuuaaagugcuuuaguuuuuaaaguaacuuaguauucaguguuauuauaucuuugguguauucucuguuaugcaccucacacuacaccaacuugauccauuauuuuaugcagcaaccuacugagcaggagaaaaagaauaagaggagcaaaagaugguagacuugauggacuucaaguuuuuauuacuugcccgucuuuuugcuuauacuuugccuuuacacuuaaaaguucuuucauagaagcaucuaucugauccugaagcaggaaagagaagauuaaaaacaaaacaaaaaacagagcaagaaaagucuaguugaagcugguaaccuaaaacuucagcuggucaccuuccuuaccauuuaacaugacauaguaaaauaaccaccuuuguagaaaacugaauaguuaagaagcuuaggcaaauuauuaauguaaaacaagcacagacuugcuaaauaaugauaagcuaguaaaacuauaacucucuagcgcuuucaauggaguaccccacugucaccaccucucaagguaaauaacaugggaaucggucaauauuuuaaucuaggcuuugcaaauuucaggaaguuacuuucauauucaguuucuccucuguugcuauaacaagcaaauagaaaaaguagcauucuuugaauauuuuuguacauggcucuugggaggacuaaaaaguguauaguacacagugccagaugcaggcuaaaugcguuccauuccuaguaacuggguucguucuuuagaagagaagaaacauuuacuacuauuagcauucggagaaaaaauauacggaguacagcagguccuugaauaacauuguuuuguuugaugucauuucaucauaacguuuuagagaaaaaaaacaugauccccagccgaagccacugucuguguggagcaugugcauucuccccaugucugugugaguuuucucugggaacuccaguuucauuccacaucccaaagcugcacacauuaggugaacuggugagucuaaaugcucccggucugagugucagugugugugagugugcccugcaauggaaugaugucuuauccagggcugguuccugccuugagcccugagcuacaaggaugggcucuggccacccaaaacccugaacuagaauaaauggguaaauaauuaucuugucuuuauucaucuuucuuaaauguauauacagcucacauuuguuucaauuagaaguguuugggucuuuauuagaggucuguguaaugcaaaaauaauaauuuuaaaaagaaaagacaaaauauuaaaaaagaaaaagaaaaaaugaagacaacaacaacaauaaaaaaacacaagaaguuuguguaaugcgauguuuuugagaucagaaauaugccgugguaacuucuucuuuuuuuuuuuuuuuuuuuuuuuuuuuuuugagauagagucuugcuguugcccaggcuggaguacaguggcacaauaucucagcucacuccaagcuuucccuccuggguucaugccauucuccugccucagccucccaaguagcugggacuacaggcacccgccaccacacccagcuaauuuuuugcauuuuuaguagagacaggguuucacuguguuagcaaggauggucucgaucuccugaccuuaugaucugcccaccucggccucccaaagugcugggauuacaggcaugagccaccgcaccuggccuacuuaauuucuuguuuaucucaauuagccuauuguuguuaugcaccauuuugcuuaaagucucaguuuccaagaaccuaugaacaauauuaagacuuacuauauuuugaaacacagacaugguauacaguaggcauucaauaaauguaagucagacuaaacugaagucagauuuauuucaguaucacauuaguauuaaaauaccuaauaaaaguaccugcccaauuaccaaagaaauuuagaucuuuuuaccuuaagcugacuuuucauaaccucaacagugauauuuuaugaaagcaugauguaacccauuaacccaaaaggaugggugauggauucauaguugacugucacuccaaguacaacgguugcuucuguuacuauuccacccauaauuaagcugaccaaaaauuggcacagaaucucaauauauucuacuuauacaaugaauaaauuugaagaccaaagcccuucccuccaaauuacaccuaaaaaggaguacauauuuaguguccaacagauacagugcaaaaugcucccaaccuccccaugagguaagaaacaucuggaauuuauauccuaaacucauacauccagcagcauuuauuccuugaagcaaagcuguuuuagauaaucaugguucugcgggaucucaacaggcuauuuaggcugcugcaaaaguaacugugguuuuugccauuaaaaguaaugguaagaaccgcaauuacuuuugcacugaccuaauaaaggauuucucaacaguucacaauggagagacagaaaaauauuaacuccuggggcaagaccucaaaauaugaggucaaauauucaugaaucaaaguaucuuagguggcaguguuucaugucagaugccagcaacuuguugauaaggugaagaacuuacugaauucuccagccugagccuaggacccugacaggacaacagaucugacauuuuagaacaaauccccuucccgccacacaagucaagccuagugguguaccauaccucucuguguaugugccacagccuaaauucuacaauuucuggcagcucaucaggggcugaauuguuuuucguugcaguacuauuuaucugaucaugucuuaaacuaugcugcuguuugaggagaacuacauaccuucauuauuaaauacgaucuuucacagucuauacagaugccauucccuuugucucuuaccuacaucaaguaagcccauuucacacuaggugccacaccuacuuggcuaaauguuuugccuaaggacauacugaaacaagaauauaauuuauacuucagucaaaaugucauauaauuugaaggcucugcuaugaaaagcuggagauaaucacaggucaaaaaccucuugacaauccauuuguuauuccuugaauacaccuuguaccugcugaccucuaccucugcugguacuguccucuacaccaggaguucucaaagcauggucccugggacaguagcaucugcaucaccugagaaacauuuuagaaaugcguauucuccacgugcucugaaucuacugcagaagaaagucaaagggcagggccuagcaauccauguuuuaccaagccaguaauucuggugcacaguaaagcuugagaaccaugguuccacacuuaaagagugccuuguugugaucuuuguucccccauaauggcugcuucuacuucaggaugauuuuaaauauccuuuauaaaugguuuccaccuuuguugccacuuaagaacacaaacccuuuacauagcaacuuauacauaucacaaaggauuacagucacaucacauaagaguacacugagucuguauguuuccuuccccaguaagucaccccuccacuagauuaugagcuucuuauauauauuuucagagcuuggcacauagcagguaucaaucaauguugauuauuacaucaaaauaugagcagucgauguuuuauaagaagaugagacuacucuaagcaguuugaauucacacacugaaaauguggucuugacuuucucuaacauacugaccuuaggggauuuuucagcuuuuagcuuacgaaccaccuccccuugugcagcaacuucaucauacagagauuuacuuuccagaauacuugcugaggaauuagaagaaauauucuguccuauuucagcaggaggguuuccagguuuauauuccuggccaguuuucuccuuauauucagcuuucaaagacaaaagcuguuuuacagcugcaucuacaucuuccuuuggugcuuucuuggcuuuuaauucacgaaccacaucuccuugaacagccacucuauuguaaaggaccaaggaauccucagauguaguacaauuauuauucagagaagguguuggucuuuccuuaaaaggagcagaggucuaccaagagagaaaaccaaaaguaaaauaauuaauucauauuaaauguuuucccacaaaauuauuucaaacugauuguuuuauaauguuuccaauuaaaaacagaaacuuuaaacuucaaucccuuaaaaagcuuaaaugaauaaucuccuaaguauuuauccuaaugaaaaaugacaggcguaaacaaagauagagguaccuacauacucacugaagcauuuuuacuauaguaaaaaccugaaaauacccuaaaucuuugucauuaggggacuaaagaaauuauaacauauccaucaaguuugagaauaaaucacugcucuaccacauacucacugugcaacuuugaguuauuuuaagcuguuuccuuacuauaaaagggggauaaccauacuuaacccaucaaguugaugggaaaauaaaaaguaaucuguguaaagcccuuagucacaaaggcugagaaaaagugaauaucaauaagcauuagguaucacuauuaauuuuuuuagagaugaaauacaucuagauuguugauaaggcaagagcuccaucaaacucugugauauaauuguaacucauuguuguggaacaguuucauuuguguaaaauuauaaauuuacagguaucuauuuguguauaaaaucuagagcuauguucacuaaaaucaacccugaagagugaauaaagauacuauuuuuauucaugcuuucugcugccuagacugcauucuucccuacugaaacccuucuaacauuaaaacccagcucacauuauaccuuucuuucagcuuuuuucuuuuaaaugaucugccacuuaauuuuucagaauaaucuuauccauauucacagucuuauguacaaauuccaaaaauuuucaucucuauuccagaauucuguccugaucccagacccagcauuuucaaugucuucaagacaucuuuaccuagacacuuaacaggcaucucaagcuguaucagaguugcauuuuacacaggcguuaggcucucaaagugggcaugucaguaaaaaaaacccaucgcucaaaauuccuuccccauaauuccuuaaaucacucauauuuauuuuuagugagauucuauauguacacucaaacacuaauaugcauauauaaaugcauauacauuaaauaaauaauacaauucauguagccacccuauaucaaaaauauauauuuguucagcuacauuuuuuuuuuuuuugagacagugucuugcucugccgccaggcuggaguccaguggugugaucucagcucacugaaaccuccgccucccggguucaagugauuacuguuccucaaccucccaaguagcugggauuacaggccugcaccaccacacccagcuaauuuuuacauuuuuaguacagacaggguuucaccauguuggccaggauggucucaaucuccuggccucgugaucuguccaccucggccucccaaagugcugggauuacaagcuuaagccacugcgccuggccuguucugcuacauuuaauuugcaacauaaaucaucucauucaugguuaguaaacaggggaacauaugaguguaacaccaaaaaaaaaaaaaaaaaaaucacacugccuugugugugauuuuuucccuguguauuccaguuuuaugucaaauaaagaagcaugcaggaacaagcuuuucauaauuaaagagaaaacuuuagaaauacauugacaaucugaagaaaaacccaaaaaccuuucauauaagugccuuccuuuaaugaggaugaugcuuaaaaaacauuuuuuaccauaacauuaagcccuggaugagaauuuaauuuugauaguaucagccucuauuggagaaaaauauccucaaagaucuacacaucacagggaaaagcauuauuauccuucagguuuaaagcugcaaaggaucucugacugcaaaguuggguauaaguggcagucaacuguaccugaauauugaauuucuauucaaaagugugcagguuucaaagcauguccacaaauuuuuugacuuuccucccaccaagaagggggaucucugugcccuuuccugaaucugagaaagcuuguuacugauuugaccaacagaguacagcagaaaugauguuaugugagacuuacaagucuaaauccuaaaaugcaaugcuacucccaccucaucuacuggacacucacuuuuggaggccuuaaaugauaguuaagaagucuuauuacccugccacugucaugcuagagaggccacuugcagcuauugcagucaacuauuccaccugagcucccagccaacaccaauaucaacuuggcauccaggugaggaaacaauuuuagaauccagcccaggccaggugcaguggaucaugccuauaaucccaguacuuugggaggccgaggugggcagaucaccugagguaaggaguucaagaccagucuggccaacauggcgaaaccccaucucuacuaaaaauauaaaaaaauuagcugggcaugguggugcgugacuuuagucccagcuacuugggaggcugaggcaagaaaaucgcuugaagccaggagguggagguuacacugagccaagaucauaccacugcacuccagccugggcaacagagcaauacucugucucaaauaaaauaaaauaaaaauagaauacagcccaguugagucuuugaugacugcuacccagccaccaucugacugaaaccacaugggauacauagguuuuuagugguuugccucaacucuguuuuucuugaaaaaucggcuguuauuuucgguaugugauuuugcagaacaugaaguuuuucaagaacacauacuaacuuauagcauaacaccaguuaucuuucuaggauauguaaaaaaugauaggcacagaugggaacuggaaccaaugagggaaaagcaaccaaauuucccaucucaugcuuacuccaugaguuauugaauaauauauaguagcaauuuucaaggugugguccacagaccccaagggguauauaaaacccuuuuaaaggggaucugcaaagucacagcuauuuucacuauauuacgauguauuuugucuuuuucgcucucauucucucaugacuguuuguacagguuuuuagaagcuauuaagucagauauuaaagagaucuguaaaaauuuaaaaccauaccgcucuuuuaacuaaaauuuuuauuuuggaaaauuuuuuuuaauaaaaacuuuucguauguuaacauguaacuggauuuauuauuuuuacaugaauuaaauccuuuuaaaacuucucaauuuuuaguaugauaaaugcugauaaauauaacccacauaagcaaaucauucuuaagaguauaaggggucuggccaggcacggugacucaugccuauaaucccagcacucugggaggccgaggugggaguuucaccugaggucaggaguucaagaccagccaggccaacauggcaaaagccugucucuacuaaaaauacaaaaauuagccgggcgucauggugcacgcuuguaaucccaacugcucaggaggcugaggcaugagaauugcuugaacccgggaggcggagguugcagugagcccagaucgcgccacagcacuccagccuugggugagagugagauuuuaaaaucuuacaugaaaggauaacaacaaaaugcaaagagcaagacuuaacugucuucuucagucuccacaguaagaaagauaaucaucuguaaagaaauauauucuaaacccugggauagaaagaccauuuauuuuuauacacauauccguaaaagucauuaccucauuuuuuguggcuucuacuuuggucuuuuccuuugacccugauguuggcauuuccuuugugugcccaucaggaauguauaucaaaacacacggggcuuccuugcaacuauaugggcuaaaaagaaaauaaagggacaaaauaguuuauuugaacaaaauuaucugaacagcaauaaacacugaauuccuagauaaauucaauggcacuaaguuaaugcuuuucuuucuuuuuuucuuuccuuuuugagacagucucacucugucgcccaggcuggaauguagugaugugaucuaagcucacugcagcuuccaccuccugcguucaagugauucuccugccucagccuguaaguagcugggauuaccagccacaugccaccacacuaauuuuuguauuuuuaguagagccuggucuugaacuccuaaccucaagugauccggccaccucagccucccaaagugcugggauaacaggugugagccacugcaccuguccaguuaaugcuuuuugaaguauaaaauaguccauugucuuacuauucaaaucagaggcucuucagaauaguuuuacaaacaacaaaugcauaaauaaaaauugacagucuuggccgggcgcaguggcucaccccuauaauacuggcacuuugagaggccaaggcggguggauugccugaguucaggaguucaaaaccagccugggcaacacggugaaaccccaucgcuacuaaaauacaaaaaauuagccaggcguggcggcgggugccuguagucccagcuacuccagaggcugaggcaggagaaucacuugaaccugggagacagaaguugcagugagccaagaucacaccacugcacuccagccugcgugacagagugagauucugucuccaaagaaaaaaaaaaaauuggucagccgugguggcucaugacucuaaucccagcacuuugggaggccaaggcagguggauuaccugaggucaagaguucgagacuagccuggccaacauggugaaaccugucucuacuuaaaaaauacaaaaauuuagccagguaugguggcgggcgccuguaaucccagcuacuuuggaggcuggggcaggagaaucgcuugaacccaggagauggagauugcaaugagcugagacugcaucauugcacuccagccugggcaacaggagagaaacucugccucaauggaaaaaaaaaaagaaaaaaaauugacaguccuuauuacaaacuuccaaucuaugaacuuucguccauaugaacaaacuauguccagggcaaaauuauaucugcuaugccugccacuagaaagggcguuagugaauguuaaugauacucuugacuucaagaaaauuugucuacauaccacaccuaaucugcuuauaagcagaaaaauuucuguaaaacauuuauuuauuuuaaaauauuuaaggguggguaugguggcucacaucuguaaucccagcacuucggggggccauggcagguggaucucuugagccgaggaguucaagacuagccugggaaacauggugaaacccugucucuacaaaaaauacacaaacuagauaggugugguggcacauaucuguagccccagcuacucaggagacugaggugggaggaucaccugagccuggggaggucaagccgcugcacucaagucugggugagagugagacccugucucuuaaaaaaauaauaauuuauaagaauuucucaauuucaaaggguauaguaauuagcaauaaucuauugccacuuuuuggcaauuaugaauaaugcagcuguaaacauucauguacacauuuuugugugaacauguuauuuuucuuuggcaaauacgcaggaauggaauugauggaucaaaugguaacuccguguuuaauuuuuggaggaaucauccaacuguuuuuccaaaguggcugaaccauucuacaacccuaccagcaauacauauggguuccaauuucuccacauuucuaacccuuguuauugucuuuuuuuauuucagccauccuagugguaugcaaugauauuucauugucauuuucaucugaauuucccuaacaacuaaugaugcugagcaucuuuucaugugcuuacauuuguacaucugcuugaagaaaugucuacuuaaauccauuguuaauuggguucucuucuggauacaaguccuuuaagagacauaugugcaaauauuuucucccauucugugacuuaucuuuucacuuucuuugaaacacaauauauguuaaucuugaugaaguccaauuuauuuuuuuucuuugguugauugugauuuagguguuauauccaaaacagcauugccaagguuacaaagauuuacauucacguuuucuucuaagaguuuuauaguuuuuagcucuuacauuuaggucuuugauaaauguugaguuaauuuuuguauaugauaugagaaagugcccaacuucacucuuucauguguagcuauucaguucuucuagcacuauuuguugaaaaguucaaaaacuuucuaagaauaaaaugagaaccuacucuguuauuuuaguuggugguaccaccaccauuacuaaauacuuaaggagggcuuagcaacuauuaggcacuaugcuacacuguaugcaugcgugagcuuaugugacuaaaggaaaugugauauuaaaaugaauaagguuacucauaugacgaaaaagccacaaggccauuccaggaaaaggcaucaagugcuuuugaaaagccccaggcaauuugguacauauguuaaaaagaagggaucagggcgagaaaacuccaacaccuauggcucaagagacgccguaacaugaaaaaucuugcauaucaaacucaaaaguuuagccuuuacucugaaacuaacaacaauguuuguuuguuuuugagagagucuugcucugucaccaaggcuggagugugguggugcaauuauaggucacuguaaccuugaacuugugggcucaagcaauccugccgccucaccugcuugagcagugaggauuacagguguguaccaccaugccugguuaauucuuuauuuauaauuuuuuguagagauggggucucacuauguugcccaggcuggucuugaacuccuggccucaaguaauccucuugccucagccuugcaaagugcugggauuauaggcauaagucauaguggcugcccuacuaauagagauuuuuuaacaguagagaaaugugauaaaacuguuacucuuaaauuuucagacuggugggcaugugaaaacugaacagaaaaaggaugaaauuggaggcaaggagauaccugagagccuguuuuggcaaucaaggaagcaauguuauagccugaaauaaggcagagcaguggauccacagagauggaccagaugggcaacacaaacgacagaguuugcugagugaaaaaagggaugaaggggaagcauaagucaaagaugacaccuagauccuggaauuuugaacacguugaguuugaaaugcuugaaagaaucuauucacagauaucuaaagcaguuagauucacaagacuaaaucucaggagaggcguuuugacuacacaguuacagagauaucacuuaaaaaaauagcagagacaaacagaaaagaaaaaaaagggacaaaaauuuacauagaguucuccuucuaauaauccuauuacuucaugguuaaaaaaaaaaauacaaauacugguuauuucuucccucuaaauguaugcuguuuguaccauuuaucuagugaaaauacacuacaaagaaaaagauaaugguaauaauuuucacccaaagauagguaauauacagacugaaauuuuguucuuuauacuugggcuacaggaaaguuaauuauaagagguuuaauuucagaaaugaauaauuuauuaauguucaaugugcguguuguuucaaagaucacuuguuaaaauaaauuacuugucuaaaauguuaaauauaaaauaaaacugagagacugagaaagaaaacuguuagguacguuauuuuagugaaaguucaauuucuaaaauauuacucacuauaacaacuuuaagcauuuucauuuagacguucaguuacauuuacuuaccuaacagguucauaagguugaucacauaugaagaauccucuucucuggaguuguauaauaucuccuuuuuucaaauccuuaaggcagggauccccuagcauuagcucuucaugcuguaaagaugauauaaaccaaaguacacuuucucaaaaucauaguaguaaaauaacucuaaaaugcaagcaguuuccacuaacuaaaauacucccauuuuaaacagauauguuaaaaaguucacuacuugaggacacacaaugaaacggugaaguguuaaaugacaauucaauuuaucacauuuuuaaaaguuaacauucauaaacuggccucaaaaaaccuuuuaaauaacuugauuagcauuccagaagaaauaauuucccugcuauaaauaugaaauaugaugcaagaagcauguaauagacuuaggugaaaggcaugcuggcguaaggcuuaaauacgagggucagauuugaaucccaacucuacuauuuacuguuuguccucagguaaguuacucaacuucacuguguuucacuuccuaucaucuauaaaauggaaacauuacuuacaucguuuuuuuuuuuguuuuuuuuuuuguuuuuuuuuguagagacgggguuucaccauguugcccaggcuggucuugaacuccugagcucaagcgauccacccaucuuggcuucccaaagagcuaggauuacaggcaugagccaccaugcucggccaacuuacaucauuugauuuaaauaaaauucuacacaucuuauccauuuuaucugaggauccgaaauauauaaaauuaauuuuuuuaauucuaaaggaaaauuuaaaaggugaaauaugguuucuuuggaagguuaccuuacuguucuuguugacauacugcuuaaaguccucgucuuuuccuagcacuggcuuugugaucaagugcucauaagugacacagauuacuggaauaggaagagcauguguagucucugcaagccaagugaccuuagugguuuucuuguagucuuuguuuuccaaauucaacuuugcaucaagagauaugauuuuuccaucugcauuucuagauauaagauuaaaaguauucaaagaaauauuaaccacagcugccauaaauucauuauuuuguucuauaauaauuuuauauuauuauaaaauaauuuauuguuuuauuuuguaauaaauggauaagaaauuuucuuuggaaaaauuccaaaucaaacauuuauuugagcuucuaacaugccagacauauauugguuaauaaauacaacauaaucacugacaucgagauacuaauaaucaacuagagaacagauucacauacaauugaugaggaacauguauauauuuauuaacuuaaagucaccugcaucaagcauuauaaaauuugaauuacuauguuuaaaaacauuuggcaguuacuugcaaucauauguaauaacuacgcaauuaagauuucagaguuugcauaaaucagucuuaagcauacuauguuucauuuauagaaucugaagaucauauuccuaaguguagcacacuauaguaacuagaaagucaaauuaauuauuaaccaaucaguuuuaaaguaaauuuuaguaaaaagauuauguuauacauauaaauucugucuaaaagauccccaugucaugcaacuguauagagucccuuuuuaucauguaauuucucauuaaagcauuacaacuauuuuuuauauccagauguaguaauuuucaacaccacaaauaaaagacaucuugauagccuguuaguaaacugaaagauauauggaaaaaaauuuaacuuguguccagaauuugcaguagcuaugucugggcagauuuacuagucagcaacauguaugggucugaauuugguaauguuuaauaaguaaacacaaauaaaauacuuuucuccuauguuuauuugaaaacaaacaaaaaguucuuacuuguguauuuuuguaauguugagguugccccaauuuauaaauguaaccaucucacccuccgaaaaagucucugcaucagcaccuucaaugaaaacuuugggacuauaccacacaggcuucaagccaaccucaggauucugauugauaaagaaaagcagagugucuguugaaacaacaacuuauugaacccaguaugcaaauuuauacauucauucuauucuuuaaccauacaaaagucuucuguguuacuaaacuguuagcaguucauugcuguauuaggaagaaaaugcuuuacucuuucuccaucuauguauuuuaacauaaacauauucccaauucuguucuuagcauuuaaacaauacauacucggccucaauagaaaucaauaguuugaauuccagcucugugacaucagaucagcaaccugaccacuaauguuaauggaauuagaugagguagcuugccccuaagauuacuuccagccuacaagacucauugauuucacagcuaagacaguauacuuuaucauuuaguaucucuucaacuagaaucuguuuccuauccuuagaaucccacugcuucgccgggcaugguggcucacaccuguaaucccagcacuuuggguggccacugcuucgcugggcaugguggcuuacgccuguaaucccagcugaggugagcagaucacgaggucaggagaucgagaucauccuggcuaacacggugaaaccccgucucuacuaaaaauacagaaaguuaacugggcgugguggcaugcaccuguagucccagcuacuugggaggcugaggcaggagaaucacuugaaccugggaggcagaggcugcagugagccgagauugcaucacggcacuccagccugggcaacagagcgagacuccgucaccaaaaaaaaaaaaaaaaaaaaaaaaaaaagauaaaagaaucucacugcuucugcagcaaaggagaaaauaagucauucuugagcaguggcuaugggacauuauaggacaacagaugccaccuuagcaggaaauuauggaccuuucagauuuuagaagacaaacuuuaaagaaaguauuaucuauauagauauagauaaguaaauuuucugccuuucuaguguguaugauauggaaagaaaaagagaugcggagaauaaaaagaacgccauaauuucaguuuuuauuuggcagaauuaaaaaaaaaaaguaagaagaucuuuugaaauaaacauuaaccagcauguguuuaacaacuguucaaugaacucaccaaugcauuucagaaaaaucaguauguuuuaacaacagauaacauacuaagcucagaauagaauacugacaggcuaaauaaaaaauacuuugcgacggaaauguuauaaugaaaauuccacagagcaaacugaguaauccagucacaauuuaagagugugcuuccuuaacaauuaguucuuauuuuuaacaaugagcaguacuuaguaauuuaauuuuuuaaauuuuauuugagguagggcuuugaucagucacccaggcuggagugcagugguauagucacagcucgcugcagccuugaacuccugagcucaagugauccaccuaccucugagauuauaagcaugaaccauaaugccugguuaauuuuuuuauuuuucguagagacagagucuugcuauguugaccaggcuggucuugaacuccuggccucaaaugaucuucccaccuccaccucucaaagugcuaggauuacaggcauaagccaccaaccuagcaauuuaaucuaaacuaucagaccacaacugucauuuuaaaaaauaagcacccuucaaaacuuuuauucucaagauucaaauuuuaaaauauucaauaugcuucagauuuauacuaacuguaugguaggugauauggcaggucagauacuacuacuuaccuggucaaaacaaucagauauaaagaaagacaaagccaaaccaaucaacuaaacgcgcaccccaaaucuuauuaggauucaaaucuuuaaaauuaaaaaguagauaaugacauacaugggaagacaaucauauaaagcuacaauuuagaauauguauagcucuuugcaaugcacaucaucuuauaugugaguuagucuacgaacacaguuauaagcuuggcuacuaguauaugcguuagucugugaacguaauuuucaguauauaauaaaguuauuuauagacaacuuguaaagcugaaauaaaacaacucuuuuaccagccugggcaacauggugaaacccugccucuauaaauaccagccuuggcaacauggucuaaaccugucucuacaaaaaaguacaaaaaugagccagauaugguggcaugaaccuguagucccagguauucaggaugcugagguggaaggaucacuugagaccaagauagaggaugcagugagcugagaucaggccacugcacuccagccugagcaccagagcaaggcccauuucaaaauuaagaaaaaaaaaaaaucuuguuuugcuucaaaauugucaacuaagcagucauaaggaucugggaugaccacagcuuaacaaaaaaguacucuaugguacuuguauuuaagauuucuauucagggcugggcacaguggcucaugccuauaaucccaguauuuugggaggaugaggcaagcagaucauuugaggccaggaguucaagaccagccuggccgccaacauggcaaaaccccaucucuacuaaaaauacaaacauugcuggguguaguggcgcacaucuguaauccaagcuacucaggaggcuaaggcaugagaaucacuugaagccgggaggcagaaguugcagugagccagaaucaugccacugcacuccaaccugggccacaaagcgcaacugucucaaaaaaaaaaaaaaaaaaaauucuauucagaauuuagauggacccuucacuuauacuuuccaaacagaggaaaugacaguguaagagacucugaagucaagcugugauucaacaguaguaggucuaauguuuuggcuuaaagacaaaggugacagggaauacccuaguuaauagagaaugcacuucagauuccauauaaagauaggagcuugaauuauaacucaucuuucaggauuacucuaggaagagauaaauucuuauuacacacuaauaugcuaacucuacacaauaaaaaauaagcaccaacugagcauaacaguucugugugauguacuauggauuguuacuaaaauaaacuuuuuuaaggcaaaaaauccaaaaaagauuuacuucgauuaguaucaaauccugacaauguugaauagaaaaucaucucagccuggcgcaguggcucacgccuguaauuccagcacuuugggaggccgacgcaggcagaucacgaggucaggagauugagaccaaccuggccaacauggugaaaccccaucuccacuaaaaauacgaaaauuagcuaggcguaguggggggcaccuguaauuccagcuacucaggaggcugaggcaggagaauggcgugaacccgggaggcagggguugcagugagccgagaucgccccacugcacuccagccuggagacauagcaagacuacgucucaaaaaaaaaaaaaaaaagaaagaaagaaagaaaaucaucucaaaaucaugccacugccaugaaagcacauuuuccuuuuuauuuccugcuccuucuuuuaacagagagaaacacauuggugaaacuguaagagugaccuuuggguguuuggcuacuucuuucaucuccuccugagcuucagguacauucacugggaucacuucuuucuucaguaaugcaacauaucguggagccacugggucaauaaccugcaacaaauacauccucauguuaaaacacugcgauaucuuauagagcgccauaagcaaaauaaauaauagcacaggaauacuaacuggcuuucuuguuacugcauuuacuaauuuuuuuucaacuguuaacucuuuucugauauuuaccauuaagcagaaaaaagagaacaacuguaaaccaagacuacaugaaggauuuagacuucuuucacaagaauagcuacuggcaggugaaaagaaaccaauuaaagcauaauauuagaguuauuuugaaaauaauuuuaaaaucugguauuagaaggcaaggaaaaguuuuccagugggguuauaucuuaauccuaaagguaaaugugauauucaauuuuauaguuuggacaagcccauuuuaagagaauauggauauuuuuguuucaguauuguuuucuuuaaucaguguuaggguaacacaucaccaucaaaagcagaauagcauucggucacuauaauaaggcaauucuauagauuaaaaguauaaaugacauuucuacugguuuacaugcuauauguagaggccaguauauauagaccaguauauucucaguauauucccaguaccuagcuagggucugucucauauagguaaucaauaaauauuugcagauugccucaauaaauggucauacacauuaugcucuaaccuauucuacuuccaaaucaucaguagcauccccuucuggagcugauguauuuuucucacuucacuguucaguguaaaauuagucaugaugaccaaucacaagagcaauguuuagacacuauauauaaagcacaugugagaaaaauguagaugaaagcagagucaaacagcuaaguaauggaaguuauuuuuucucauuagaagaaugcagaaaacagugguauaauuaaauuuguuuuuauuuuuccauuguugccauuauuggguugguuuuuuuugucaguguugaagguaguuuucagcuucuaaaaagaaugauaucguggaaauucugaaugaacucagagaggaagccauccucagagaggucauucacgcaaaguuugaaaagcuauuuaacuucuccucaucugcuaauccucaucugcuuauauuucaugcuaauacuaaaucaguaccagccuuuuucaaguuuacuguuucauuccuuccuugaggcuuaaaguucauucuuacuagcuaaggauuucuccuuucagcuucuacugggcuggaauaaucaaagauuuaauucgugacugacuacucaguucaguauuuaagucaguaagacauaauuucuuuaaaaaaacuaaaacuagacaaccccgccuaagaaacuuaguucauugcagcuguuuccuccgcugccaaaaggagcaggauguuuccuauacuugacuaauuuuaaucaccacuuggggcaguuguuagcacagauucugagacaacuuggucugaaguaaauuucagaaaucuaauuuuuaacaagcauuccauaggaugguuaggaucaggcauauuugggaaacuuggauucaaagacuuaaaagguauuuuuagcucuaaaaauaugcaauucuaaaagucucuggaucagugguuuucaaauuacuccaaagaguccuaaauauuucaaagaggugcccugguagcacuaaguggagguggaaggaccagagggccuccagauccccuucauauacuucaaccagaacagcuaaguuuuuguuuuauuuauugggguuuaauucugguagcacuaagugaagggggaaggaccagagggccuccagauccccuucacauacuucaaccagaacagcuauguuuuuguuuuauuuauugggguuuaauuuucaagaaaacuuucacuggaaggaagucuccugauuuguggaguggggagagaagucucuacauacuuuauuagcugagaacagaugcaagggguugagaugagaguugggaaaaauuauauuauacuacugaaauacauacauuuuaaaacuaaagcagucaauaaggguucauagagauugacaacagcucuaaaaugaacaucuuaaaccugugacucuucugccuugacugaaaaguuaaaaucuuaacacuuaaauaaaagcuagaagaaaacuagugagguuaaugcaaaguaagcucuugaaaugucuccuaccacuaucaaggaaaaaacuauuuauagauauauuccauuuaacuaugauacagaaaaauaaaguacuaguuuccuaucaagaugaaaacucaggcugagaaaacaaggaucacgguauugucgaagggauauugagauaacuaaucaccccacaucucuuuccccuucauccauuucucccuucuuuucuuuaccacguacaauucacuccuaaaauaaggcucuuucuccaaagaaucaugcaaauaaaucuagcuuauuuuuuuuaaaacagaaccugcuuugaaaaaaaaaaugcuaaguuagugaagaguaggagaauguccaaagaaugaugauucagcucugccaguaacacuuacuucacaacuccacggcgcuaaauuuaguucacugaugcuucacuuaaaucuuaccugcagagcuugagaagaaagacagagcaagcuagaaaacaacaaagcaguaauuagagauugagagugccaugaacucuaaauaagagggguauguaccucaagaguugaagggaauggguuucaguguaugaagacaucaugaaggccagcaauagaaacaaaaaguaaugaucacaaugauuuccuuuuuacuaccaguugacuaaaaacaaugcuauguuuuaaagacgguguuuaaugauuaaagaucucacaggauuuaggagaaaaaaggcagacugaaaauacucaucaacuuucacucuuucccaacccccaacuuaaaagaaaugaaagguuuuguuuuguuuaaaggaacaaauccagaaggauuaauauaauaaaagaagagaaggcugggcacaguggcucacgccuguaaucccagcacuuugguaggccgaagugggcggaucaccugaggucaggaguucgggaccagccuggccaacauggugaaacccugucuauacuaaaaauacaaaaauuagcugggcgugguggcaggcacauguaaucccagcuacucgggaggcugaagcaggagaauugcuugaacccaggaggcagagguugcagugagccgagaucacgccacugcacgguagccugggugacagagcgagacuccaucucaaaaaaaaacaaaaaagauaacagcaacaaaauucuggaagcugaaaaacauagaagcauccccuccccacuccauauaaccaggcaacugccucuccccuaccuugacaaaagacuggaaguuuacucugugaauaagaggguaucuagauucuggcagauaccagaaagagccaaaggaaaggguacugcacgagagacaaugggaauaagugaauguaugauaguagauuuauaaaacccucagcagucuucccccauuuggcuccaaagccuggcagccaggucuucacacuucaggaaggcgauucaaugaagccccucugggaaaacugccuaauccuugagaaaagauauaaaauuacugacauggaauuucuccaacaaacuagcccagccagaucauuguacagugaagcucaguugaaagcccaacucucauucuucaggcuuccaaucacucuuuauuuccccacauuaaacauaagcagauaaccaaggcucuaaccagacaucugagaaauaucuuuaacgugaaagaaaccaaaauaaacaaauuggggagaagagacacuacucugcagaaaacccuacuauuaauaccaugaaacaagaauagagaguuauuuugaaaauucagagaacaagagaaacacuggaacuauaguagcauaaauaaaauucaacagaaaggugggaagauaaaaauuaaguagaucugugauaaacuaaaagacaagaaggaaaauaagacagaacacgaaacaagaguaccaguccaagaggcccaacaucuucccaagaagaguuccaggagaagaaauacacaauagagaagaaagaaaaagaauucaaagccgggcacaguggcacacaccuguaaucccagcacuuugggaggcugaggcggguggaucaagaggucaggaguucaagaccagcuuggccaagaugaugaaacccugccucuacuaaagcuacaaaacuuagccaggugcaguggcagaagccuguaaucccagcuacucaggaggcugaggcaauagaauugcuugaacccaggcagcagagguugcagugagccgagaucgugccacugcauuccagccugggcgacagagugagacuccgucucagaaaaaaauaaaacaaaacaaaagagaaaagacaagacaagagaaagaaaauaaaagauggaaagggaaagggaaagggaaagggagagaauucaagaaaauuucccagaacugaaggaaugaguuucuagacuggaagucacauguucuuccaaugaugcggaugaaaacagacccucaccauggccuaucaucaugaaauuucagacuaaaaacacaggucagauacaagguuucaaaauuuucuucaucccauccuccccuugucagggagcuggacugagucuccaaagaaugacguauuaccuucaggaaagcaagaagguaauauaaaaaaaaaaaaaagaagauccaagaauggggcaauguucuguaauguccauuacagaauaaaagcaaagggaaucccuaggaagaugcugaagagaccuaggaagauagcuaugcuucagaaaccaaugggccaugaauccaaaucagguuacagagcagcacagaaggcucuggcaaaugucuccaaaaugaaacugaaaguauaccuaaggcaucugaauaucuuggugggaaauuugcacaucuuguggagacagaaaaguaugcaggggggcuugguggcucacaccuguaaucccagaacuccgggaggcugaggugggcggaucacgaggucgggaguucgagaccagccuggccaacauggcaaaaccccgucuccacuaaaaauacaaaaauuagcugggugugguggugggugccuguaaucccagcuacucgggaggcuaaggcaggagaaucauuugaacccgggagguggagguugcagugagcccagauugugccauugcacuccagccuaaguaacagggugagauuccgcuacaaaaagaaaaagaaaaaagaaaaaaagaguacgcagggguggggagaggaaaaaaaaaaaauuaauuuucuuuuuuuuuucuuuugagacagagucucacccugucacccaggcuggauugcaguggugugaucaggacucacugcggccuugaccuccugggcucaagugauccucccaccucagccucccaaguagcuagaacuacaagcaugcacgaccaggccuagcuaauuuuuuuuuuuuuuuuuuuuuuggagagaugggguaucacuauguugucuaggcuggucucaaaaucccaggcucaggcgauccuccuaccuuggccuucugaacugcugggaguagaggcaugagaaccuggcuuuuuuuuuuuuuuuuaacagaaaaacaaaaacaaaaacaaaaaauaagcaaaugagagggagagacaaagcaagacaaucaacuacaagcaaaccaaaaaguuaggagaaaaaguaaaaggucaaauuauuuaucuuccaucacgggaagucaacuaauaugucuaaacauagcuaaaaaaguaguaacacauauauuucauucagcaauauaagcaacaggccggacacaguggcucacgccuguaaucacagcacuuugggaggcagaggugggcggaucacaaguucagggguuugagaccagccuggcgaacacaguaaaaccccaucucuacuaaaaauacaaaaauuagccaggcaugguggcacaugccuguagucccagcuacucaagaggcugaggcaggagaaucgcuugaacccgggaggcagagguugcagugagccuagacugugccauugcacuccaccgugggcgacagcaagacucuaucucaaaaaaaagaaauauaaguaauaaauaccaaaagaacuaucuagaagagaugaaagugcuuucuccagggagacuaugaaaguagauagagagaggaauguguuguucaucuuaacagacccuacagaacuauuugacuauaguaaaauauauuucagauaucugaaguguccauguuuaacuuuauuaaaacuuaaaaucaguaaaaauuguauuguuaaugaaaaguacaccaguguuaacuuugccagcaaauucuacucauauuuauuauuaguaacugcagcaacagcaagaaccaauuaacaauuccuuuauguaucaaaaacuaaacacgaaagaccaaaauaaaacaaauucaagacacaugcgaaacaagcaacuauaucuugaggcaagacaucagcaccaucaagcagcaaucccaaauaagaauuuacagaacacaaucacagaaaccauaauuuaaaacauggcauuugaaugauuugccuuauuauaguguccaagcaucugcuuuccaauuaguaauuaacaaugucaauaggcaauguuccucauuugacuuucaguuaagaaacaguuaaaaaaaaaaaagcuggauucaguaagacaaaggaacuguaauuaaugaaacuuuaauacaacucaaugaaauacauacuuuuagaauucuauguccucucagcacacaagggaaugggguagaauagaguuaucccaauauuccccuuggcacuaagaaaaccagaggacaugguuuuuaacacuaggaauaaugcauuuucaaugcguuuguauaagcaagucuuuuauauaaaugugauugugcuucaaagccauauaacaucucagguuuuaacauguaauaugcuaaaagcuauguuuaaggcaaauaaaagcauuaaguaauaccuucuuacagagagcucgcagcuugaaagcagaaaaaugaaaugcagaguguucauaaaaaauuuaaggaaaaaaauauuacuguuccccauaauuccaaguuuguuuguuucaaucauuguuacuuauuuggaauaguuaauaggcuuaauuaaugcucuucguguauuuaaaaaaggaaaacauuccauuuuccugaaagucugcaaaauguuaauauucuucacaaacuuuucucuaccaugagcacaguaaugacuucuacuuguacauuauuugggacuuaagcaugagaaaagaaggcagagaguuaacauacauaccuuuuuguuaaacgcccagauuuugucccacuccauguucacgacugaacgugaggagcccuaaaaaacaauaacaacaugauuuuaagggcaagcaguauuaauuagaacuuugccuuuauuucaugcuaagcauguuuagaaaaaaaaaaaaaacucgauaaauacuuucaaguuuacuucuagugaaauauaaaacucaguguauacaaacuaauuugguuacccuuaacaguucacuguaaagguucagucuacagacugcucacagucaagucauauaauucacugcuaaaaauacuucagcugccuuucuccaaaucuagcuuaggaguuuaggacauuuucaauuuuucacuauuauaagcagugauaaacuuuaaaaaaaaaaaaguuuguuuuaaaaaaaaaaaaaaaaucugcccuuggaucauaaggcacaaacaaggaauagaaagaacaacagagauaauaaagaguaaagggacaguaauagaaguaccugaaauuucaaacagacaagcuggaaaagaaacuguaacgcaccugagcagcaauaaacuguuucaguccuucaacugucaucccucuucucaguacaccacgaaccguaggaaaucuugggucaucccuggaaauauguaaauuuuaaguaccaaggaaauuuuguaauguguagauguggagaguagaagauacuuaaucaauaauaaaucauauucagcuuguuaaacauuugucuaagagcuaguuauacuaauuagguaguaugcaauacuagugagcccaaauucaaggaacaggauaacugcugaccugucaaauacugcaguaaaauaaaugcacuacuggaaacaguagaagcacauuugaaaaaaaagacacaauggugacauuuucaaauauggaaaucccaugcauucauacauuuuuauuuaucaaacauuuucaaggucccuauuccacauaggaccaugagaaucagaaaaaagaugguauccugucauucacauaugaauauacuuuauaaagcccuuuggaauaaaacaaaaauauauguaggaaauuaauauucugcagggaucugcaaaccucaguaaguaugcaguaauacccuuuucauggagcucaagauaaacuuuuacaucuucacuucgauucaaggguauuuuaaccuucuugggaccuagccaaaaagaaaaaccucagccucagcagagaguagagaucaguaaccaaauauaccaagaaccagaaagucaaaacuguucuucuauuaaaugcuaagaccugcagaggaugugcccucauguguguuuuucauuccaugauccccagugggcacuccauuauuuguggcauuaaaacaagaaggggaagcccuaaugcacuggcugagaagaagauaagaaucaggaauucuauaggccuacccauucccccuccucccaaucaccuucccuaucucucaagcaguuuaaaaaucacugaucuacuauguccuuacuucuugucaauucuaaguaacauuaaacauaccauccaucuacuaguccuucauugacaaaccaugugaguuuucuuuuggauagcacuguguuguugagauuuagccgacuauauucccaaauauaugguuuucuuaugccuaaagcuucaauaauccaguaaaacugcucaucucugucaugguauucuguuguucucagggcauguguaacaccuucgaugcugucaacuauggggcaggcaaaaucauauguuggauaaacacuagaaaaaaagaaaauaaaauaaacaaaacauuuuacccuuucccucuuagauuaagcauuauaaacaacaauacuaauuuaaaauguaauucuuuacaaguuaagagauucuuaaaaaccaaaagguuuuaugacuuaauacucaaaguguaucaaaacauuaucagccuuugagaacaaugagucaguugucaacuuagcagucaaacaaaaaagcaaauuugcaaucuaauacaaaauuagguauuggcuuggcaaauuguauaaucauaauauuucuguaauggccaauguauaacauaguaggaagcaauaaauaauacauguaauaauuuuaaggaaauuuagcuuuugaacaucuuuuuuuuugagacggagucucacucuguucugaguaaucccuuacucaaguaaaucccuaaaagucuuaaaaguacucaaacacacucaaaaacagugcuccauucacuguguaaaaaaaaaaaaccgacagaagaccagaaaaucauuaggucaaaauuacauuuaagaugaaauagucuaaaaaacaguuucugacuaagauaauguauacaauuuacaugcaguaucaauuugaauuuauauauauauauauauauauauauauauauauauauauauauauauuagugcauuaugcuuucuuucuuuuuuuuuggagacagucucgcucuuuuacccaggcuagagugcaccggugcgaucucagcucagugcaaccuccgccuccuggguucaagugauucucagccucccagguauagaugggauuacaggcaugcgccaccaugccccgcuaauuuuuguauuuguuuuaaaguagagaugggguuucacuauguuggccaggcuggucucaaacuccuggccucaagugauccacccaccaaggccucccaaagugcugguauuacaggcaugagccacuacacccaaccaaugcuuuccuuuuuguuugucuagagacaggguuucacucuguugcucaggcuggagugaaguggcaugaucacaacucacuguaaccuugaacuccuggacugaagcaaucuucuugccucagucuuccaagcagcuagaacuacugaagcgugccaccauaccuggcuaguuuuuuuuuuuaauuuauuuuuugguagagacagguucuugcuauguuucccacgcugguuucaaacuccuagccucaagagagcuuccugccucagacucccaaaguguuggcauuacaggcaugagccacugugcccagccauuauacauucuaacuuuuaagauacaacuugauuaagaugcuacugcauuaugcuuugcaauuauuugacacugaaaauguguauccaaagucacuuuuccaaauguauugaaaggauuugcuuaguaaaacaaggaguaauccugagaaaaaugauauguaugcacauauaaucacauguguauuugucuauauauggacagacaugucagcacccaugaguuuaaaguaagucacaucagcuaaccaaguaaucauuuacauuuaccauucucuucagaaauuuuaauucagcauuuauguguaguacgcuucuucaaaguauuaaaaaauauuuuuuaugauuuauuuuauaaaguaggguuuuuuuuuuuggaaaagguccauuuaaaacaaagauucguuaaccuacaaauccacauugaaaacuaaucuaaacacauguuacucuccuguauuguucauauuucuggaaguuuucaauacuauuacuuuuaggaaucaauuugugcaaaguagacucaaaguuuauuacaggaagcaaaguaucuucaccuaaagauguacaucacaguauaccuaaucaauacaaaaaaagcaacucuaggcagacucaggacuuucauagauggaagugaucuuagaaauaaugugguagaaccuuaauugacaggugaguaaacggcccgugaaaggcuacaugccuuuacagaaggccaccagccagugaacccauggaugaacaaaaggccagguuucuugacuauuuugcuuguacuccauguuuaaagaagaucaaaacaaaagcacagauggcuaccuagcauauugaaggagauauacuuacuuguauuuauuuccaguucuuggaugugguugaauuuugcagcgauaaaggguuggaucucucaugcauccauuguuacuacucaugucaauuuuugcucgcaaacaacaggacugaccaaacuggcucccuuuuuucauuucuucccacauuuguagauucuucucaauagcuauaaaaugauaauuacauuacgguucacuaaucugguuaaauucaaauuauucucauagugcuauaauuugauauaaauuuucauguucuuguuuuauaaccacccuguguuaguuuaaaaacacuguaauauuuccaguauccaguaccaagagcaaaugcgucauuuuuuaauuaaagaaguuucacaauacauuuagcaaauacaaauacguuuuagaaaagguaacaucaauacauuccacucaugugguaucaauuaagcauaagaaaaaguacaaggccugaaggcuccgcucaccuaguguuucccuucccaucauggcacaacgggccagccccuucucuucucaucucccugaaauuuaacauucugccuuuaaagcagaagcauucuuauuuugccaccucaugccuaagggacagaaugguuugguccggcccuaaggucccacaggcauuggcacuacagaccgugccuaucuaaagaacacagcucagguugagagucugagcucaugggcucccugaaagccccuucaucaucccaaugagaagcaggauacucuuggauccaagaaaauaagaggugauagaaaacagugacacaggaaagaaaagaguuuaauaccagaaaaaaggacucuacauuccaaguggcuauggcucccucuauaucacaauaucuagcaaaaaccugcccuguaugcauacaaacuguuaaacaauaauuuucuguggaagcuacuagaaauguaagacacuugcccucaaauaaucaagauaggucuaaaaguccauugguuagccaccucugaaaauguagaaaaccuuuucaaaauaaaaaagacucauuauaacuauuuuaauuuacuaauacuucccaaauguggcacuccagguuuaauuauagugaaguucugacaacauaauuacagaaugaaaaucacccaauuuagaaguucaggagagaagccaugaauaagaaagauaugcucuucagucaagugauauuucagagauacagguuaguacugagcuuguacuauauauuauauucauauuuacccacaugccaaaaggaagacuugggugacaacauuaucaucaaacauuguauuauagaaaggcuaaguauuuaaaguaagaaaacuguaaaauguugcagaaggaauccuucaaauugaaugaauacaaugcaaaagacuacacauaauaagugagauacuaagggcauauucacaugcaguugugauguuaauaaaauaacaagaacauaaagauagaggaagaaaaaagauuucuaagacaaaugagucauauacccaaauguauuuaaacuagcagcuuuugccagauacgguggcucaugccuguaaucccggcacuuugggaggccaaggcaggcagaucacaaggucaggaauucgagaccagcuuggccaauauggugaaaccccgucucuacuaaaaauacaaaaauuagcaaggugugguggugcacgccugucaucccagcuacuugggaggcugaggcagaagaaucacuugaaccugggaggcggagguugcagugagccgagaucgcgccauuguacuccagcccaggcaacagagcgagacuccuucucaaaacaaacaaacaaacaaaaaaacuagcagcuuucacaaaaaagaaaucacguucuacuaaagaagcacaauauaagaauaucaauuaaaauauaaaacaauguggcuuacgguuuuuucuauguuuagagucuauccucugcucacguucugcuuucaucuguucagcaggaguaucauccacauaagccuucccuucuugaauuagcuucucugcauacuucauuauaguuucaaaaugauccgaaguauaaguaaauugaucugguuugauaugcaacauugcaacaucuuccaagauaaccuguaguaagaaaccaaaauaaccaucaguauaucuuuugcauuuuuucgugcauuuucaacccuugauacugcauuuaagcaaauguaacauagaccaucagucuuauuuagccugaaaaugguuguggaaguuacaugauauuagaucaaaaaagaaaaaacagauagauacucauuauauuagccuccaaauuuccagcugagaaagcugaucucacgauggaguuuuccauuuacuuuggaaaagcuggucauuacugggagaacugacaaucauuugcccucucuuugaauacacugccauacuucugaauaaagauaagaggcuaggaaaccuucacauuuuccaauaccuacuuaguguuuauuucauucauaaacuuaagauuauaugaccaaaaaaccugccuccagugaccauuuaauaaauugguauuauaggaaaacauaucauucagguaaacucuauaacuggggaaaggaaaaauaacucuuaaguuuuuugguaugggagcucgacauuucuuggcuuaggucucagauauggaauauauagauagggaaaaaagcagcuaugagaacaaaauuuauuuucauaccaugaagguauuagguaauccuguaacuuuaauucacuuuucuggcaaagggucaucacuacacuuuuaauuaccuucucaaaaucuuccuuuucuuuuucaggauuugugucaucaaaucucaugaucaguuucccuuuaaaguuaaccugguagugcugguucagaagagcagcuuuugcaugcccaauguguaaguaacuaaaacaaaaacauuucacaaagaaacucauuaacauguuuuaacuaaauacuuaaacuuaaccuuuuugaggagaugagaacuaaacaaaaguccuucuaauugguacccaagucauauuuuauuuucuaacaaaaaguacugugauagaaaaucugacccugacaggaaaaaaaaaaaagacuauaccauauauaaaacaauuauaagaaacaacuucaaauguaaaaucucacagaggggacaagguauuuacaaacauugcaaccuuaaggagauucuccuuuuucuuuuuaucaaaaagaaugaucauuuaauuaaaguaaagcugcuucaaaauuguuuccaacgcuaccuuccacuguuugucuuuaauaagaccuacuacuacugagaacugggugcccaccuaugccacuggagagaagcucuucugagacugucacugugaugacuaaaugaaaagagcacaugacaauuaguaaaagccgcuuuacuucucuaggcuuugguuuucucagaugccaaaauaaaaguuuuuuuuuuuuuuuuugagacggaaucucgcucugucgcccaggcuggagugcaguggcacguucucagcucacugcaaccuccaccuccuggguucaagcgauucuccugccucagccccccaaauagcugggacuacaggcacgcgccaccaugcccagcuaauuuuuguauuuuuaguagaaacgagguuucaccauguuggccaggauggucucgaucucuugaccucgugauccgccugccuuggccucccaaagugcugggauuacaggcgugagccaccgcacccagccaaaagauuauuuuuuaacuuuaauuuuuuaacuucuauuuuagguucagggguacaugugaaguuuuguuauauagguaaacucaugucacggagauuaaaaauaaaagaauuuuaacuaaauaaucccaaaggucucaucagcaccaacacucaaugaaucagaaucuacaaaaacacuguucugcuguuccugugagcagcugacaauuguaaggaagaauacagaucagagacacuguugauaauaucacacaucaacacccuccuucuaucaaguacaugaguaaaagaaaauauguuacaccacuauguugaaauacaguugauugggcugacaaggcaugaagcaaggaaguuuaaucagcuuucaccaacuuguauuaguuucaaauuauaaugauggcagcagugguacaguuuuuuuuguuguuguuguuuuguuuguuuuuuuuuugagacggacucucgcucugucgcccaggcuggagugcaguggcgugaucucagcucacugcaaguucugccucucagguucacaccauucuccuaccucagccucccaaguagcugauacuacaggugccugccaccaugcccggcuaauuuuuuguauuuuuaguagagacgggguuucacuguguuagccaggauggucucgaucuccugaccuugugacccgccugccucggccagcaguuguacaguuuuaagauaguuaccugguuucccacacagguuugaucucaguugauauccauaugggagggggaaaaguuuaugaaauuauauuauuuuauaaaauaaaauaauauaaaaauucauaaaaguuuaugaauuuacauuauuuucaaaucaaucaaguuuuuaaaagucauuagcaucccagaucaaugauucaacuuuaagaagggcuugggccgggcacaguggcucaugccuguaaucccagcacuuugggaggcggaggcgggcagaucacgaggucaggaguucaacaccagccuggccaacauggugaaaccccgucucuacuaaaaauacaaaaauuggccaggcacgguggcucacgucuguaaucccaucacuuugggaggucgaggcagguggaucacgaggucaggagaucaagaccauccuggcuaacacagugaaaccccgucucuacuaaaaaaaauacaaaaaaauuagccgagagugguggcaggcaccuguagucccagcuaccugggaggcugaggcaggagaauggcgugaacccgggagguggagcuugcagugagccaagaucgugccacugcacuccagcccgggcgacagagcaagacuccaucucaaaaaaaaaaaaaaauuaucugggcgugguggugggcgccuguaaucccaacuacucgggaggaugaggcaggagaauugcuugaaccugggagauggagguugcagugagccaagaucgcgccacugcacgccagccuggacaacagugcgaggcuaugucaaaaaaaaaaaaaaaaaaaaggaggguuuauauacaaagacuaaugcaaacaacuacaaugcaacauauuuagggcuauucaaaacuuuauacauauaauaaagggcuguacgccgggugcaguggcucaugccuguaaucccgacacuaugggaggccaaggcaggcggaucaccugaggucgcgaguucaagaccaggcugaccaacauggcggaacucugucucuacuaaaaauacaaaaaauuaauuaauuaauuaauuaaaaauuuuuuaaaaaaagggcuguaugugauaucccagaugaaaucuuagaucagaaaagagauacuagggaaaaacuaacaaaaucccaaaaaaggauggaguuuaauaacauauuaauauuaguucauuaguugugacaaauguaccauaauaauguaaaauguuaauguuaggaaaaacugggugcaggguacauggaaacuuucuguacuauuuuugcaacuuuguguaaaucuaaaacuauucuaaaauuaaaaauuuauuaaaaauaaaacuaaaugaagggccauaaguucccaggaagaaaaauauugugguguacuuuuaacuugagggcguugcacccaauaacauguuauaaccauugucaagaaaagauuaacaauuaguaccuauuauuuuacaguuaaugugcuuggcuuuaaaauacagaaauuaauuuaagaaaggugaugagaucaaaacauuauuucaaaaauguuauuucuaaaucugcaggucuaacaauuccaaaccucaagaaagcuaagaggacuauaagucacaagacaacuaaaaucaucaguuaaagagugacucuauaucagaaucgcuaaaacacacacacacgcgcacacacacacacacacaaaagaaucaugcugcaugaguuagaacugaugcugaauugggcuucugccauauguuaacagauacauguaguacaauuuuuaauuauauggauucuagagccagaugguagagguuugagcuuggcaaguuacuacaacauaugaaucuguuuccgaaaccauuuguaaaacagagauaacaacagugccuccucagaaggcuguugggauuaauaaguuacuauaaguaaagcaugugguagcaccuguacauaauaggugcuauguauauguuagcuaagaauaagaauaaaagacuaagccaagccuucuggccuuucauuuaagacacagaaaagaaaaaaugaaaaaauaguaauuaaagaaaaacucuuuaacaguacaagaagagaugaugaaaacuaugcauaguaaaaaaaacuaaauacugauuuauauuccugaccccaaaacugucucaugagcguagucucugacauaauuuacaacagguaaauauauauuauacuguaaauauacaaacauggggaacucacuauucccagaagugacagugacgcaaaauaugaaaagauuuaaaaaagacaaauguucaaguggcgcagcuaaaaauggccacugccaaaaaaagguggcuuuuagacgaucaaggucacuauccaacaggacaaucaugaccucucauaccaagugcacaguagcagaauacuagaugguaggaacccaagaugucuauagauauuaaaccauguaagguaaguauuauuuaugccugaauccacuuagucaauuaccaaucaaccauuuaacgaucaagucugugaauuuuccacagucaucacuucuguuucaucuccuucuaucuacccuuuauuucaccuccugaaucagcaaacauagaaaagcagagacaaaaugugaaauucuaaaagcaauuuuacuguuaaugaugcuuaugaaauaguuugugaagaaguauuaaauacaucgcuaaaagaaaauuguuucuguaucuuccaguuucuacuguguacuauagaaaggugagaacuucauuauggugauagaauacaaaaucugaaaaaauuaaauuuggaaaucuuaaauuuggaaaaaauaaucaccucaauuacaaaacauggcagaacauuuuccuaaugguuaauuuucuaagugaggcuaacugcuuuaauaagagguauuuuauuauauuaacaucauuggaaggacgcuauuauaaagcuuguccaguauacuucaaauaggaugacaggugugcaaagacaaagacuuccuucucagccuuggggaauggugggcaagggcugaagcagccccagccuggugaucaccauacagaacagucuuuuucucuaaugagcuauucaaauacuacuuuccaugggugccaagagaugaagggguugggaaaccuaauggaaagaaaggaauaggaacaggcuuuucaggacuccccuucacuuggggaaaaaaaauaacuuaaagaccaauacuauuauaacuucaacugcuaauuaaaaggauugcucaggguacaaauacaaauccaauuaaaugaaagcccaaaaaucuaaaaauaaaaaugaaauuuaagguuucuuauuuuuggauauuuuguuaauuacauaauuaaaguucugucaggauaaaacuaaaaugucucuuuuacuaaguugacaaacuaaaacuacaaauuaaaucaacauuaacuauuaauaacauaaaaacuguuaaaacguuuagaauuuuaacucucacaauuaaaaucuuauguucuucuauauuauuaaccuauuaauacuuuaaguauuuaaucacuguuuuaaagcuuucccacuaaauauauucaauuauaaaugugaguuacauuuucuuacccacuggccucuggaggaaaucugacgguaaccuuucccaucuccgcaccuggaagcucaacaaauuucccaacaucuugcuuuuucucaggugccugaaaaacacaaccaccaucacaacaaaaagucuuaugguuaaaugucuaagaacacacucauucaacaaaugugccaggcacuacacacacugguuaugaaaaauaugaugacuagaacaucaucccuacacuugaggguacaaaaucugguuaagaauauaaauaaaaccaaauaccaguaauacagauauguucagggugcuguuagggcacucaguugaaauuaaucagcaauaccuagguuuaucaggaaaagcuuaaaagcaguuaagaaccaagcuggaccucgaagauaaguagaaauguaucagauggaguauaugggaugcuaggcacggugguucaugccuguaaucccagcacuuugggaggccgaggauggcagaucacuugaggucagaaguuugagaccagacuggcuaacauggugaaaccccaucucuacuaaaaaugcaaaaauuagcugggccuggcggcgugcaccuguagucccagcuacucaggaagcugaggcaggagaaucgcuugaaccugggagacggaggcugcagugagccgagaucaugccacugcacuccagccugggugacgagcaaaacucugucucaaaaaaaaaaaaaaaaguauaugggguauucauucuaaguaaauaaauaacagaguagguaaggcacaaaggcaggaaaaaguagugcaauguccaugaaaaguuaggaaugcauauuggguggguagggaaggaagccgaaauagauuaagucaaaaacacagaggaccuuuuaaguuuggcuuuuaaguuuuaggcaaugaggagucaguccucagggauaauaggaccguggauuuguguuuucuaaagugauacccugaacuagagaaagaugagacaaaaggaaguuuaguuaugagauuaugguauuaaaccaagcaaggaaaaauuaggccucaacaaagugcaguagcacugaagauggacagaaaacaaaucuacacacaugagaagucauaacaggacucguugaguaaaugugaaaaacagugaaggaugaguaaagauuuguagccaaaacaacugaguggacugggcuaucuuuauccaaguagacaguaguuuucaaauuuuacauuagaaaaccuuaauuaaaucaaaacuuuacaacacauuccuaaaguguaaaacagaucaaaguggagcaacucugguagagaaaaggagcuuuuguacuguacacuaugucacauuuuccuacagaaccaaugaaaaagugcugcagaaucccaggacuugaugcucaaugguucaaaaaccaggagauucagaagaaagaaaaaauugcaaagguguaaaauuaaugagguuuuauuuauauggaguuuggauugccuaagggacauacacuggaugaucaaaauauuuagcuauauaauuauaaagauuagggcuuuauauagaugaacaauuaaaugugaaaccaagacuuaaaaaugucagauucuugcaagaagauccuuuuaaauuuauuaaaagaaaauaaacuuuaugaguaggaauaauugucuuuucagaccuagggccucagacagacugaaaugucaucuuuuuuuuuuugagauagagucucgcucuguugcccaggcaggagugcaguggcgcgaucucggcucacugcaagcuccgccucccagguucacaccauucuccugccucagccucccgaguagcugggacuacaggcgcccaccaucacgcccggcuaauuuuuuuuuuuuuuuuguauauuuuuagcagagaugcgguuucaccguguuauucaggauggucucaaucuccugaccuugugauccgcccgccucagccucccaaaguguuuuuuuuuuuaaaaaaaaagaaaaaaaggcuuaccacucgagcuuugguuguugaaacaucccacuugguaccuacugacuggaaggccugcugggcuucaagaaagccaaaccaacguuuuacaugaacuggagcuuucuucuguuucaacuguucuugccaggcagcauuuccuaugagcaaagauaauuuuaaacuauucaauaaaucugcagcuucaaaagcaaaguuccaguugugacuaauugaaguaauugagauggcuuaaaguugugcuucuaaagaaaaugaaauguuaaauaucuggauauacacugaacuguuuucuaaaacaguuagcucucuguguccauggguuccauaaccguagauacaaccaacugaagacgaaaaauaugcaaagcugggcaugcugguuucuugggaccuggugaggguggaugauuacaaagcagcaugaggaacuuuugggggugguggauauauuuauuaucuugauuguaaccauaguuccacagcuguguguguguguguauguauauauacacacacauauauaugucaaaauuuaucaaaauauacauuuuuaaauaagugugauuuucuguaugucaauuauaccucaagaaaguuguuuuugaaaaaacugucuuuccaaguuggaaaaagcauauucuuacuuguuccaaacuaguuguagaagaaggaagugaccuccaagaaaaaccacaacuccacaucaucccacuacucccuaaccucccagucacacacucacugagcaauaauggcuuuuuucaagucagagacaagugucuggaguaaaauaauagcugaaguaggagaggugcuaacauaaaugggauggggacuucuuuaucaggaauaagaucagcuccaaaggcaagaaggaaguugggguugugagacagacgacgggacggcagaaaaacacagggaauucccguagcuggauaggaauaaaacagccagggaggucauuccccuguaauaaaguccuaaguuacugucuaaacauauauauacacacacauauacauacaugcauacacacagaaauauauauaauuuuuauccagcaaaauauuaaacgauuaaaacagaggauuauuaagaauuauugauaccuuuuaggguggcccaaacacauaaaucugcuaaacucaaggaguuuccaacuaaguauguucucagagacaggcaaugauugaguucauuaauuguagaaguaaaggaaucacaugaagauaauuuuguagcacugaacuccaaccagugaucaaucugucaacauaaaagacagaaaagaaaugcauuccaacauuucaacuuauaaaaagaaagaccauaaaaaaauucuaguuaacuagagcaacaguacacucuuacuaugcuuuuccuuucucaaauuauacaauuuaucauuauguggacuaaauucugauugccuaaaaucuaaaauagaacuuaaauaaaugccacauuuauuuugcuaugcuuucugcuuuuuuuuuuuuuuacaggaguguggcggggcacuucaggaaagaacaggaaaauaagaauuugagaauugguggcagaaauaagccaaccugaaugaaccgaagggaugguaccuagccaaacagauucauuuacuugaaaaauuuaaaaguuaguacuuagaaaccauucuguguacuuugaauuuuaugagauuuaggaagguuagagcagaauacaaacaggaaaaaaagcagcaucuaaaaagcaguacugucaucuacugcauaaugacauuucggucaaugacagacugcauauaugacaauggucccauaagauuauaguuuuaucuauguugucuauguuuagauacacaaauacguauuguguuacaauuaccuacuguauugaguauuguaacuugccaguauagguuuguagucuagaaggaauaggcuacacuguauagccuagguggguaguaggcuauccccuuuagguuuuuguagguacacucuaugauguugacagaaugaugaaacugccuaauaacacauuucucagaacgcaucccauuguuaagaggcacaugauuguauauaaagcuaauuuacuacugaaauaauuaauuaaacaaggcauacacuuagaaagaaaagaaaaugggauccaaacuaugcguguuacccuguucaaacuuaacuuuucuaggccugcugccuuauccguaaaguaagaaaguuggaugagaugaucuauacagccccaucuggcuaugaaaugcuaggaaucugugaaggccaagauggcacuaaaugcucccaaaaguacagcugguaggggacuaaagguucaaacuuaggaauuacaaaaaaagaauuuuuuugugacaaaaaaacaagaugagcauucuguaccuuggucuauauaauuaacacucuguuaauauccuuaaguagaauaguucauaagccaacaauaaaugaugagguucccauaaaaaaacagaagcauaagacaaaacacacacaacaaaauguucauugcuuaccucaguauguuccaucagauuagagccauauaacccagcuguaguugcaacucuagccaaguagcgaaguauagaauucacaucugugaauaucacauuucuagaauauaagcacgagauaaaauauuacugcugcucuagcaaaucaguaagucaugagacuuaugaagaaauguaaaaauggaaacuuuauuauauuuaccauguauuuucuacuauaguaaaaaauagaucuguuaauuguuuguuuguuucagaugcaguuucacucuuguugcccaagcuggagugcaauggugugaucuugguucacugcaaccucugccuccaggguucaagcaauucuccugccucagccucccaaguagcugugauuauagguggcugccaccacgacaggcuaauuuuuuguauuuuuaguagagacgggguuucacaauguuggccaggcuggucucgaguuccugaccucaggugauccaccugccucagccucccaaagugcugggauuagaggcaugagccaccacgcccagucugcuaauuuguucuuuacaugucuauucagaggugcaaauaugaaaauauaacugggauguugagaauaacagugauuuaauauaaaucaaggcuggccaaguguggugacucacaccuguaaucccaguacuuugggaggccaagacgggcagaucacuugaggucaggaguuugagaccagccuggcuaauaugguaaaaccccgucucuacuaaaaacacaaaaauuagcuaggcauaguggcaugcaccugugcucccagcuacucagaaggcugaggcacaagaaucgcuugaacucacagugagcugagaucacaccacuguacuucagcuugggugacagagagagacccugucucaaaaaaaauaaauaaauaaaauaaaucaaggcaaaggagccaagaaucuauugcuaauaaagaggcuacgaaggcagaucaaaccucauccaaacccaucacaagccaggugugguggcucaugccuguaaucccggcacuucgggaggccgagguggacagaucacuugaggucaggagcuugagaccagccuggccaacauggugaaaccccgucucuucuacaaauauaaaaauuagccgggugugguggugggcacuuauaaucccagcuacucaggaggcugaggcaggagaacugcuugaacccgggaaguggagguugcagugagccaagaucgugccacugcacuccagccugggcagcggagcaagacuccaccucacaacaaaaaacaaaaaaccacacacuguuggugggaguguaaauuagucaaaccacuguaaaaagcaguauggcauuuucucaaagagcuaaaaacagaacuacgauucaacccagcaaucccauuacuggcuauacacucagaggaauauaguucauucuaccauaaagacacaugcauggaaauguucacugcagcgcuauucacaauaacaaagacauggaauccaccuaaaugcccaucagugacacacuggauaaagaaaaugugguacauauauaccacagaauacuaugcagccauaaaaaaaaaaaaagaucaugucuuuugcagcaacauggacggcacuggaggccauuauauuuagcaaacugacacaggaacagaaaaccaaauacugcauucucucacuuauaagugggagcuuaacgacgagaacacaugaacacaaaaaagggaacaacagacacuggggcuugaggguggauguugggaggagggagaagagcagaagaaauaacuauuggauggcuuaguaccugggugacaaaauaauauguacagcaaaccccaugacacaaguuuaucuacauaacaaaccugcacauguaccacugaaccuaaaauaaaaguucauaaaagaauaaauucauuuuuagcaaugaaacaaaaauacugcaaucauaaaacaagauacuaaaaaaagaguauccagaauguaaaaaaaacagaacacucagauacuaaaaacauaauagccaaaauuaaaaaccucaauagaaaaaugggauaauaaaguugagaaguugaggaacuuuccagaaaguaaaggaaaaaaaaaaaaugggccaggcauguugguacacaccuguagucccagcuacucagggggcugaagcagguguaucgcuaagcccaggaguuggaugcuguagugugcuauaauugcaccugugacuauccauugcacuccagccuggacagcauacugagaccuccaucucuaaaaauaaaaauaaagaggccaggcgugguggcucacgccugugaucccagcacuuugggaggccgaggugggcggaucaccugaggucaggaguuccagaccagccuggacaacauagugaaaucccaucucuacuaaaaauacaaaaauuagccaggcaugguggcacaugccuguaaucccagcuacuuaggaggcugaggcaggagaaucgcuuaaaccugggaggcggagguugcagugagccuggauugugccacuguacuccagccugggcaacacagcaagacuccaucuccaaaaaaaaaaaaaaaaaaaauagaaagauggaaaauggaggugacaacuuagaaaaauaaaggacuaaucccaacauccacauaaagaaccaaaaauagagagaaaaacauuuuucaaagaaaaaauguuuucaauuuccaaaagcaggauuuccaaguuuccacaaugaaagaggcaaccaaaugcccagcagaacagaugaaaaauagacccaaacuaaagcauauuauuguaaaauuugagaauacugacuccuaagggaagauuccuccaaacuuccugaagucacauagaaaaguucagaaaucagaaaguuucagaagaaaauuacaaagcaaacaaacaccaauuacuccauggaaaacuaacaguuuuacaugaaaagcaauuauacuauguggcucaguaguaaauaaaacuuacacggucauuauaauguaaauacagaaugguaaucaaaugacaauuaugguacaacuacacugggagaaagggggagauagagagcagaaguuuaugaguauggggugacuguguguauguaguggcaacaggggaaaguguuucagcuuuaucuuuuuuuuuuuuuuuuugagauggaguuucacuauuguugcccaggcuagagugcaauggcacaaucucagcucacugcaaccuccaccucccggguucaagcgauucuccugccucagccuccugaguagcugggauuacaggcaugcacaaccaugcccggcaaguuuuguauuuuuaguagagaugggguuucuccauguuggucaggcuggucucgaacuccugaccucaggugaucugucugccuuggccucccaaagugcugggauuaaaggccuaagccaccacacccagcucaguuuaucuuuuuuuuuuuuuuuuuugagacagggucucccucugucauccaugcuggagugcaguggugcgauccuggcucuacugcaaccuccgucucgugggcucaggugaucauccugccucagccucccaaguagcugggaguacacccagcuaauuuuuccucuuuuuuuuguagagacaggauuuuacuauguugcccaggcuggucucaaacugcugagcucaagcaauccacucgcccggccucccaaagugcuaggauuacaggcuugagccacugcgccuggccacauacccuguuucauaggggagcagaaagauagggaaugcagauaauucuuuugagcaaaguaaaucaucagaauaaauggaccaggaagugggcgcagggaggugagggagcaacauuaaaggaagauaagaaacagagcggcacaggaacaaagacugucuuauuacacguguaaagucaccuagguaauaucuugaagcugcccucagaagagcaggugaagucugucugagcugggauugacugaccuuuccagauuauuugaugagauccacaaggaggggacuuaagucaacugcauuucuuuuggaaagaugcuuucuuggccagaugaggaaauucuagaaagucccucucuauaugaugggggaagugggcauguuggguugugaaaggaaacaagguuacagguacccugauucugagguagcuucuaaggccucucagcaugucaaagcgccagucuuugggguauugcuuucugaagcaacauuccccugucugaaacuucccuagaaguuucaguuaaaagcugaguuggugguuguacaggaaaaaaucaacagcugggugccaagggaucccauuaaaccagucacucauuucugggaguaggccaguccaauuaaauaacccugccucauuucaggagcugguguugcagaugggcucucaaagcuagaccucuaguuccuuuuaaacagacuacauggggaaucaguuugcugaaaaauuuaagucucuagauucaauucuuuuagaauaaagaaaaguauacuucuuucuagggacaaucuacuuaauuaguaaguaaaacaagcauacaacauuuaaugcugauuuuuuuuuuuuuuuugagacagagucuaacucugucacccaggcuggagugcaguggcgcguucucgguuuacugcaaccuccgccucccagguucaagcaauucuccugccucagccucccagguagcugggauuacaagcaugugccacaacaccuggauaauuuuuuguauuuuuaguagagacaggguuucacuguguuacccaggauggucucgaucuccugaccucaugauccgccugccucagccucccaaagugccgggauuacaggugugagccaccgcgcccggcgaugccgaauauuucuuuaaaugccauucagaggccaaacgugguggcucacgucuuuaacccuagugcuuugggaugcugaggccggaggauggcuugaggccagggguucgaaacugggcugggcaacacagugauaccccaucucuacaaaaaacauuuuuuaauuagccagguguggaggcaugugccugcaguccuagcuacucgggaggcugggauggcaggauccugaguccacgaguucuagguacagugagcuaugaucaugccagccugggcaaaagagggagacucugucucuaaaaaaacucuaaaaaaaagaaaaagccaaucaguacugaaaauaaaaagaugaaaacacuuacucagaaacaugaagaauauucucuuucccuucuucaacggaaaugcugacaucgucuuucacguguucuacugccagcaaagcuccuauaaauaauaugaaaagauuuuuuaucuuuaaaagcaaugcaguauuuauaacuugaaucauaaagcaaucaggaugagucaacaaaccaauauuaaguccuacaaggagugaacuuuuuucucaguagucuguagacagaaaauguagucuuuugucucagagcagcaacaaaucagaauccagaauccauucacuagcauauccaacugguuuugaauuuguucagcuuucaguuagagacacugaaauuaaucugcuucucccuucggagacaaaaagaaauuaguauagugccagccaggcaugguggcucaugccuauaaucccagcacuuugggaggccaaggcaggcggaucaccugaggacaggaguucaagaccagccugaccgacauggagaaaccccgucucuacuaaaaauacaaaauuagccggucaugguggcgcaugccuguaaccccagcuacucgggaggcugaggcaggagaaucgcuugaaccugggagguggagguuguggugagccgagauugagccauugcacuccagccuaggugacaagagcaaaacugcgucuuaaaaaaaaaaaaaauaguauagugccuuauauaaaagcuuuuguuaauauguugaccuuggauuuuuaaaaaacuaaaaaaaaaaaaagaaaaaagcuaucguuaauaguauuugagugacuauuauaucuuagucacuaugccaaaugcuuuacaguuagaauuuuucaucuuugggguaaccuguagaguuagauucaaaggacaugauaucucaagccuauaaucccagcacuuugggaggcugaggugggaggacugcuugaacccacaaguucaagaccagccugggcaacauagugagaccccgucucuacaaaaaaauacaaaaauuagcuaggcauagugguacacaccuguggucccagcuacccagggggcugagguggcaggacugcuugagccugggaagucauggccgcagugagcccugauugcaccacugcguuccugccugaaugacacagcgaaacugucucaaaaaaaaaaaaaugagagauacuuucauccccauuuuacagaauaggaaaguaacgcuuaaaggaguuaaauaaccagccuaauguccuugacaaaauauauagcagucaggaucugaaugcaagccucauguaguccacagcucaaacucuaaaacaguguaaaauggccucuugacacuuaauugauucauuaauccucugucccuuaauuugauuaagauagacaggccaggcgcagugguucacgccuauaaucccagcacuuugggaggcugagguggguggaucaccugaggucgggaguucgagaccagccugaccaacauggagaaaccccaucuccacuaaaaauacaaaauuagccaggugugguggcacaugccuguaaucccagcuacucaggaggcugaggcaggagaaucacuugaaccugggaggcggagauuguggcaagccaagauugcacuauugcacuccagccugggcaacaagagugaaauucugucugaaaaaaaagauggacaacuagcacccagauacugguuuauaaacaccauguuccacuggaaacagggcuguggcaaggaaggugcaaaauaaaccugaaaaaucuuauuguguuagaaagcaaaggaguacucaaagauagagaacauauaugucgaaaggacauagagucucuacuaaaaauacuaaaaauuagcugggcguggcagcacaggccuguagucccagcuacuugggaggcugaggcaggaggaccacuugaaccuaggaggcggagguugcagugagccgagaucacgccacugcacuccagccuagguggcagagcaagacuccguccccaaaaaaaaaaaaaaaaaaaggccacaugcaauggcucauaccuguaauccuaguacuuugggagacugaggcaggcggauugccugagcucaggaguucgagaccagccuggacaacauggugaaaccccaucucugcuaaaauacaaaaaauuagccaggcgugguggcaugugccuguagucccagcuacuugggaggcugaggcaggagaauugcucgaaccugggagguggagguuugcagugagccaagaucguaccacugcaguccagccugagcaacaagaaugaaaccccaucucccaaaaaaaaaaaaagaaaaaagaaagaaaggacagaguccagguuggaggggcuuccacuggcaaaucaggguaaugacaucgaaauaaaugagaucaauuuuagcacacccauacaaugaaauuuuauccagcaaauaaaaaaaugaacuacuggccgggcgugguggcucaugccuguaaucccagcacuuugggaggcugaggggggcggaucaugaggucaagagaucgagaccauccuggacaacauggugaaacuccgucucuacuaaaaauacaaaaaauuagcugggcgugguggcaugcgccuauagucccagcuacucgggaggcugaggcaggaggaucacaugaaacugggaggcagagguuucagugagccaagaucgcaccacugcacuccagccuggugacagggugagacuccaucucaaaaaacaaacaaacaaaaaacaacaucaacaacaacaaaaguaaacuacugucauagacaaaaagauauaugaauuucagaaguauuauccuaggcacauaugagaauauaagaauauauauaauaugauucaauguauaugaaauuauagaaaaagcaaaaaagugacaaaaagaagaugagucgcuauuaggugcuaggaguagggaaaggaaugacugcaaaggggcgugagaggacuuucugaaguaauggaaauacucuacaugaugacugugguguagauuacacacuugucacauuugucacauuguacacauuugucaaucacuuaaaauuggugaacaauuguauacaaguuauaauucaauaaaacuaauuuuuaaaaacaaaauaauuuuaaauagaaaaugaaaauaauacaaauuguaacuucuugaguauuuuugcuaugauuuuuuuaaaugggaaaaagagaaagcucuccucacagaaaaaugccaacuaauacauacagaaggaaugguagaaugggaaagucacuaucucgcaaacaucauaaaaucauaaaaaucaaguuaggcaggaaguaucaauggauacugaaacuagugggugaagaucugaugcaaaguggaacauuuacaugauuccaaugcaucugcccauuaaaauuaagguuagaauaaucaguaaugggaaaauuaaauucaugcaccaacugaugggcugcaaugaagaacaaggaauaacuacgcuauuccugccaaaaacaaagagccugaaucuagacaccaggaaauaucagacaacuuaaacagaggauauucuucaaguuaaguggccuguuaucuucagaaaggucaaagcuaugaaagccaagggaagacuaggaaaccauuccagacugaaagaaacuggagagaggugacaaucagaugcaaacaaagcauaauacgggauuuugaucucaacacuauggagggucugguuguaacaaauaaugauagaacaaggauggggucugugcauuagauggaagcauuguauccaaguguauuuccugauuugggugcuugugugagaucaccuggaguuuccaaguuuguuggggauguacacuggaguuaugcugagauacugaagccucauaucuacaguaugcucuugggugguaugggggaaaaaggucuuuauuuuaaguuugaaauuaacauuaaauauauaacaugaugaaugcauacaaaauaggaaaauucuagcaaugcaacuauuauuuuaaaauguuucaucuaauuauauuacuuaaagauaaaauguaauugaauuaaacugggaauaauuaaaucaaaaauuaaaaagggagaggagcaauuagaaaaaugauauauuugauaacuggcauacaguucaaaaugacaagaguuucacagaauacuggcagaauucugaguucuguaauacacuacagaaacaggccaccuucagggugauuuucuaaguaacaaaaaauguaucaggaggcugggcaugguggcucacaccugugguccuggcacuuugggaggccaaggcgggcggacugcuugaggucaggaguuugagaccagccuggccaacauggcaaaaugcugugucuacuaaaaaauacaaaaauuaggcgggcaugguggugcgcaccucuaagcgcaacuacucguguggcugagaacaagaauugcuugauccugggaggcagagguugcaaugagcucggucuccaaaaaaaaaaaaaaaaaaaaaaaaaaaaaaaacaguaucaggagcuuuaacuauagucucacuuaacucuggcaaccaauccuaucuggaagacauuauucucccuuucuuaaaacaaggaaacuaugggagaagcuaaauaaggaacuugucaagguuucacaacuaguaaguggcagccaggauuggacucaggucugcagaaaccaaaugucuuugcucucaaucaugaaggcacucuaaugccuuuccagcucaggaaucaaacccauuccuuuuagaguucauugauuuguugugcgguuaguccauuacugcaaccaauaugccaaaacauuaccaucuuuuaaauguuuaaaauggcuauuaaguuguguuuuuguucaacaaccuuaaaacaucaccaaaguugagaauauaaugaauaauuucaucagccccacguggucaacuguauauaaagguaugggcuucuucaacauuagaaaguacuguguguguauuaucauacauaugcauuaacaaauauuaggucaggcuggguacuguggcucacgccuguaauccuaguacuuugggaggccaagucaggauggcuugagcccaggaguuugagaccugccugggcaacacagugaaacgccaucuuuccaaaaaagacacaaacacaaaauuagccaggcaugguggcacgcgccuguagucccagcuacuaaggaggcugaggugggaggaucaucugagcccggaaguucgaugcugcagugagccuugaaagcgccacugcacuccagccuggacgauagagcaagacccugacucucaaaagaaaaaaaaaaaucggcaaacuacuuaaauucuucuguguaauuucccaaaguaaugaaaaagcagaaauucuaagcaaucuaccaacaauaaucuuggucaugucgaaaaaauaauuccaaacagaacuuaagaugugucaguaaggugacagauccaauguuuacucugaaauuuacuacacauccacagggugcaguaaaagcaaccgcaucagucuacaguguaccuggguguuuuccccaauuacccuaccacauuuaauuaaaaauaaaugcagccucaguugaaauccuaaaugcuaauaugcucgucuggguuauuucuucugaacucgauaaaacguaaggaaaauuugacucaagugaacugaggauuucuccugagaggagggacaggacaggaaaggagguaagaaaaggaguugggggaaaaaugcuaaaagagaagcgacgacuauuggauuuuaaguuuuaaaaucuuauuuccacgagcaacucucgcucuccgggggaaaaagggagaggugaguugacugggaguucaucccucugagaaaaagauccgaagcggagucucguguugucuagcccgggcucacacugcgccucccuccaugcccgggaaaaccaucuucaggagcagaugcaccugccggggacacggggcgaggggugcggagccuccuccacguacaauucuggggcgaggggcagguccaacaucccagauggugaccaccacugcgcaaagccggggcgcagcgaccuuccacgcccugcacccucccuggcugaugcaacccacacaggucauuggucucggccccuuaccuagcggagggucuccugaauucacggucagagagagcgucgccaucuccaccaguccgcugguccaccugucaguacgccuggcucgugccagaacuacggaggaccccgcgaaaggaagaagaugcaacgugugcgcguacccgacgccgccgcagccuucgcuccgccccugcgccgcagcuacugccgacaccgcgcacgccgcggugcgacaucgucgcgcgccgucuucguccccgcccgcagguuccagagccugcuaccccuccucuuggccgccaggguuagaacggccugcguggccuuucgugcu

SEQ ID NO: 192919 - RNA, 98673 nt, Homo sapiens
ugaauuuuuaacagaaaauuuuauuucaauaaauauuuugcccuccaagugacaacuacaauuucagggagguaaaaguauaaccuagaaguaauuuagaauuauuccacuuuucaauuuugccugagugaagaauacaguuugggccugaagucugcuaagagacugcaccgcagugacacgugcagaaagucaaaaggacacauggaaagcaguccaucuuuggugcacgcacacagccaugugcacgcacacguguggguagaacguaucugcacauacaugcguaaaauaaugggacucacgcaaguuucauuucucuuucaacccuucugggcucccagaauucuagcauuaccaaggauuuacacauaaacuucaucauacauugaaucauuugguuuacacuuucuuuacaaaguuauauccuaaauggguagagcagcuugucuuaaauaacaagguuagaauucugagacacaacgaaaguugugcaagcuuuccgcugaaagaaauuugcaacgagacacaaauaccacugcaggggcuuugaauauaggagacauugauaaacagaguuauaagucaguguuaucaacugcaaaaucaugacuuuaccaccacccaagccagaaaggcccaaaagcaccaccacgaaaauuaauccugugucugaaacuuuucaagacuaauuaaaaggguugcuguguccaagcaugaagaacgcagggacgcuucugucaaucauuaggcgaacacuggccuggggacuugggacaucaggaauguccaugccacauuagugcuuacucgcaacgaacagugaaaacuacacgcuuaaggacaaguuucaggauguuccacacacugacucauuccauggagaaaauccagaauugauucagacgucccaugggaaugcaauuuuccagcucuaugccagauauuuucuagcucuucauuaaaaagaauccaauuccacugacuucgauagggccaugguaaagaacaaugugaaacuccuauaaagcaaggaguuggugucgccuggucagcgaaaugagccacagcaaccucacacauacgauucaauguaaagcaaauuaguucaucacuuuauuacaucuuagugcuuucuuaaaauaaauacaguaauaucauaucaaacauacagugagaaauaaagcccacgugugaaaguaugguaacagaaagcucacucaggacuguguaacucagcacuugagaaaucauacagccuuuaguucccuauuuacaggacagagagcggcugugucgaacacgauauauacaaaaucgcaagagacuguacuucucuucaaaggacugaggaaaggggaauaagaccuauaauuccuucuagccuucuguaccauguucccuccuuauguacacgacucacucauguuuuuugucuaucuaaaauuauguaacaguuaaauuugucucuuuuucucccaauuauugaucuuuugauuuuuucugcaguuugagauagauucaaguaacacucccaagaaaauaugugcaaaacuaauguuaguggcuccagaaucuuccggcagcuggucaguugcagcagugucuggcagccauggcuggcacgcaccugcuccugggaauguccgcgcuccacagaagcaucaacaccauugggaccaaggcagaaagaacccaaagccauccacuuacuuggaguucugaaauaacugcaaauaaccacuuaauuguuuuuaaauaggcaacaaaacaaaaguauccaucuacaggggaaacggcacgcuccucugagagcaugcagcgcuuccagaugcagaauccagacaggacaagccgugaccuaacaaaaccacugaagggacugucagcuuaagugcaucaccuuuugggacaaacaugcucagaaugaaaaauauucuacuuuaccaaaaucugucuuuauuaaagugaacaaaccauuagagcacuacccaaaacuuaaugaaugauggcugcaguuggcucggcuugccuacuuuaaaugaggcaaacaucagcuccuagugccauuccccacccucaugaccgcgugccagaagucaucaucuucacauuuguagacguuguucuagcggaagacaggcuuugcagauuucggugcuuuuagugaacugguguuuuccguaaacuuuuucugagcagcaagggauaagaauuuuuuuucagaaaucuuagaauuggauauaaauguuggcaguagacacaaccaauaaauaucauacaauuucucaaaugaaaaagauuucccauuaugaauuccuuugcuauagacauucaaacaccccaagccaagauugagccucagucccauagucacgagauuacagcuggccaauaugagggugucaggcaaugugcaagggggcgaggugagaagcaagaaagcaaaguggaucacgucuaaucuaugcugaaggagaacuucaaguaagggagcuccguggcccgggaccuggcugugaacacccuccgcugggagccucaguggucagcaguggccacagcagugcgagccacugcaaaagcggcaucuacucccccauccucacccugccuggcauccucugcgugagaugagcgcugagagagggguuuucuucugcugucuagaaaccucuuugcaaaaggucugugacuuugcacacuucguacccaaauagaugaaaacaauaaauaaggaccccguggcacccucuggaugccagccacaagggcaucauuuacgagucugggucacccuuuggacgccagcugcaccggggucauuuacgagucugggccuucuuuggcacugcaggccgcuugggcugccacaggugguuguggauugugagugcguccacacugacagacaugguuuuggcugggaucaaguuaaacuguuuucggucugagcuguauuuauacaguuugucgaucauuuucuuggugauguucuuuggccccgugccagugaguuuguagauuuccucaguaucaggauaguagcaguaaagcgcccugaacuggcagccagcaucacgaaacaguaugauguagugauuggcaucacacuucuccagcuccugugcagagagagaaaaggggaagagacaaacacuucagggccacuccaauugccacgaguugggcucccacagcggcucaaccagcaccgcuccgugggaagcucucccacccgucagcuacggccugccuguuguaaacaauuacagcagaccccuguacgggagcauuauaugccauugagacuuuacuuaagaagucuaagcaagcaagggggaaaagaaugcuuuuacgauuaaauggaaaagcauaugaaaagaugcucaucaucagccaccagagaaaugccagucagaaagagacgucgcgucaugcccacaaggacggcuggaacccagaagcagggcgguaacgagugcuggcgagccauggggcucuuucacugccagaaggauacagagcacagcagcugcugugaaaaacaacuuggcucuucuccaaaccaucaggcaguuaccgugggacccagcaauuccucucucacauauguacucaagggaaaugaaaacacgcauccauacaaaacacugcauauaaauaacagcacuaucccuucacaggcaaaaaguagaaacgaaaauaucacauguacccccaaaagcaugcacaucuguucccuaucaauaaaaaauguuugaagaagaaucaacccaagugugcaucagcagaugacgagaugaacagcauggggucggagcaugcaauggagcauuacccagcuacaaaaaggaauggagguccgguacacacuacacugagaaaccucagagcaucacgcuaagugaaagaagccugacccaaaaggccauauaauuaugaugccaguuauguaaaugcccagaacaggcaaauccauggagacagacuggcgaccgccaagagcuugggcgcgggaagacuuaggggggugacuguucacgggcguggaguuucuuuuuaugaggaugaaaaugcucugaaauuaggcgguggugaugguugugcuacucuauuaauguacuaaaaaccacugaaugguauaacuuaaaagggugaauuuuacgguaugugaaugauaucucauaaagcuguuugggccgggcgcuguggcucacgccuguaaucccaacacuuugggaagcugaggugggcgaaucacuugaggucaggaguucaagaccagccuggccaauauggugaaaccccaucucuacuaaggauacaaaaauuagccaggcgugguggcacaugccuguaguccgagcuacucagagaaucgcuugagucuggagggguggagguugcagugagcugagauugcaccacuguacuccagucugggcgacagagugagacuccaucucaaaaaaaaaaaaaagaagaaucugaaguaugacaaacugcugaugccugucgccgcguuuguugauuguauuuuaaaguuuaaaacguaucuucaaguguuuugguaacuuuuaaaaacaaacccuccacacgccugggaaugggagugcaccugggucugcccucacaguucuccacaugcggcccaggcauccugaggccuucccaggaaucucagggucaagcccucgaccucgaaaggcuaaggccucaucgccucucccaagugugcggcagaaccuucccaaggcccugggcugugugguuguaauggacggagggcccgagcggcugagaugccagcccucuuaugucaaugccacucuucuauuuauuuggcuuuagaaaaguuacuuuucauaaauaugcaauguaucagcauauaaugggguuuauuauuuuaaauaauacguauuuuuuaaaagaauccaaaacugucuauauaauacugauuucaacccuacucacuguguuuaaauaugaacagaauuagaugccaaaaagaaagaaacauuuaauuuguagcgacagcgggacuguggggagugggguucaucuuauuuacuuauugcugccugcacgauaaggaagcguguggugcccacagcuuauguggcacagcugagagggcugcuguccuagaaaggccugccugcugggcggcccuuggugggcaccugggaacuugcuaucugcagagcucgcucccagucacucacuggcaagacaggagggccuccugagccugaacugcuggucugcacgcugacgcugguuuccucccaggcgucaggcacacugcugcacacugggcagggagugugccuugugaccagcccccaaggagagcucagggcauccagucucaaaagggcuuuccauggcccacaggcugcuguggauccacugcuggaagaacgagagcagagggagcugcacaaggccuagccccgccucugucuucucccucuucacccaguggcuguggcucccuccacagugcuggaauaaaucuaagcccugggucgacuccacacugagggccacgaguccuuccagugcaucuccgcaugcagggugauccugggggccacugauacagggggccaaccaccucuccguguggaaaucuaagcaggaagggcaugaccauggccucuucuguccccagugccacgagaccugccuaggucggggccauucuuagucuagaugaucuucacuaucaagaaaagaacacauccguuuuaaagugggucagaaauuccguaugucacuuuaauuuuuacaacuaaaccaacuaaggaccagggguuagucuuaauuauuaaaaagcagaauuucugguggaugacagauuguugcauaauuuucauucacucauucacaagccguuguaucccaaggccagcaacuuaaggccacacaccagccucaaucuggggcaggguccaguggcucugccuccucuccccuggaaucccaguccugccccucaggggccagccuagaccccgugcaggacccucagauuccugcuuccaagccccucccugggcaugcacacugggugcuccggaguccacacgcucagcgggugcgcgccucuucccucccuccccacuccaucuuccccaacccaccacuccguccuccguccucgguccuccccaacccaccgcuccagcccuggccccuguuccucauucaccuccaggcugccucccuggcuucccugcugacugcucugaucuacugggaagggcagguggguuccuggcucuccucugcccacaccugcauccacuaucucacugaguagaacuaugucuuuccucagcccagaggcaccacaugaggauguagccucugaacccugccccguccuccuggguguuccuccagcacaggcucacugcagccccuggaccuuggcacuccucacucccaccugccuggaacggccucuuccuugaaaucugcauucucccuaguaacucucaugcaucaaagauuagggguguuuucuuuuaaaaagaacccuuaauuuauaaacacuuuuuauuccacauaaaaacugagguugaaacaugauacuugccuccaauauggaauucuugugggguucguucacuuuuccagccaggcagcaaugggauauggcauugugaauaaucggcuuguuugauuuacuacugggcuccuuaaagagcuugggaccuaagaaacgaggccaggguugguaaaauuauuauuuuaaggcacgaacacacacaaaaaagaaaaccagcaaugucuuagaagcaagcaauggguaggcugaauuacagauauuuaugauuauuuaaaaaugggaaguaaaaaccacuuaaauuuauucaaaagaauuuuaaguuauaaauuuuuagacaacuaaagacaaaguaaucaauaauuuauccccuuucuaaauucagugucuuaacuauaaaaaaaagacaaaaccagguaaauaacuuguaaaaagucuaaaguucaaaggccccgggacauacaccucagccacagcagcaccuccaguucacugugcccugagcccacgccugcuccaagggcagcuggugagagccaagcacuuccaccacucccgggcucugcugcccccagguccgcugcccccugcacagcagacagcagggcagaugaccaggagggcaaggcaggccuaagagcuucuacuaaaccacaugcccauuucagcaccaaagagcucaaauuagcucucuuucacuacaucaaacaucuuuguuagaaaaauacuuuuuagaccaaaauagagaacagauauugaaagagccacgcaaaggcguauggccaugcccacgaugaccucuaaggagggcgaacgccgucaccuguguacucggccacugaggccagggaagaugccgccgacgcggucucccagucucggucugugcuccugcuuggguuacggcucaguaugggcagggcuuccaucgauuccacucugcaggcagaaacagacaagagacaggcaggugaagcgcuggcuuccucucaccacugcuggcaaggggcuggcccgcaaccaggacaggaagcacaucagcaggggaggaggcuuucggugacggugggggcucgaguugccacaacucccacacaguacagacacuccgagcaaaauacaaaagcaaacacuucaggcacuagggagugaugaagacagacagaggggagucagcccuucaccgaagggguucaccuccacgaagcccuugcuccaggcacugcccccgugagcagggcacaggcacagcacagggcacagugcugcuggcucaggaagccagaggaugaaguuugggccaccugugcugcugcccagccagggaugagaccuagggaaggaggggccacagcaggccgagucugaaaacuugggucccagugacgcugaucccuggaaggccugagcuccacccugcagggaagucuccacugagcacaacagaugccgaaaggcuggacacagcugcucagagaugucggcugcugcucucacaagggaggcagacagagcuggagucugaauccagccaggguaacugaccaccagaacaaaaacccaaacagaaucugcagucccucggagggaucugccacaaagcccagagacaacaaggagccaugagacgggugaagagacaagaaaacacggcccacaggugcacacagagcaggagccacacgcugugcauauaaaaauaaagggacacaugggcaagggaagcccuugcucccacgagagcugacaacacgcguggaggaagcggugagcaggagcuccaugguggucacuaaagccccugcgggacaguuccgugagguccagaccaguccccagccucucuccugaaguuacuuucucaucacaggagcggucccggggcccaccugagaggcugcguugagaaagacgcacacucacuucugggcugcucaaucagcagcgcgaggccucagucucaucacaggaagccgauacugagaggcagccagaaggauaacugaccugugguuaccaaaagucaagguccagaaaaacacagaaaggcuaaggaacugcucuggaucgaaggagacuacagggacauggcauuucaaggccauucaucgccccaaaccagauccuggacucggaaacaacacaguugucagggacacucuugggauaacugaggacagcugaauggggaccgcaaaucggaugaaagugcugccuugguaacugguaacacgagaaaacauucucguucuaggaaauacacacuuaaguauuuaagcauaaaaggccagacaucuccaacggagugguuuuuuucuguuuauuuuugcuuuuggggguuuucuggcagcgucucacucuguugcccaggcuggagugcaguagccugagcacagcucacugcagccucaacuuccugggcucaagcgauacuaccaccucagccucccaaguagcugggacuauaggugcaugcccccacacccagcuaacuuuuuuuuguauuuuuuguagagaugggggggucucacucuguugcccaggcuggucuggaacuccaaggcccaagugauccuccugccucagccucccaaaguccuggaaucaugggugugagccaccacgcuuggacuccaacggacucaaaacgaugaagaagcaggugugcacguguggggugggggacaggggagggugauaaggugaaggcugccacguuuaaccagcuggggagcccgugugaagggcacugguauuccugaugacaugauugcaacuauucuguaaaugugaaauuauaucaaaauuaaaguuacaaaagccucucucaccguguuuaaucaggaagucccacccugccccuccgaacguccuccagccccgugccggcggccgucucaggccccuuaccgcugagagggugugcccccggaaugaacgcucucggguucugucgucgccgcagaggccaaggacaggcuggagccugacugaguccggcucaaguuaucagcugccagagacagaaacagacgacgguucaugaacggauuccgacagacaaguaccuguccccuguaccuguuccccucaccucgcccugcagagcucggccacacaggccgcguccccaccccaucccggggagccgggcugcgccuggaugugccgcacaucucagagcaucuggucucaacauugucauccaugaaacggggauaaucaucuccacccuucccgccucacaccacucuugaugacaaaauugaaaugagcugaagaacgugaggccgccgcccgcggaaggaagcgcugcccgcgugagggccggggcugcuuacggguggaggagcacuuggugccggagucgcugcacgacucuucccggugcaccgacuucggccgcggcuucuucggcuuugacuugggcuugccgagccccugcuccucuaggaucugcugcugcuuccuccgcagguacuccugcuugaugagcucgcgccgcgccuucuccuccuccuuccgcacccggucuuccucagcuuugcgccugagagaaacacacgcccagacacugcucggucacggggcuucuuccacgacgccugcgccgcggcgcucuguccaggcgcguuucucggguucuccccggccgcugggaccaagaguggccagccuccacaagcgggacacagaggcugcaaaggcaguccugcagaugacccaccgaggccacacagccucccuggccaccggcaacgcacguccucacugaagaucagcaggggccgugaaaguucggggaggugguccaugggaggaguaagaccgucacaggcacucauugccaugguccaugcucagugccagcaacgggaccggggccgccagggacccaccaggcuccugcucagucugcuuucccccccggcgggacgcuuaccgggcuucgucacgcuugagcuccaccuccgcuuccagcugcugcuugcgcacgcgggccuccucggccuugcgcugcugcuucaggaggaaggccgcccgcuucuuggcgagcucaucuuccgcuuucuguucauccugcaagacagaggccacacagagcaugacaggaacccccucagacgccggacacggccgcacucgacccagcagccgacuuccacuacgcuuuuaaaaguuuaacgcauaaagacuucuaugcuuuucucuaaccguuacagacucugaaauacgaaugaagacaaaccagggcauuucaaaggcgcucggcaucacccaauuucccaaacaucucacgagauccaguuugccuuaaaaaguacacguauauuuccaaaauaagagcgaggcugggcagaauggcucauuccuguaaucccagcacuuugggaggcugaggugggugaaucacuugaggucaggaguucaagaccagccugcccaacauggcgaaacccugucucuauuaaaaauacaaaaauuggcuagaugugguggcucacgccuguaauccuagcacuuugggaggccaaggagaguggaucaccugaggucaggaguucaagaccagccuggccgacauggcgaaacccugucuccacuuaaaaaaaaaaaaaaaaaaaaaaaaauuagccgggcaugguggcacacgccuguaaucccagcuacucaggagccugaggcagaagaaucgcuugaacucgggaggcagagguugcagugagccaagaucaugcccuuuuacuccagccugggcgacagagccagacucuguccaaaaaaaaaaaagcgaaaaagugaauacugaaguuggucacgaauuuguuuacauuucaaaagugcaaccaccaaauaaagcuugccucuuuugcuaagauccaccugaugauuugguauccucucaaauucauaacugccuggaggcaaagcagaaacaguugcgugucgcuugccgagagaaaacguucugagaaauagguccucaggugacucugcugcugugugagcaugacggagugugcgcacaccuggauggcagcgccccccacaggccucggcuacaucagccacugcuccuagacuacagaccugcacagcacauuacuguacccaauacuguaaguaacuguguaucaaaaucuaucuaaacauugaaaaacuaccacgaaaacauggucuuaucaucuuaggagacgacgauauauggucuuaucaucuuaggagacaacgaacgucacagcaaacaucaugugacgcacugacuauuaaaacaguucaguuuacgcuucccuucauaucuaaggaaaaaauuacaagaaaaacauacaaaaaauguuuuuugaaguugcuauaucagagguuggcaaacuucagcccacaggccaggccuggccaccuccagagcauucuaacgacgaacgcuuuuuacgcuuuggggcaggacagggagaugacaggguuuugacuggaaaaccagcaaaaaaaaaaaaacuauguugaaaaucacaugaaauuccaguuucagggcucauaacaaagucgucucagccacaccacgcucacuugcaugcguauugcccgggacugcuucuggccaaguggaguccucgggacagagacucuguggcccacaaagcuaaacacacacauccccuggccucuuacaggagcggcuggccagccuggugcagaucuguguucucuaacucacuaucacgugggguggcaacacaucacgagugccugaaacagaugcuaccaaucccuuaccuugaagaagaagccgacccccggcuucuggucgccuucgcugacaagguccgccgagccaucgaggcuuaccagcuccccauccucgucgggggccuucaggucggagagguccacuucaaugaggcuggcccugcuccucagaggcuccuccacggggacgcucucuuuucccgagacaucugaggagcuggaccccaccuccuucacacucgcauccagaacuucuuugaggcucaucugcuccgaaagaauguuggcaucuuuggaagaggacagaguaaguguccgcugauugcuuucaucauggagccuguaacugucgaagagacacuucccaugugggucaccacugggcuccagggcacuguccaggccaggguccgugggcguccgaggguggcugcuggcagggaagggucucaagugcgggagcgucucuacacugggcguugggguuuuacuucgggaggagcccuguggccugucuuuugggaccuucagcuccgccggccuuccggaacgggaauuccggccuugacccagccggggggcuuugcgguggccagccacgcccgugggagagaguggcuccacgaaguggacuggugccuucacuuugugguccugcgaguuauucuuagagccuggcacugggacugugggggacuucaucagaagcugcucuugcugcugagagauuuucaggauggccugcugcagcguacugaugguuucguuaagcuucucgauggaaaggucacauucauucacgucgacaaccuccccaacaguguccuccaggagggcagcggagaucaccuuauuucucuccagcucgugcagagccacagggucuuuugcuuuauguugcugagcaaaggccaggcucucuuuguccacauccuguggcucgugaaggagcuccucucucugcuccuccuucacgagaaagucuucgguuuuggaaacagcguccccacaguccuccccguugugcugagaguacuccuuugcaaagugcuccggccugagggguggggcagccucggccuugcccuucuucaccacaugcaggaaugcagccuugccgagcuucaggcgcugccuugccgacagcgccuccaucuucuucuucugggccucgauggcccugcgcuucuccuccagcugcaugugcagcuguaccagcucagaugccaggaggcuggcgggauccuugccaugcuggcucggacucugcucccucuucugccuccacgucgucagaggggcugggcagcucucagacgcaucuggcguggucuucugggagcugcuggugcuggacuuggucucacagcuguugagucucuggagcuuccucuccgcaaagcuggucaucuucacgcucccacucgccauggagacacugcucaucugagaggcugugcucaggcaggggcucgagcggccgcuggcgucaucuuugucuucauguuccuucaccuucauguccuccugcaguuuggccgacucuuccuccccaauguaucugcugaaaaccacaggaugggccucacccaugaaaucgugcucggcuuccucuauguccaccacauccgagucagaauccugccugaggagaguccacggcucugaaucgugggaguuggggcuuuuugaacaacuaacauauaaccuucccucggugucuucaucggcccugccuacaugaaggaagaagccauccguggauggucccugggggaacggaucgaauccgccaagggccagaggcccaccacagaccucuccugcgguuuccacugacagugguccugucucgguggggucgaugcccauggggaauucugagcauggaaucgggguaaaaguccuauucaagucgcgacugccagucauuuuccuucguaccaaaggcugggggcccucgcugggccuccuagacacgaugcuccucggucucccuuccccccguucauccuccuuggugaucaccugcuucucuuucgcuggcuuaagaacugcuggcaucaaaggcuccaagaaaaaacugucaggcuuacuuuccgagguguccagcuguccuuggggagaccgggcauuugcuguaaggccuaaggcccggggugaggcccuggggaacuccgggucagccugcuggggaaccacgucugcucuaacaauagccacaagcuccucuuccucauccucaauacugacauugcucaggaggcucuucccguggcucuucguggccgugggguguggcugguucuguggggucagauuaacaauguuggaugccaaacugucuuugcugauggagcgggccaagcugaugcugucgccagagcugggauccacuucacaacucgcagcgugauguagagcaaaagguguuggcugggacgcaggccugaaacacagggaaggcccacugggugcgcugcgguauacaccaaagacccccaacauggaccagggggugagaaugccggccacacaaagagaauacgccucucauaugcaggagauuuaaacucacucuuccacagagcagaagaaaaucagagauaauuucagcuuugugauucucaaacacucuagucccaggaccucuugauacccuucaaaauuacugaggaccucaaagagcuuuuguuucuauuuaucaguauuaaucucuauuuaucauccuacaaauuaaagcucagacauuuucuaaacacugauuaaaauuacaguaauuagcccacuccaugacaaaugacuauauucgccagaacggaagaaguuccuaguguuaagggcaggcacuauuugacaccuguauaguucugggaucuggcuggacccucauaccugacuccaccugcugccacaccacaugguaugcagccucugaaaaaucccacggcacacucgcaagagugaggcugcagagaggcaguaacuuccuaguguuguuauaaaaauaauucugauuucaggcacucccuauaaaagggucucggugauccucaggggguuggggugacaucuuaagaacugcuguuuaguauaaaaaacauuccaaacagaaacacugcugaaacacagacucaccugguuuuuuuuucuggccaggcuauugcugcuccucgaggcugaccaucaacucgggucaaagaauucgaucgaugucgcugaucugcaguacagaggaauuagauaguguuaaguaaccaauuuucuaucacuugaaauucuuucaauaugaccauuuguccagaaaaaugccucucaagucaguacaccagaagggccgcauggaaagcagagaggcaaaaccauacaguugucccacauuuugaugguaacacacaguucagaacugugagagagcuucagcaugugugagcccugcuuaugucgcaguuacucugugucuacuacacagaagguaauugcucucaacgauauuuucacugcaagacuauacauuuugacaacacaaguuaaaauuuauuuggcuacagucuuaacuaaaaucacuacaucagccgggcacaguggcucacaccuguaauuccagcacucugggaggccgaggugggcagaucaugaggcuaggagaucgagaccauccuggccgacaugaugaaacccugucucuacuaaaaauacaaaaauuaacugagcaugguggcaugcgccuauaaucccagcuaugugggaggcugaggcaggagaauugcuugaaccagggagucagaggcugcagugagccgagaucgcgccacagcacuucagccuggugacagagcaagacuccaucucaaaaaacaaacaaacaaacaaaaaaaucacuacaucagauaaaaugauuuaauuuugagaaauaugauuuuacuaaucuauaguaaggagaaauuaaggaaaaaaggaggaaacaacauucuuaccagggauguccucucccuguauggauuucugcuguuucugucucaguggcaauaaaggaugggaugggcugaaggcagcaguuccuuucccgcuaaauggaaaaagaauuacagggaaaaucauuccuuuaucaaacuucaaggucaacagcaaaugcacaaguguacaggaccauccugaauucacaccaaguuuugagaaacucggacuguuugggaaaaaaaugacaauaaaaaugagccaagaguaucaggaacuuccaaccugggaugaacauccacacacugcaaacgggcacacugacuccccgaugugucuacaacacaaccagcuucccacgggaaaagcaaaacccaagcgugcaauuagagugauuuucugagauaagcaaaaguaaaaagaaaaagugauccucugacaagcaacaguuuucaaaaaugcacauuacugcuucaauuaaaaaaaagagagagaacuucagagauaaaagagaccacaaggaugaugcccaauguacuaagccaccacugugaagauauugaugaguaauuaaacccaucacagacggcagcaugaacauucccacacugcuggugggaggguaaaaauguacauuuuuagaggacaauauggcaauauccauaaaaaccucuaaaaucacucacaccuuuaccacuccuuggauuauagcuuaagagaaagaacgaugagaggugcacacagaagcaugggugugaaggccucacucccgggaagaacggcacaugcaggaaaggcggaagucacacgugugcggaucgcacaguucugacagagcaacacccaugagaccggcacccagcagccucugccacuccacaggcaccagcuccccgagaaacaagcgcgcucacacugcagggcagcuaucuugcuuguuucacuuuggggagaauuugguaaagggauaauucgccaggugcagacaggcuggggagaucacaggggacagcucggcacccuaggccagagucagcacaccuaggccugaagaggcaaagacgggcagaggacaccagagucaggacacagacaccaaagagacacagugagagcaggugugcaggagcacacaagcgaaaggguugcggagagaggggcucaaggcagggagcccggggggaagcugggcagagcaggaauggcacagggaccugugucagggccacaaugcaaacccugcagccuggacaccguggggacaguggacccaucacggcacgcccaugacgugacagacuggguagcuguugaaacuguggcagacgaggaugcaccgagugggaaaauucucaccacaggcugcugggugcagacaacagggugcagacagcaggucacagagcagcguguacacgggcaccagcacacacacacacacacacacggcucaacaacagacacgcaaagaccgaagggaggacgccaaguguccacgcuggccccaugugagggacggcucagccucgagccauucuccucacucagugaccccgccugugcccgcgggcauggaguuaccgccccaccucugcucugagcucuggggacagacaccccagucucaaagccgcccaacacagaacacauccaaaccccucccucagcuaugccccaccccuggguguguacccccccaccacugccuguaucacaagggccucucaacuccuuccuccugacuccggcagcccccgcaucccaucccucaacauggucaccgguuuuagcuccucucaaacaaccugaaacaacugaguucguucuaugccaugcugucucacugaaccauucacuuaugugaauuauuuaaaaccacuuuuaaauagcgucuucaucuuaaaucccaacuuaaaucgccacauguuaaaaauguuucuccacuuucggugugcuaacuggcuccaggcuggcaucagcuguggguccuccuaccacacacagcacaaagcucacucuuacuccaagggaagcuuccuucacccccucccccaauucuggcacagucaauucuaccccagauaugguuauccaaauuaggucuucaugaugaaaauucauuuuagaaaaaacguuuuuuaaacaacucuuuuucuagaguaguuuagccuuuaagcagcucuauacacuuuuucacucgaaucaaauuaauucuuccccaaagagcaaacaaauucucuucuuugaagacuucacaauacuugaaaugcaagaggauuucacucuuuaugucuaucagaccauaaagagcacaccuaaacugucaauucaacuuucuaaucuuuagaucguuucuuaaacaguguaacacaugguggaaaagagaacagaaaaacaccuguuccauaaacaaugucagaauuagguacacaucccugaaggaacuuccugcuaguaucauucccggccucuggaaaggggaccgaauggccagaagggcagggacagaaggaaaaucuuucauaagcgaauacaaauugcuuauuuuaaaaaagguaacuucaauuaauauuuuaaacuaacacaaaaagggacacaagauggugaacugauucugaaagcagaaagacagacuuacagguauucagguucuuccgggugcagguagugccugugacagccuuccgccggcagcugcacggggggcugcagcucagccagggucccugcagcagggcugccuaggaaacugcguuuggucgcguuggagaucgguacaggaggccggcugcucuucugguguaacacuguuuucgcugcagaaauagcguuuuugcaucguuacuuacaacacuaacuggaagcacagaaaaccuaaccugcagcuuuuauaagcacuaacucaaccuuuuauugaaaccaaacuucugccaaaaaaaacugguuucaaguuuaacaaauguauucuguaauaacaaguacuacaaauauuauaccgaaguaaauacuaacauuaaaagacacaacacagaugagaagaagaacugagaggaaauguaagcccagcugaugggcucugucuuggucaccgucuagcacccgcacaaaagcccuccacuggugggcugcuuccaaaaccacgugccaccuucaccaagccugguccuagacaagaugcccaccacccaggcuccugggagaaggcuuggggcucagcuccagagagccaccucgcucagcccagccagugagggaccgaggcagggucagaagggcgcuucucuagacccagcaugugggcagcugcucuggugggucccuucagcuccagccccugggggucaggugaggugcugagccuggcuggggcgccauucccuuucuuggcccacgccugcucacccgccucucucccaaagggucagccccaaacagugacucuguaucuaaggcugcuucccagagaacuaaccuaugggagguggugccaggagcagcucaagaaggcaagagguggggccauaugguggggaccagugggagggcacccacuaggugauguguugugaacauggaggagggaaguaaggacgagcggguggcggcugcacugagcucugcagacggucuagggaaaagauaaagagggcuaagaggcagcaacaugugaccaaaagccaagggcaccaagcugugcucuccuacagccaggggccaggaccagaaaugaauggcugccggagaagcuaaacccccaacccaagaaggcugcaaggccaaggugaggcccuagaugggaaggaaagagacuaugacucauggcauacaaacuucuaggccuggagaaccucaaauucucagauuaccugaaauucuuugagccuacagaggagggcuucccucccuguuaaaggccaguaucccugcuggccccacgcuuagaugauacagaucucucucucaagaugacaugugcucccccaggcacauuauaaucaaauugucaaagacaaaaagaauuuugaaagcagcaagagaaaagugauucaucacauacaugggaacccccauuagacuaucaguagguuucucagcugaaaccugcaggccagagagaaaugggaugauauauucaaaacgcugaaaggacgggaaaaaaccccaaccaagaacauuuuaucuggcgaagcaauacuucagaaacacagaggaaauaaaaacauucccggacaaacaaaaguugagggaguucaucaccacugcaccugccuuccaagaauggcuaaaaggaauucuucauauugaaucaacagaacacuaaauagcaacacaaaaacauaaaaaguaugaaacguauugguaaagggaaauauacagacacaaacauaauacuguauuaccauaacagugguagauacaucgcuuuuaauuccauuauaaaaguuaaaagaggccaggcacgguggcccaugccuguaaucccaacauuuuggaaggcugaggugggaagaccacuucagcucaggaguucuagacuagccugggcaacacagcaagaccucaucucuacugaaaaaaaaaaaaaaauuaaaguagcuaggcaugguggcacaugccuguagccuguagucccagcuacuugggaggcugagguaggaggauugcuugagcccaggagucugaggcugcagugagcaaugaucaagccacugcacuucaguccagccuggacaacagagcaagaccuugucucaaagaagaaaaaaagguaaaagacaaaaauaguuaaaauaacaauaaauuggccaggcacaguggcucacaccuguaaucccaguacuuuucgaggccgaagcugguggaucacccgagguugggaguucaagaccagccuggccacauggugaaacuccaugucuaccgaaaaaacaaaaauuagccaggcgugguggcggauaccuguagucccagcuacucaggaggcugaggcaggagaaucacuugaacccgugaggcggagguugcagcgagcugagauugugccacugcacuccagccugggcgacagagcgagacucugucauaaauaaauaaauaaauaaauaaauaaauaaauaaauaacaauaaguuauguuaacaauuacauaaauaguuauguaugguggcauuaacugcacaucauguagaggagggagguaaaagcugagaggucuugcauauaagugaaggugaguugucaucaucuuaaaacagacaacuguaucuuauguaagcccuagguaaugacuacugaaguuacacaaaagaaaaaaagaagggaaagcaaaaaccauuaacacaaaaagcaacaacaaaacacaaaugaagauagcaagagacaaagacaugcaaaagaacuguuagacaaaacaguuaacaaaauggaaaaaggaaauccuuuccuaucaauaauuacuucaaacaaaaauggauucaacucacuaaucaaaagauagagaguagcuaaaugaacuaaacaccaagauucaacaguauacugccuacaggaaacccacuuuugagugaagaacacacaggcugaaagugaagggaugaaaagauauuccacgcaugcaaaugguaacccaaagaaagcaggcauggcuauacuuaccucagacaaaagagacuuuacaucgaaaacugucucuagagacaagggucaauucaacagaaagcuguaacaacuguaaacaucuauguacccacaucagaccuaaauauauaaagcaauauugacagaucucaaaggagaaacagaaauacaguaauagcagaaggcuucaauaccccacuuuaaauacuggauagaauauccagacaggauauuuaacaguaauaaaaacaaagaacagcaggcuuacacaacauuccagacuaaaugaccucacagagacauauacacacuuuucacccaacagcagcagaauacguauuuuucucaagcacaugggacccauucuccagaacagaucauauguuaagucauaaaacaagucuuaaaauauuuaagaucaaaaucaugucauguaucuuuucaaaccacaauggaaugaaccuaaaauuaauuacagcaagaaggccaggcgcaguggcucacgccuguaaucccagcacuuugggaggcugaggggggcagaucaccugaggucaggaguucaagaccagccuggccaacacacugaaacaccgucucuacuaaaaauacgaaaaauuagcugagcgugguggcgggcgccuguaaucccagcuacuugggaggcugaggcaggagaaucgcuugaaccugggaggcggaggcugcagugagccgagaucgcuccagccugugugacagagugagacuccgucucaaaaaaauaaaaaaguaacggcaagaaaacaggaugauugacaaauacguggaaacuaaacaacacauucuuaagcuaccauugaguaaaaaaggaaaucaaaagggaauuuuaaaaguaucuuaagcugaaugaagcggaauacaacauaccaaaacuugcaugaugcaguguuaacaaggaagucuggggccagaugugguggcgcagaccuguaaucccagcacuuuaggagacugaagugggaggacugcuugaggccaggaguucaagacaaaucuggccaacauagcgagaccccaucucucuuuuuuuaauuaaaaaaaaaaaaaggaauucuguagcaaucaacacuuccauuaacgaagaagcaggacuuuaaauaacaaccuaacuucacaccucaaagacuaggaaaggaagaacaaacuaagcucaaaguuagcagaagaaaggaaauuauaauaaagaucagagcagaaauagaucaaauagagaaaaacaauagaaaaaaucaacaaaacuaaguugguuuugugaagauaaaaucgacaaacuaaugaagaaaaagacucaaauaaaaucagaaauaaaagaggagauauuauaauagaugccucagaaauaaaaaugaucacaagggccuauuacaaacacuuauaugccaacaaacugaauaaugcagaagaaauggauaaaucucuagaaauauacaaucuaugaagacugaacaaagaagauaucuaaagccuaaacagacaguaauaaauaaagagauugaagcaguaaucacaaaccucccaacaaagaaaaaguccaggaccagauggcuucacuacugaauucuaccaauucuucuuaaauccuuccaaaaaacagaagaagaaacacuucuaaacucauuuuaugaagacagcaucacccugauaccaaaggcagacauagacaccagaaggaaagaaaacuacaggccaauaucucugauuaacacagauguaaaaauccucaauaaaauacuaauaaaccaaauucaacauuacaucaaaaagauuauacaccaugauuaaguggaauuccucccugaaaugccagguugguucaacaaagacaaaucaaugcagaacacauuaacagaaucacagauaaauaccacaugaucaucucaacaauaugcagaaaagcaucuaaguucaacauccauucaugauuuaaaaaaaacaacucuacacagaacagguauagaaggagcuuaccuccucacaauaaaaaccauuuaugaaaagcccacagccaguaccauaauuagugggggaaaacugaaagcuuuuccucuaagaucuggaacaagacaaggaugcccacucucaccucuuuuauucaacacaguacuggaaauucuagucagauaaauuagucaaaauaaauaaauaaauaaaacugucucacugcagauccaagguccuacacauagaaaauccuaaaggcuccauaaaauaagugcuagaacuaaucaacgaauucagucaaguugcaggauacaaaaucaacaugaaaaaacuguagcauuucuauacacuaacaauuaauuaucuaaaaaagaaaucaagaaaacaauccaauuuauaauagcaucaaaaagaacaaauacuuaggaauaaauauaaccaaugaguaaaagaucuguacacugaaaacaauagaacacugaugaaagaaauugaagacaacaaaauuaguguaaagauaucccauauucacggauugacauaauauugucaaaauguccauacuaccaaaaaugaccuacaaauucacugcaaugccuaucaaaaucccaauggcauuuuccaccaaaacagaaaaacaaaccuaaaaucuguauggaaccacaaaagacccaaaauagccacaguaaucuuuuuuuuuuuuuuuuuuuuugagacggagucucgcucugucgcccaggcuggagugcaguggcgcgaucucggcucacugcaagcuccgccucccggauucacgccauucucuugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccaguaaucuugaaaaagaacaacaaaggcaaaaacaucacacucccugauuucaaauuauacuacaaagcuauaguaaaacacuaucauacuggcauaaaaacagacacaagccaaugaaacagaauugagguauacgguuaacuaaucuuugacaaaggugccaaaaauacaccauggggaaaggauaguaccuucaauaaauguuguugggaaaacuggauaaccagauguagaagaaugaaacuggacccuuauuucacaccauauacaaaaaucaacucaaaauggacugaagacuuaaacuaagacuaauuaauuuaauuaaggccugaaacuguaaaacucuagggaaauaagcuccuugacauuagccuuggugaugauuugguuaucacaccaaaagcacaacuaacaaaaacaaaaauaaaccacaggaacuacaccaaaugaaaaagguucugcaaagcaaaggaaacaaacaaaacgagauggcagccuacagacugagaaacuauuuacaaacuauauggcugauaagagguuaacauccaaaauacauaaguaacgcaacucaaucgcaaaaauacaaauaacccaaauaaaaagcaggcuaaggucuuaaauaggcauuuuuuuccaaagaagacauacagguggccaacagguaugugaagaguugcucaacauggccagucaucagggagugcaaaucaaaaccacaauaaggcaucacacaccugucaggauggcuauuaucaaaaagacaagagaugaguauugaggagaauguggagaaaaggugaaccuuugcauacuguuggugggaacacaaauugguauagccauucugaaaaacaguauggagguuacucaaaaaacugaaaacagaauuaccauaugauccagcaaucccucuucuggguauauauccaaaggaaaugaaaucugcgucgcuaagaguuaugugcacucccauguuuacugcggcacauuucauaauugcccagauauagaaucaaucugcuugucaacagaugaauaaagaaauugugauauacagagacauacaauggaauauuacucaaccucaaaaaagaaggaagucuugucauuugugacaacacagauggaccuggaagauauuauguacagugaauaagccagacacagaaagaaaaauacugcuugaucacacuuguauguggaaucuaaaaaguagaacuuaagcagagaaguguuugccaggggcuggagggugaggggaacagggagaugauggucaaagggcaccaaguuuccauuuuaagguaaguaaggcagcaugggacuauaguuagcaauacuauguuguccguuugagaucugcugaaagauuuuaaguguucucaccacauacaaagguagcgaugugaagagauggauguuaacuagcuugacccugguaaccaguucacuauguauacguguaucaaaacaucaugcuguuuauauacacuuuuaaucuucaauaggaccugcccccaucuucccucgcggucaccaggccuauaaccagggugacauccaacaaagcccuugccugggagaaaagggccacauacccacacaccccguggagcugcgggguguagccagccaguuucagcagccaggggaggcugugaagugcuggacucugagggcccuugucaagggagcuggcugaggcaaaauguguccauuugggaggacccccaagcacaggauuuggcaggaauugggugaugaugcacguguacuaacaggaggcccuuaccaaguaagggagaaguaccauaacugccaagggacagcaaaggaggggcuaggaccccucccgcccccacacacacagcagaagcauggggagugugccggucagacggguacccacagcagcaccaggcagccccguggucgcccccuucaguacaccagggcugucugaagcaacgauuggcggggaagcaaucaccauggcaaggggaagacagaguuccaaagugagaggcuucacggagguaucagaaaccagguggccuuagugauuauggugaauggcaaggcuggaggggcggccauggggccuggucagcagagucacagaauugagaacagggcccugcuucacuaggcacaaaacgcagagccaacaagggcacuggugagcuuaucccaugagaagaaaccaagaaaggaugacugguugcuaagagcagcugugcccccacuggaauucaguaugccaugcuggacggauccaaauuacacccuaguggcauaaaaauuauuuugauggcugggcacgguggcucacgccuguaagcccagcacuuugggaagccggaaaaggcagaucaccugaagucaggaguucuagaccagccuggccaacauggcaaaaccccgucucuacuaaaaaaugcaaaaauuagccaggcaugguggugcgcaccuguaaucccagcuacuugggagauugaggcaggagaaucacuugaacccaggagguggaggcugcagugaggugagauugugccacugcucuccagccugggugacagagcaagacccugucucaaaacaaaaaacaaaaacaacaaaaaaauuauucugacauuugcuauccaacagacucaaaaaacagcuuuuucagagcuucucuuauccgaccaggggcagaaacuucggaaagagagcugccaaaauccccucuggggcagacuuccugcccaaaagcacccagagaagcccaugugcaucuacagacgcacaucaccacauaccuuuacccguuccgcagccacacaucgccaaguaccuucuacccuguucuacagaaacacgucaccaccuaccuuuacccauuccgcagccacacaucaccacguaccuucuacccuguucuacagacacacgucaccacgcgccuucuacccauuccgcagccacacaucaccacauaccuucuacccuguucuacagacacacguuaccacgcuuuuucuacuccguucuacagacacgucaccacacacuuucuacccuguucuacagacacgucaccacacacuuucuacccuguucuacagacacacaucaccacgcacuuuccacccauuccgcagccacacagucauguaccuucuaccccguucuacagacacacaucaccacacacuuucuacccauucugcagccacacaucgccacguaccuucuacccuguucuacagacacacaucaucacgcacuuucuaccccguucuacagacacacgucaccacgcacuucuacccuguucuacagacacacaucaccacgcacuuucuacccauuccacagccacacauugucacguaccuucuacccuguucuacagacacacaucaucaugcacuuucuaccccguucuacagacaugucaccacacacuucuaccgacacacaucaugcacuuucuacccauucuacaaacacgucaccacacuugcuacccauucuacagacacacgucaccacacacuuucuacccguucuacagacacacgucaccacacacuuucuacccauucuacagacacacaucaucacgcacuuucuaccuguucuagagacacacgucaccacacauguucuagagacacacaucaucaugcccguucuacagacacacaucaucacgcacuuucuacccauuccagagacacacgucaccacggacguucuacagacacacaucaucaugcacuuucuaccccuucuacagauacacaucaucacgcacuuucuacccauuccagagacacacgucaccacggacauucuacagacacacaucaugcacuuucuaccccuucuacagauacacaucaucacgcacuuucuaccccuucuacagacacacaucaucacgcacuuucuaccaguucuacagacacacaucaucacgcacuuucuaccgguucuacagacacgucaucacgcacuuucugcccguuguacagacacacgucaucacgcgcuuucuaccccuucuacagacacacgucaucacgcgcuuucuaccccuucuacagacacacaucaucaugcacuuucuaccgguucuacagacacacaucaucacgcacuuucuaccaguucuacagacacacaucaucacgcacuuucuaccgguucuacagacacaugucauccgcacuuucugccuguuguacagacacacgucaucacgcacuuucuaccccuucuacagacacacgucaucacgcacuuucuacccauucuagagacacacgucaccacgcacguucuacagacacacaucaucaugcacuuucuaccccuucuacagauacacaucaucacgcacuuucuaccgguucuacagacacgucaucacgcacuuucugcccguuguacagacacacgucaucacgcacuuucuaccccuucuacagacacacgucaucacgcacuuucuacccguucuacagacacacguuaucacgcacuuuccaccuguucuacagacacacaucaucacacgcuuucuaccccuucuacagacacacaucaucacacgcuuucuaccccuucuacagacacacgucaucacgcacuuucuacccccuguacagacacacgucaucacgcacuuuccacccauucuacagacacacgucaucacgcacuucccacccauucuacagacacgucaucacacacuuucuacccguucuacagacacacgucaucacgcacuuuccacccguucuacagacacacgucaucacacacuuuccacccguucuacagacacacgucaucacgcacuuuccacccauucuacagacaugucaucacgcacuuucuacccacuguacagacacacaucaucacgcacuuucuaccccuucuacagacacacgucaucacgcacuuuccacccguucuacagacacaugucaucacgcacuuuccacccguucuacagacacacaucaucacgcacuuuccacccguucuacagacacacaucaucacgcacuuuccaccuguucuacagacacacaucaugcacuuucuaccccuucuacagacacacgucaucacgcacuuuccacccauucuacagacacacaucaucaugcacuuuccaccccuucuacagacacacaucaucacgcacuuucuacccguucuacagacacacaucaucacgcacuuuccacccguucuacagacacacaucaucacgcacuuuccacccguucuacagacacacgucaucacgcacuuuccacccguucuacagacacacaucaucaugcacuuuccaccuguucuacagacacacgucaucacgcacuuuccacccauucuacagacaugucaucacgcacuuucuaccccguucuacagacacacgucaucaagcaguuucuacccauucuguagccacacguucgccacguaccuucuacccuguucuacagacacacgucaccacgcacuuucuacccauucuucagagacauaucaccacacacuuuauauccguucugcagacacacgucaccacgcacuuucuacccuguucuauagacacacauuguuacgcacuuucuacuccauucucaagacacacaucaucacacacuuucuacccguucugcagacacacuucgcuacacacuuucuacuugguucggcgcccuucgguucugcuccuguaugagccuaucugucuuuccugaggaaacugauucauccuucccauacaagcuucuucucucccugccucccugcugaugcagaguguaugagucccuauuucuagcuacucagcaagccacuguuucugugccugccacaugcauaugaauagcuaugagucuguuuguguccguauuuccucccaacaaugcccagucucugggaccagcaacacuaaggugagcaugcauggcaaugguuccccagucauucccaaagggaccaccagcuacguucccagaugaguaugcacugggaaagggaggggucaucacaucccauggccuacagguaucaguggagggagaacaugccacaggagucucuggcaagucagcugggagagcacaaugcaagaucccgggacuguagagccacagagaaucacgcgacauuaacaacagccccugaugugcacaggguacuguacgccugcugacaguguguucagaacugcccaucacaagcuggguucugccacccacucacuccagggcuaaggccgagugcacccauaagacggaguugugccuugggaccgagccugcacaggagcaggggcacgagcugcaggcauacacagcccagacccucacgagcuacugccagggcaccagcagcccaccgagccccucucuacagccacacaagggccccugacgaccacagauggaaaaggggaaagccugggcacaguuaacagugggucaacugggaaugcagacaaacucugccaucagccacucucaggccaggacaacagacacacacaugaagcagccagagguaggcagguauggagacuaagagcacagacuaccaccugccaagaccagugcugacuccuaauauggcaccguccuggagaagaccaaccaaucacuaggcagcaagguaacuacaauggaccccuugcagccuggaagggccagcaguucacuuuuccaagagcagccgugcauucugcaccugaguguuggccucuccuggccauaggguuucagcaggcaucacuacccaacgguuggcaguaggacccacugcacagggccccacauaauacuguaucagaccagagacacuccccagccucggaggugcagagcgggcccaugacucugaggucccccucccccgcuaugucucaucccagagugaacugaagcuuagcugcuuccuagcauuccugacuccucauuccuaaggaccagcaggcaagaagaggagccccgcaagaagaagggggcuccagccaugacucacgacgggguccgaugggaagaggccuuucccaccaggcagaacaggugaaaccaccucacaagcagcaggaaaaacaagacuuccuucuugagcuggacaguaucaugaaaagggugaagaaaggcaggaggaagguggcuggcaagaucaaacagcuccaaucugcagcucccagcaagaucaacacagaaggcgggugauuucuacauuuccuacugagguacccagcucauuucauuggggcugauuagacagugggugcagcccacagagggcaagcacgguggggaaucaccucacccaggaagcacaaugggucggggaacucccucuuccagccaagggaagccgugaggaauggugcauucugguccaaauacuaugcuuuucccacagucuucgcaacccacagaccaggagauucccuucagugcuuacaccaccagggcccuggguuuccagcacaaaacugggcgaccauuugggcagacaccgagcuaguugcaggaguuuuuuuucauacccuaguggugccuggaacgccagcgaggcagaacuguucauuccccuggaaagggugcugaagucagggaggcaaguggucuagcucaguggauccaacccccacagagcccaggaagcuaagauccacuggcuugaaauucucgcugccagcacaguagucugaagucgaccuggggugcucgagcuuggugggaggagggacguccaccauuacugaggcuugaguagguggguuuuucccucacaguguaaacaaagccgccaggaaguuuaaacuggguggagcccuccagagcugggcaaagccgcuguagccagacugccucucuagauuccuccucucugagcagggcaucucugaaagaaaaguauuagcccuagucaggggcuuauacauaaaacucccaucucccugggacagagcaccuaggggaagggguggcuaugggcauagccucagcagacuuaaacaucaccgccugcuggcucugaagagaucaguggcucucccagcacagcgcucaagcucugcuaagggacagacugccuucaaguaggucccugacucccgugccuccugacuggguguuuaccucccagcaggggucaacagacaccucauacaggagagcuccgguugacauccggagggugcccuucugggacaaagcuuccagaggaaggaacaggcagcaaucuuugcuguucugcaaccucugcuggugauauccaggcaaacaggguuuggaguggaccuccagcaaacuccagcagaccugcagcagagggaccuggcuuuuagaaggaaaaguaacagaaaggaauagcaucaacaucaacaaaaaggacauccacacaaaaaccccauccaaaggucaccaacaucaaaaaccaaagguagauaaauccacaaagaugaggaauaaccagugcaaaaaggcugaaaauuccaaaaaccagaaugccuccucuccuccaaaggaucacaacuccuugccagcaagggaacaaagcuggacgaagaauguguuugacaaacugacagaaguaggcuucagaagguggggaauaacaaauuccucugagcuaaaggagcauguucuaacuuaaugcaaggaagcuaagaaccuugaaaaaagguuagaggaauugcuaacuagaauaaccagcuuagagaagaacacaaaugacuugacggagcugaaaaacacagcacgagaacuucaugaaauauacacaaguaucaguagcugaaucgaucaaguggaagaaaggauaucagagauugaagaucaacuuaaugaaauaaagcaugaagacaagauuagagaaaaaagaaugaaaaggaacaaacaaagccuccaagaaauaugggacuaugugaaaagcccaaaccuacguuugacugauguaccuaaagugacggggagaauggaaccaaguuggaaaacaaacuucaggauauuauccaggagaacuuccccaaccuagcaagacaggccaacauucaaauucaggaaauacggagaacagcacacuccacgagaagagcaaccccaagacgcaaucaucagauucaccaagguugaaaugaaggaaaaaauguuaagugcagccagagagaaaggucagguuacccacaaagggaagcccaucaaacuaacagcagaucucucugcagauacccuaaaagccagaagagagugagggccaauauucaacauucuuaaagaaaagaauuuucaacccagaauuucauauccagccaaacuaagcuucauaagcgaaggagaaacaaaauccuuuacagacaagcaaaugcugagagauuuugucaccaccaggccuuacaagagcuccugaaggaagcacuaaacauggaaaggaaaaacugguaccagccacugcaaaaagaugccaaauuguaaagaccaucaacacuaucuaugaagaaacugcaucaacuaacgggcaaaauaagcagcuagcaucauaaugacaggaucaaauucacacauaacaauauuaaccuuaaauguaaaugggcuaaaugcccccaguuaaaagacacagacugggccgggugugguggcucgcaccuguaaucccagcaccuuggaaggccguggcaggugaauuaccugaggucgggaguucgagaccagccugaccaacauggagaaaccccgucucuacuaaaaauacaaaauuagccaggugugguggcacaggccuguaaucccagcuacucgggaggcugaggcaggagaaucgcuugaacccgggaggcagaggcugcagugagccaagaccacaccauugcacuccagccuggacaacaagagcgaaacuccaucucaaaauaaauaaauaaaaagacagacugcaaauuggauaaagagucaagacccaucagugugcuguauucagcaaacccaucucauguacaaagacucaaaauaaagggauggaggaacauuuaccaagcaaauggaaagcaaaaaagaagcagggggugcaauccuagucucugauaaaacagacuuuaaaccaacaaagaucaaaaaagacaaagaagggcauuacauaaugguaaagggaucaaugcaauaagaagagcuggcagggcgcagugguucaugccuguaaucccagcacucugggaggccgagacagguggaucacgaggucaggagaucgagaccauccuggcuaacacgcugaaaccccgucucuacuaaaaaauacaaaaaaaauuggcugggcgugguggcgggcaccuguagucccagcuacuugggaggcugaggcaggacaauggcgugaaccugggaggcggagcuugcagucagccaagaucgcgccacugcucuccaaccugggcgacagagcaagacuccgucucaaaaaaaaaaaaaaaaaaaaaaagaagcgcuaacuauccuaaaucuguaugcccccaauagaggagcacccagauucauaaagcaaguucuuagagaccuagaaagagacuuacacugccacacaauaauagugggagacuuuaacaccccacugucaauauuagacagaucgggacagaaaauuaacaauacucaggacuugaauucagcucuggaccaggcagaccuaauagacaucaagagaacucuccaccccaaaucaacagaauacacauucuucucagcaccacguagcacuuacucuaaaauugaccacauaauuggaaguaaaacacuccucagcaaaugccaaagaacggaaaucauaacaaacaaucucucagaccaaagugcaaucaaauuagaacucaggaugaagaaacucacucaaaaccgcacaacuacauggaaacucaacaaccugcuccugaaugacuacuggguaaauuacgaaauuaaggcagaaauaaagaaguucuuugaaacaaaugggaacaaagagguaauguaccagaaucucugggacacagcuaaagcaguguuuagagggaaauuuauagcacuaaaugcccauaacagaaagcuggaaagaucugaaauugaugcucaaacaucacaauugaaagaaccagagaagcaagagcaacgaaauucaaaaugaauccaggagcugguuuuuugaaacgauuaacaaacuagacugcuagccacacuaauaaagaagaaaagagagaagaaucaaauagacacaauaaaaaaugauaaaggggauaucaucauugaucccgcagaaauacaaacuaccaucagagaauacuauaaacaacucagugcaaauaaaacuagaaaaucuagaagaaacagauaaauuccuggacacauauacccucccaagacuaaaccaggaaaaagucaaaucccugaauagaccaauaacaaguucugaaauuaaggcaguaauuaacagccucccaaccgaaaaaagcccaggaacagacggauucacaguugaauucuaccagagguacaaagaggagcugguaccauuccuucugaaacuauuccaaacaacagaaaaagagggacucuucccuaacucauuuuaugaggccagcaucaucgugauaccaaaacccggcagagacacaacaaaaaaaaauuucaggccaauaucccugaugaacaucgaugcaaaaauccucaauaaaauacuggcaaacugaauccagcagcacaucaaaaaguuuauccaccacgaucaaguuggcuucauaccagggaugcaaggcugguucaacauaugcaaaucaauaaacguaauccaucacauaaacagagccaaugacaaaaaaccacaugauuaucucaauagauucagaaaaggccuucgauaaaauucaacaccccuucauacuaaaaacucucaauaaacuagguauugaugggacguaucucaaaauaauaacagcuauuuagacaaaccgacagccaacaucauacugaaugggcaaaagcuggaaguauucccuuugaaaaccgguacaagacaaggaugcccucucucaccacuccuauucaacacaguauuggaaguucuggccagggcaaucaggcaagagaaagaaauaaagaguauucaaauaggaagaaaggaagucaaauugucucuguuugcagaugacaugauuguauauucagaaaaccccaucgucucaacccaaaaucuccuuaagcugauaagcaacuucagcaagucucaggauacaaaaucaaugugcaaaaaucacaagcauuccuauacaccaauaacagauuaagagagagccaaaucaugagugaacucucauucacaacugcuacaaagaaaauaaaauaccuaggaauacaacuuacaagggcugugaaggaccucuucaaggagaacuacaaaccacugcucaaagaaauaagagaggaaacaaacaaauggaaaaacauuccaugcucauggauaggaagaaucaauauugugaaaauggccauacuucccaaaguaauuuauagauucaaugcuauccccaucaaacuaccauugacuuucuucacagaauuuuaaaaaaacuacuuuaaauuucauauggaaccaaaaaagagcccucauagccaagacaacccuaagcaaaaaaaaaaaaaaaaaaaaacgaagcuggaggcaucaugcuaccugacuucaaacuauacuacaaggcuauaguaaccaaaacagcaugguacugguaccaaaacagauauauagaccaauggaacagaacagaggccucagaaauaaugccacacaccuacaaccaucugaucuuugacaaaucugacaaaaacaagcaauggggaaaggauucccuauuuaacaguguugggaaaacugucuagccauaugcggaaaacugaauuuggaucccuuccuuacaccuuauacaaaaauuaacucaagacagauuaaagacuuaauuaaauguaagaccuaaaaccauaaaaaccuagaagaaaaccuaggcaguaccauucaggacacaggcaugggcaaagacuucaagacuaaaagagcaaaagcaauggcaacaaaagccaaaacugacaaauggaucuaauuaaaauaaagagcuucugcacagcaaaagaaacuaucaucagagugaacaggcaaccuacagaagggaagaaaauuuuugcaaucuauccaacugacaaagggcuaauauccagaaucuacaaggaacuuaaaacaaauuuaccaaaaaaaaaaaaaaaaaaaaaucaaaaagugggcaaaggauuugaauggacgcacuucucaaaagaagacauauaugcggccgacaaacauaagaaaaaaagcucaucaucacuggucauuagagaaaugaaaaucaaaaccacaaugagauaccaucucaugacaguuagaauggcgaucauuaaagucaggcaacaacagaugcuagagaggauauggagaaauggaacacuuuuacacagcuggugggaguguuaauuaguucaaccauuguggaagacaguguggcgauuccucaaggaucuauaaacugaaauaccauuugacccagcaaucccauuacuggguauauacccaaaggauuauaaaucauccuacuauaggccgggcacgguggcucacaacuguaaucccagcacuuugggaggcugaggcggguggaucaugaggucaagagaucgagaccauccuggcuaacacggugaaaccccgucucuacuaaaaaaaaaaaauacaaaaaaauuagcugggcaugguggugggcaccuguagucccagcuacuugggaggcugaggcaggagaauggugugaacccgggagguggagcuugcagugagcugagacugugccacugcacuccagccugggcagcagagugagacucugucucgaaaaaaauaauaaaauaaaaaaaaguaaaucauccuacuauaaagacacaugcacacguauguuuacugcagcacuauucacaauggcaaagacuuggaaccaaccuaaaugcccaucuggauaaagaaaauguggcacauauacaccauggaauacuaugcagccauuaaaaaaaaggaugaguucauauccuuugcaaggacauggaugaagcuggaagccaucauucucagcaaacuaacacaggaacagaaaaccaaacaccgcauguucuuacucauaagugggaguugaacaaugagaacacacggacacagggaggggaacaucacacaccugucggggggugggagggcuaggagagggagagcauuagggaaaacgccuaauguagaggauggguugaugggugcagcaaaccaccauggcacguguauaccuauguaacaaaccugcagguugugcacaaguaucccagaacagggaaggggaggggaguggggggagggggcagggaaggggaggggaguggggggaggggagugggggaaggggaggggagugggggaggggaguggggagaugggaguggggggggagggggaggagugaagggaagggaagccagaaaggacagggcaguggagagggugcugcagucaugaaggcaucaaacaaggaaagccuauucuaccuuaaaugcaagaagaauagaaacgaaucugaaaacaggagucagcaauagccuugacuuagggcuaaccucaguuaagaugaaggaagcaaguuucacagcacuacaguguuucuggcuguaagauggaauaguuaccacagaagaagaguugggaaggaaaguuaaguccagggaugaaaaauuaguucaaggucacccgugaggaagcgaggugacuuaagaacauucuaacagcaagguaacccaguucuaagcuuuuugucguuauucuuucuuauuguaaaauagugcacgcacacacagagagagaaacugcauaaaacguacauagagcuugacaaauaauuauaaagcaaaaucgagguaaccaccacucggguccagaagagaaagucacgggucugccaggagcacccaacgugcccaaugaaccacugccuuuuagccccagacacacacacacacacacgcucacacaugcacacacacgcaugcacacacauacacacccccuggaaaacacaguggagcucugccugcucuccagccuguccaugugauucugugccuucauuaucaggagaaucuuccuuguagcugcucguggcuguggcucacacacacccagggcugcacagcaucuuguggcauggacauagaacacugcaccacucugacugcagaggcacaucugggagcuucuuuuuagcuguuaugagcagagcugcucugagcauccuuucccuguguccugaugcacaaguaccaaguuucccugaggauacaccacaggaaugggcuugcugagccaaagggcaggcaacccacaggacuggguaacacugaagagcuucagaggcugcuccaaguaaaacagugacuccaaguaacacucucgccagcaguggugaaaggugcacucucagacacugccccacaccugggcccguuccaacguuuugccacaaauauaucuggaggauauauacccgcacagaugcuccucagcuuacaauggggucaugccccaauaaacccaucguaaacugaaaauaucaguaaguagaaaacacacugaauacacuuaaccuagcaaacaucacagcuuagccuaggcgccuucagugugcucagaacacuuacacuagccuacagccgggcgaaaucuaacacacagccuguuuuagaauaaagugcugaguaucucguguaauuuacugaaugcuguacugacagugaaaaacaaaaugguuguagggcacaggaaacacgguuuccacugaacgugcaucgcuuuugcaccacggugaagcugaaaaaucuuaagcauugcaagcugcaggccgucugggugucaucuuuaauuugcauauccuugaugacugaggccaagcagcuuuucacaaaucaguuaggcacauggggucccacucucaucaagaaucuguucuuuugccuuuuuuuccuguuggcucuucuuuuuucuuauggcuaugaaugagcucuuuauauauucuggauacuaguuauuuaucuaccacauacauugcaaguaccuuuucccccucuauaguuauuaauaguugggguuuuuuaaaauuaucuuuaucaucuuucaaggaaaagaagguccaaacuuuaauguugcugaauuugcaaucuuuuccuuuguggcuaauauuuucauauucuuuguaagaaauaauuucuuaauccaagguuaugaagauauuccucuauauuaucuccuuaaaacuuucuagauugucaagccugacagauuauuuuaaucuguaguaaacauuuuuuuuuuuucaguuuguucauucuggaggugagaacagccauccuggaacuuuuagaguugugcaauuuuuagagcugugauucguaaccgaauaguucaucaaaaucacuuagaaagccuuuccccaaacucucacgcccgucccugggauucugacuccacaggcucuuccaagaacucugcugugcgagaaacauggaaccacuggagagugcuuucugauacucuaggcucucaaggaaaccauugccaaccuggggaauaucugucacucaccgucuuucagcuccugaacaucccugggcugaacaaaaucuggcuugacauucucgaaccaccaaaaaagcuccgcaauaaaaaccauaacauucggcuaaaagacaaaaacaaaaaaccaaaguaugauaagcaguuuauucacacaugguuuuaaaacugcaugccaaauaauucguuauuaccuucaacacuaauggcgcauacagcauaucuuccaaggugagauaaaaacauuuauuaagauauucauuggagaauucucucagaagccgaauauuauacagacugucggccaucgacguuaccuccuuuaagcauauaucuaauagacaaaaagaaaaucacaauuuauuguaaagguauucugcuucgagagagagagaagcauucuaaaaugaaaaccauuuuacauaaagguaguaaugaagauaaugacauugagagauguagggaguauaggauguacaacaaguaacacuaaguauaaaaagaaaacacucaagacaacuccaggaaccucucaagucugaauuugauggugaacauccagaaagcauaauagaaaucgcucagaucucaagagugggcuuccaaaacaaacagcaacaaucaccuuucacuuuacagcagagccaugcugcacguagcgaguaaauguugagccgaguuucuuccgcccaucagaaacccucugcacaagguuuccguguuuguaaagggcagggggaagggaaaugaauaaaacguaaagcaucaggcucauccacgcccacucagugauaacacaggaaugugacuaaucacaaagaucaagugacaaugcauagcccaagucucuuuccaugaagagguggagacugguggcuauagcaucugcagggcaacuuuccauugcacgugacuuugcagacccuccauggaggaagcaccaguaugggcaacaagucacaggaccaaagagcaggccucccccuagucuaggcacccugguguggagugggggguggcccucagacaaagagcccugcggagagcacggugcagcucaggacuccgugagaagugacuugacuuuauuuugccuguaaauauauacauagagaaaaaauagaauuucagaaauaacuuuuuacauaaauuuuauuucuaaggaaaaaaccauuuucaaggguuuagaaguacguacaaacuggagccacagcauccagagucguucaugaacugcccuccacagucaccuaagcagcauucauucucaaaagaaaacuuuaaagcugaggaacugugcacacucacacugcuaaggauguuuccuuuuguacaguucugaccaucaaauguuaacgucuuauaggcuucagaucuuuucuuuuuuagaaauaaaacagccgaagucaucuccaucuccaaagggaaccauucucccaacacugccacaaacccuuuccacuccuccugaguauucuacacacugucugcauccacaaguaacacaaacaguguugucucagccuugagaaacuuacauucaugguaucaagcuaugccucauuuuagcagccaguuuuugccccaaaacucaguaugauguuuucaaacagaucuauguugauacggagagauuuccgucacucaucuugaccgcuauaugguccuccacgauuucucacaauuaugacaaaugcugccaucacaaagcuugcgugugcugucuaugcguguacagacggguguugcccaggcauacucugagaggggacucgcugggccacgagcuaggcacgcccuccugugucaccuggcaacgcccuucugccugguugugccucgcuccagucccacccacagcacuccacagcuugcuccuucccaccugcaccgcagcaugaccgaccuguccaugucugccaggcggaggggcgugaacaccuccuucucaaacagcaugccucugaugacugcuguggcuuuacuuuuucaugguuacuggucaugaaggguccucuccuguggacccuguccauaucugccuugggcugugcaucuuuuucuuaccgauucuagaauucuuucuggauugugguuacgaaaggacuggaugacaguccuucaucaggucacgugugcugcaaauauuuucaauggguacaguuuaucauuucauuuuguuuaugauguucuuuugucacaggaaaguuuuacauuuugauaugguuacauuuaacaaucuuuucuauuugugcuuuuuauaauuuuggcaauccaucucuacacgaacaucauaaaaguauuugccuuuaucuucucaaaauucuuaaauuuuacuuuucagguuugcaucuuuacuccgaggaagggguauuucuggcucagguggggugagguuuuacggcacuuucccauagagaugucuaugccgccauguucuugaccagccagcgcggcucccucggugaggccaccccaaaggcaccagauucccugcaaagcaucucuuuucucaguucuacaugugguuuauucaucugguccaugugacugccccggaaccaaaaccacacuguuuuugguaaugcaaaguuaagcaaaauuugguauuuguagggcacauacccugcacauucuuauucuucaaaacuacucagcuaaaaucugggacaauuuaagcaacaaaauaaauaaugaaaguaaugaauuaugaccuauugaauaaaguaagauccaugaggccauccggauauaaacaaacacaugaauaaagaagcaagcaaguggggcaaacgcugacaaaauggaaagaugcacugaggcuggaagccauccacacguggagagaccagcaggugagagucugaugagaaacguauucacaguccaaagccucuccccacaaauuacuaaugcauucuaaagcaaaaacagcaagcuuagaaguggggaaggccagcacaugccaccugcaccaaggggugaagcuggagucaccaauacggagaugucccaguaccuugccccugaggugacacgcugggaggacacaccgcaaggaaacuccagacaaacacaccaagggccacuacucacaaccuuacucuucgaaaacaucaagagucaagagagguaaaggcuggaaacgacuccagaugaagggaaacuaugaggggacgcugggccaagcaggugcuccuggguaguugagcgagucaggaccaggcuggggaucugugugccaacguuagcuuucccaacuuuugcuguguuacucucaaaugguugagagagacacagaaauaacacaauccaagagaauuucugcauugccuuguuaauaucugugaagacaaaaguauuuacuggacuggcgacaaguuuucagaacaaucuggagaaaucacaaguuuuaauacugacuggggaucuaaguacacuuguuucagucuucucccaagagaaauagaaaagccgauggauuuucuucgccucucuucugcugcacuuacucccaaaugccucccaguucucacaugacaagagaaugcucauagggagugggcacugcagugcagggcaggggcacagggcagcccuggcuacggcucccacuaccuuccucuugccaggcucagagaacccgcuccgucaggacacaaaggcaccgcuucuccugggccuucaauggaacugcaccugccacagguggggucaacagccuaugagguccaaucaagucccuaugaggcccagagccacgaucagaagggggcagugacugcccacaagugauucccugcccuuacugagaugacuguagagaaucuguucaauuugcgcuaauauuuuacauaggauuuucaauccauacuaacauggaaagccagccuagaauuuccucucauagccuacucagugucagggaauaauccccuuuugggccacuccaucuuuuccuauuaucugggacacuugacauaacacaggagcugacaauuccuugagagucuggugaaaugccccaggaagaaguuggucccuguggauguauguguugacuccugaguccguuuccuuuguaguuaugggucuauuuagacugcccaccacuuuuggcuucaaagaagauugcucauuuugucuaacauuucaaacacauauggcacacaaauauucucaguauuuuuauuucaguagcugcuauaccugaauucuugaucagucuuuccagauuaucuauuuuauuaauucuuuaaaacaauaagcuuuuaguuuuacauauucucuagaacuuuggaauuuuuucuacuuuauucacuuuuugcuguuaaauuugccaaaacuuuuuuuuuuuugagagcaggucucacucugucaucuggagugcaguggcacaaucacagcucauuguggccucagccuccugagcucaagugauccuccugucucagcuuccugaguaucugggacuacaggugcacaucaccaggccaagcuaacuuuuuaauuuuuggggucucauuagguugcccaggcuggucuugaacuccugggcucaaaugauccccccgccucagccucccaaagugcuagaauuacaggcaugagcuaccacacccagcaaauuugccaauuuuuguuaacuuuuauuuuagguuugggaggguacacgugaagccuuguuacauagguaaccucaugccacggggguuuguuguacaaauuauuucaucacccaggaauuaaguccaguacccaacaguuaucuuuucugcuccucucccuccucccacccuccacccucaaggagaccccagugucuguguuuccuucuuuguguucuuaaguucuuaucauuuagcucccacuuuuuuuuuuugagauggagcuucacucugucacccaggcuggagugcaguggcgugaucucagcucacugcaaccuccaccuccuggguugaagcaauuuuccugccugagccucccgaguagcugagacuacaggugugcaccaccacccccggccaauuuuuguauuuuuaguagagacaggguuucaccuuguuggccaggcuagucuugaacuccugaccucuggugauccacccaccuuggccucccaaagggcugggauuacaggcgugagccacugcgcccggucuuagcucccacuuguuaagugagaacacgcaguauuugguuuucuguuccucuguuaguuugcuaaggauaauggcuuccagcuccauccacauuccugcaaaagacaugaucucauccuuuucuauugcugcaugccaaaauuuuaaaauuuguauuuuacuuuaagaagcuggcugggcucaugccuguaaucccagcacuuucagaggccaaggcgggcagauuaccugaggucaggaguucgagaccagccuggccaacauggcgaaaccccaucucuacuaaaaauauuaaaaaauuggccaggugugauggugcgugacuguagucccagcuacuugggaggcugagacacaagaauugcuugaauccaggugguggcagaggcugcagugagcagagaucgggccacugcacuccagccugggugacuaagggagacuucaucucaauuuaaaaaaaaaaaaaaaaaaaaaaggccgggugcgguggcucacgccuguaaucccagcacuuugggaggccgaggcgggcggaucacaaggucaggagaucaagaccauccuggcuaacacggugaaacccugucucuacuaaaaauacaaaaaauuagccgggcgcgguggcgggcgccuguggucccagcuacucgguaggcugaggcaggagaauggcgugaaccugggagguggagcuugcagugagccgagaucguaccacugcacuccagcauaggcaagagagugagacuccagucucaaaaaacacaaaaaaauaaaacaaaaacaaaaaagccaaacuauuuguuuugaaaagcuuaagagaacuaggucucugccuauauuaguccaucuucacacugcugauaaagacauaccugagacugggcaauuuacaaaagaaagcaguuuauuggacuuacaguuccacauggcuggggaggccucaccaucauggcggaagaugaaaagcacgugucacaugacggcggcaagagagagaaugagagccaagcuaaauggguuuccccuuauuaaaccaucagaucucaugagauuuauucacuaccacgagaacaguaugggggaaacugccccugugauucaauuaucucccaccaggucccucccacagcacaugggaauuaugggaguacaauucaagaagagauuuagguagggacacagagccaaaccuuaucacugcccauuccacuccuucugccuguggccucgguaagagaacacgcagccccauccccuacccuaugacuaagaggcuacagcccacugucacaacagacaagcacagugcaggugguccucugugugccuccccagccucucuccccaguggccacacagcaggaugugugauuaaacccagacugagucucuauacaccauaacuauguaaccaucuuccacagcuggguuacacagugucucuacuuacacuccuugcacaacucuucauuucuccuggauuuaauacuuggcucaguuauucaccuguuauugccucugagccggacaggccaacugccuccuccuggucugugccuuugucccacgcuccuggcccauccaugggaaggcuggcacuguggauuucagccugagccucccuccaccuccucuucaggauggugugcgugcacacacuccccagcacugggaaggcaccucccagucaucuuccuuccaggacuguggcugaggaaucuggugucauuggggcugccugcuuguguguaaccugcuuggucucuccacaguuauuugggaucuccucuuucccagggguuccggagcucaucaugguaggcuuugccauggcccuucuucaggaauccugcuggccacccacuggguccuuccuacuuaccacgcauguccuugggacauuuuucuacauuuuguguugacuaaguucuuuucuccuauuuucucuucucuuucuucguagacugauccugauuuuuccaucuuuuuucccuuauuucccaucucuuugcuuuucugguucuacuuucugggagauuucuucaacuguccucuagcaguucaguggcucucccaucuuagcaaccaaauauuuccuucccaagaacugguuuuuggcggcucuuuagaauuugccagagaauucuaaacaagcuguagcacuccaacagcuguucugagucugaugauucuguacacaguuaugugccacuaucuugcagacauuguuucccagaguccuguuguugguucugagguccaaacccucucaucucuaacauuuucuccugcucaccugcaccaucucuguugauuuggguucucauucaggucaguggcuuuccucaaaugucaggaaucuuuggcugcugcuccuaguaaagagugagucacugugagucuuuuuccugaggccgauuucugcagagaagaauccuucccuguguugcauguggggcaggucugcauuauggagucaagugagagagacgguggcuucuggggcagggugcaccaggaggagaaccagucucaccuucggguaugaagaauuuuacacaaaagcccugauuucagugucaccucaucccuaccugcaccuggggucugaggcuagagccuaucuggcucaguucuccucaagagugucccgcaucuacugagggcaugugaggagaaaggcaucagaagcaaagugaaccugagcucucauugcuggagaccaacuuucaaggaauccacccucaggcacugcuguccaccagcauccuuggugcuccguucugcuguccaggguccuauaggaugagccucuuugcguccccagcuugacacccaccccuccuccacuuugccuuuuuuuuuuuuuuaauuacuucuccauuagaggacuuguucagaguccagauauaucuuaguuucauccaaaauggaaucuguaauucaguuccuuauucuccuuguuugggagugacuucugacuaacagaaauggauagaaaacugcccuucauuucuccuuccuucaacuuuuuuuggguuuacuucuacguucuuuuucuaguaacaaauaccuacucaacaccaacuggccccagacacuauuucagaugacugggauacaucagugagcaaaacagguaaaacccugccccuguugagcucacacuagcaagucccacuacucuuuccccuaugauccaugaaauauuuaaaugccuucucuggcuuccaggcacucaaucuuuaagauuuuagaauaacugugcauuugucaggguucuccagacagacagaaccaguaggacauacgagaagggauuuaaucagagaaaucugcucacaugaucacaaagacagagaaaucccacaacaggccaucugcaagcuagugaaucagagguggcagcaugccuggguccaagucuggaagccucagagccagcaaagcugauggugcagcccccaggccaaggccaaaggccuaaaaucccccaggaagccauggugcaagucccagagucuaaaacccaaaaaaccuggagucugauguccaaggacaggaagagagaaggugccccacucaguaagggagagagagcagagagcagagagggagagucccccucuucugcccacauugaaggcaggucuucccuucucaagccacugacucacacccaucuccccuggaaacacccucagagacacacccagaaacaaugcuucaccagucaccuaggcuucucucaauccagucaaauucacaccugaaaugaaccaucauuaauucacaggcaggaaaagaagcugcaucuucuaguuggugaguucucacuuuacugcacuguggagaauguacugauucuuugggaucugcugcagucucaccuguggccuuaaucgacugcacguuuuauaaaggcucccauguuugucuuuacugucuguaagugagcagauuccacaguggcuggugcacuggaugaagccugaaguccucuauggccuuacuaaaugaucugcuuuaucaaucaguuucuguuacauaagucagcaauguggcucuguccauuucuccuuguaacucugccauuuuguuuguuuguuuguuugagacagucucgcucugucacccaggcuggagugcaguggcacgaucucggcucacugcaagcuccaccuccuggguucacgccauucuccugccucagccucccgaguagcugagacuacaggugcccgccaccacauccagcuaauuucuuguguuuuuaguagagacgggguuucaccauguuagccaggauggucuugaucucccaaccucgugaucuacccaccucggccucccaaagugcugggauuacaggggugagccaccgcgccuggccguaacucugccauuuuuuaaaauccauuuugauguucugcucuuagauaaugagcuucaauacagucacaccuuccuguaaacuguucacaugaucauaauuggcaaugacccuguauccuuagcaauucacucugucuuaagauccccaacagacauacagggcaggcugcacacaaugaaggaaaagucaaauuuacgaacuagaagguggacuucagaaagcauccagggccaggugcgguggcucacguauggaaucccagcacuuugggaggccaaggcaagcagaucgcuugaacccaggaguucgagaccagcccaggcaacauggcaaaacccuaucuccacaaaaaaaaaaaaaauaaaaaaauacaaaaguuagccaggcauggucguacgugccuguagucccagcuacucaggagguugagaugggauaaucaccugagccugagaaguccagagaagucaaggcugcagugaaccaugaucacaccacugcacuccagccugggugacagagugagaccuugucuccauaaaaaauaaauaaauaaaauaaaaagcauccagaacucagcagggagaauguaagagaugaacacauaaaagaaggucccauggccaggcgcgguggcucacaccuguaaucccagcacuuugggaggccaaggcagguggaucaccugaggucaggaguuccagaccggccuggccaacauggugaaaccccaucucuacuaaaaguacaaaaauuagcuggguguggugguggacaccuguaaucccagcuacucgggaggcugaggugggagaaucgcuugaaccugggaaguggagguugcagugagccaagaucacgcaguugcauuccagccugggugacagagcaagacucugccucaaaaaaaaaaaaaaaaaaaaaaaagugccaagacaagaccuggaggaugaagaaaaucacagcacaucugaagaccccaaccccuccgccgucuucuuuaaggugucuaguucucuuuuuaauguccaucauuuuaaauauccuguuaucuuucacccaugucuuggugccaaaucagcugcagugccugcuuucccugcgugguuucugauuuuucaaagaguuugucuuccagcagggguucuccucagugggcagccagcaugcccuggcucauggaaaugucccugcacagccaagcugugcuuuaucccugccagggaccaugaguuucacuaguucuagacuacuuguugcacuaacauucaaccaguauucccacgccacaugggugauacacaucucaaccucccucugauccaccguguacccaagagcugcauuuccuccuuaaagagcuucuccuccacauccccagagccaagggcaucugucaggccuccucaguucacuccugggcaguagguggaguuuucuaguccucuucccaaaaggucccagucacagcuccugacagcacauaggcccagggccaaacgaacauggaaacucaggcccaaggggccccagggcaccuaccuguccuccacucaugaguuuucacucaaugacagagaccgucuccugguaccugaggcucucuccuucuuccuuuuuuuuuuuuuuuccccccgagacagagucucgcucuguugcccaggcuggaauucucuggugcaaucucggcucaccacaaugucugccucccagguucagacaauucuccuguuucagccucccaaguagcugggacuacaggcacgcgccaccacaccuggcuaauuuuuaguagagacaggguuucgccauguuggucaggcuggucucuaacuccuaaccucaggugaucuaccgccucggccuuccaaagugcugggauuacaggcaugagccaccauauccagccuguuccuuuaagugcagcuauauauuugugaaacuauuuuaucuaagaaacuauauuuucuagcauuuuuacgcccaguaggaacaagaucaaugccagcucaauccacccagcaccugaagucugacacaaauguuuccauauuaguuuggggggcaccucuuggccuuguaucugccuacuucagaaugaauggggcuuagcaaaaccuaaaucagaauucaugcucccccagccccuguccagacacccacugucgugcuggugacagucacucucucucucuccucguuguuaggguguaaacaccuggagggagauacacugucaucggaacguccccaacacgaagcguguggcaguuguucauaaaugguucauaaacagauucaauuuugcauuaauuuucccauccucaaacuaaguucuaggugauuuaaaucaauugaggaaggauuuacaaaagcuacccauucugagacauagauaaagucacaaauacuuucacacauuacucagauacuuugaaguaccauuucucucucccucuccaccaccccccgcccaccccaccccgggcuaaggugauccucucaccuuagccucccgaguggcugggaccacaggcgugugccaccacacccagcuaauuucaaagugcaguuuugucaucagauaaaaugcagguuaaguaugagcacaucaucccccaauuuuuucaucuauaggcuaacaucccaauuuauauuaaggauuccauuuucuuucucuuuuuuuuuuuuaauauauauguggaucaauguacacuauaauuuuccuuuaagccuuuucggaucuguuucagggaagcauucuccacucaccauccaguuucaucugcucugggcaauaauagugaaucacagcuaagagagcagcaccaucacugccgucucucaucaaauccuccaacaacgggaaguagggugacugccuagcagaaaggugcucucgucgauagcggaccuguaguugauaaaaggaaaacggucucugcaugugaugucucuucacuaccauauauguuacaggcacacuguuagaucgagaauuaacauaacgccuaacagacaacauggagaacaauugcaauaaucuagaaagaguuagaaacgucuggauuacguacuuugccuggaacauauaugucaagauccaaggagcugggcuucauggcuacacuggguaacagcaacuacuugcuagcaauaccagagccagucuacucuaaacugaccuggaagcagaggcugccacuagugcaggcacacacgggaaaggacacagaacacacaccuacacuaccgaaagccgacguacuagacacuaacgagaaacaaguuaaauggugaacauccugacgcucagaagacccaaguuacuguuacuuuucugaguaauaucacuagccucagucauuaagaaaaacacaaaacagcaugaauauuuaguuugagaaauuucagaagccagguuagacaaaauuucucauaacacaaccaccaccacucuauuaacggcaaugaagcaucaggaggcgaaauccaugcaaggugcuccagaagacaagugucugcucaaggauuccauguuucugcauuuacagaaagccacacguguggccuucugcacuccaucaaacccucagaucugccccuguaucugcaugucagcgaacaagagcacagacacaggccacugagggcaggacacucagccccagccccacugccaaacagccugcaguacacugguguuuucugcauuaacagccacgauacagcuuuaaaauauggcauuucuugccaaccacauuuucuccacaggaggaaaauacacgauacaaacuagaggaagaaaaccagcaaucuacaauaaaaaaugacugauuucugagagucaugcagcugaaucaacuugaggagaaauugucuaaaaucaagaauuucagguuguuaugucaauaaguacaucauguagaauaaucaauacugauguuuagcaaaaaacauuuguaacacauucucuuaaauuuagcaauaaggcuuauuuuaugucaauaaaaucuauuucagcacacacuuuaacuuguuucucgggagcccacggcacacacuacaaaacgugacccgccucauacuguaccacgcgugcaaacuccacggguuccagcaugcagugcaccacagcaugcgccaggccaggcuuccacacagacagcagacacgugaggggggaacacaggcaugcgggaaagcacaugguuucuugauuaaagauggauggggugggcuuaaggucaggugaaacacuccggaacuacaagaguccaggaacuuguauagcugccuugcaaaucaggugcugugaaccucuaggcuguacaguguugagguuagaccucuaaaucuguccgucuuucccaggccuuuccacacuucuccucacugaccuauuuacugaacacuggggucggaaaguuaggguuaugaacuaucuaauaaaaaagcauuaagggacccaccacccuugguaacauguuucuguuuuuauaaaacucucaugugaccucacuuccugcaggacagacgaagucugugagcccuugacuaaaucacguaagugcuuugauauuuagcucuucagucuucaggauucaaaaaguuaaaagaucuauauugauuuagaaugcuuuccucuuucuucuuauuaauauauuucaagagaggcaaaaugaucugugagcucugcagcagaaucuaccgcugcucaaaggagcccuguaucccagcuuacucccgcugcuaucgccucgaggauggacuucaaaggaaaauaggggcccaauaaugacacugaaggacacaggcaguuaauggaguaugcauaaagcccucugcaagaucuccauccaaaaguucccgagaaaggcaccacuggcaccaaguacucucuccccaggggccugguaacaaacuggcuccgcuuccagaaugggccaccagguggagcacaacuaggguuggaaaaccaaaugcuguuuucaccuuucuuuuuaugugaaaauucacacuuaacuccagaaagccuguggccaggcugaccuaacucagacccuugccugggaauaaggaaacgccccuuccccacuccaugcaggccgaggcagcaggaauggcugcaacacccgaggaggagaacagaggaaucugacaugcuggugagagccccucucugcagcccuccagcccuaguccaccaggugcaucacccgcauaccuggaccacccagcugauggcuccuaacagaugucacauuacauaccacagucaggcaagguaacaucagaaagaacaaaauauacagaguaacuugggcaacuagaccacuucucauucccucuguaucuaucacaaaaaugcccucucauuacgugcacguugaucacuuaaagaaguaacuaggaaacugggcgaaauguaacuuaagaguuccaaagugccauauuacaaggccuauucggcucagaaucaggccaauucuuguacuauauaaauaacuccaaggugggacauuuaaacaacaacaacaaaaaaacaguuuugggugcgagcaguuuuuaauggaagcaagugaucgcgacaggauggcucuguagauggcagcuggcggcuugggguucacuuacaggcacuaacuuccaauaccacuuggagggagacugcucaggaagcgagagaaggaaggcaggagaggagcaucagcagagcagguccacguguggacgagguaacacacacuuccccacggcguuuacacggcagaggcgggagagccucugguaagcaaagucuucuaaguguacguggccauagucauguuguauuagcagaugauuaaaguggaagaucacgagucaccuccacaacacuauucuuugcaguagcaaagaaaacuucggaaacuugguaugggcuggguaccaaaaggcaagaagucagcucugacgcgggaagggucuagugcuuagucuguacccauguguuaaacaugaccaucugaggaacagggaggaagcucaaugcuuaagauccagaugagggaggcauaccaggcggccugacucacccacccacccagcuaacaaaugcauggccaggggcuggugccacuggagggggaagaaggaacaggggaaggcagcacacugcccuucaaaggcgagaccuuauagauggucgggcugcaucuugugugcacugaacugagugaauucagucacacaugugcuugcaaaagagaaaauaacgucagaggaagaaaaaggcuaauggcuggaaggugcagcccagccaucgugcuacuucaguaggcacguaggguucauccagcagaaucauggcacaggcacacagguacaccaccagcuacgcuguaccucaugagccacuuaaggacuuuucgagggcaucuuuagcaacaggcaauuucccccuuguuuguugacuuguggaagcuagcacccaggugggcccuacgucccucacucaagcuucccaauucccccaaauacccucacgcaccauaaagugcaauacaaaacaccccuucccaggagaggcggggcaggcugccguggucacaucucacugagguguggagaaucagcccaccaggugaauccaagagacuagcugcuucuuuggugaguaaaaauagagaauaagcaaauagugggaacuaacagaauucuuuaaaauugggaccaacauuaacuuagugcauuccagaaaaauuaaauuuacccuuuaccuuuugaugagcuggacuuuccaauaacuguuguuuuaauuuaacuucuuucucuguuaucucucucauuuuaagauuuaccuaaaguagaagagaaaugcauuaaagagguaauugcugucccgcacaauuguaucuccacaauuaucccccagagacccccacuucaccugauucaccucugacuccuagacauagguauuguuuaggccaauuacacagauacagaaguacacggauuccacaugauccacaacaagguccgccugcuaccaccaggaaaccaccugcccccgacccccaccccaaugccagcgcagugcucccccgucacugcggggcagagucacuacaucuuggcaguggucacucaccacacaaguacugucaaacagcuaagcuucuccaacaccaacagcaaaugccacuuacaaaacaaucugguggagacaccucacuaaagagccuaacuugugacaggaugggucacacaucccagaccaugcaaaaaucauaccaaaccaaaucuaauuauaaaaguuuaacuauacaccccuuaaaaauuaauucaacuucuuagaaauuuaaguauucucuccuguaauuacuaacucaauaucaaaauugcaaucauaaaguauggagaaaaacacucagcagugcuuaaaggggcuagguaaaagccaugaucagacaaaaagacacagagcugaaugcuucgucaucaaacaacacagacaaaggaguccaccaugcacaucaaaucaggaguacgaaaaacuguuuuuaaaaauaaagacaaaaaaaauauagauaauguaaaauucaaucaaugagaaaguagaagaaaggauauuuaaauccacaaccaaguuuuguaugcaugauuaaaagaguccuuugcaaaggacgaguguggcagcucacacguaucaucccagccacuuggaaggcugaggcacgaagaucacuugaguccaaaaaccgcacgccagccuaggcaacacagcaagaccccccucuuuuuuuuuuuuaaaaaaaaagucuguaaagcuaaucaagaaaaugaaugaaaauaccaauacauaacaugaaacagucauauuuuuggaggaaagucgaagccacuaaaaaagcaccacguaaaaacacauccuucuuaaaauguaaauuaauuugaaauuuuuaaugaaacuaacauuuuaaaggaaaauauaaauuaccaaaaaaucaagaagacuaaacagaguaaaucaaacauuugcuuguaacucugaucccugugaaaauaauacagaaaagauaauuuaaaagcugaaaauccacaggacaaacaaggcaagaggggaacccuguaagcaagggaaaccuacacagagcagagccagugcagccccagugcuggagaagagaugccaggcaggggcccugcaaacaaccccaagacgccucccauccucagaccagagacaaggcugcagacaagacaacgguugaaagucagugucuuaaaaaguuggagcaagaacccagucccaccucaucccacaaaguaaccccagcagcauaacagaauggagccauauuuucaccugaaagaaaauucagucaaccuaaaauuuuauauccagccguauauuuggaaaaugaaagcaaaaugucuuuuucagaaaaaaaaacaaaaaagcugagagaauucaguagaacugcuuguaaaaaaaaaaaaugcuaaaagaaguuuuuuaggcugaaggaaacgauacagauggaaaauauuuuauuaaaucucuaccuuauaguacaacuucuuuuguauuccaugaccacauggucagcaggcacaaagcaccucuccugugguccaaaugacaucagugaccucgggacaugcaccugugcaccugacugaguuacaagcugagccauuaacaaaccaguuauucacauuugcaaacauguuaagacaucaucucaaaaccaaagaaguguuuuuuguuuuuuuuuaaaugaaugucugucacuaaaagaaaacuacuuuuuuccaguaauaaaauuugaauuucagaaaaaauuuaaauuuuggaaaacuuguuucugccaccaaaagcuagauaacuuccuaacauguaaaggcuuuucugaugagauuggcaauuuuuuuuuuuuuuuuuuuuuuuuuugagauggugucuugcucugucgcccaggcugaagugcgguggcaugaucucggcucacugcaagcuccgccucccaugucucgccauucuccugcgucagccuccugaauaguugggacuacaggcgcccaccaccacgccuggcuaauuuuuuguguuuuuagcagagacaggauuucaccguguuagccaggaugaucucgauauccugaccucgugauccaccugccucagccucccaaagugcugggauuacaggugugagccaccacgcccagccaagauuggcaauaucaaugaauguaaguuuugauacugugucaugaaaugugacaacauuuggaagaucuacauaacucagugaaacaauuuuccgaaugaccaaagcaugaagcugcaaaacccuggguggguaaaagguccaggaagaaugcaagaacuagaaaugguuacuauauaguaauaacagaguauaaaaacucacugaucuaguacccagaaucuauaaaagaacaauacaaccauaaaaagacaauccaauuuuuaaauaggcaaaggguaugaauuccuccaaagaagauauacagucaggcacgguggcucacaccuguaaucccagcacuuugggaggcugaagcagauggagcucuugagcucaggaguucaagaccagccugggcaacaugacgaaacccugucucuacaaaaaauacaaaaauuagucaggugugguggcucacaccuguaauccuagcuacuugagaggcugaggcaggagaaucacuugaacccaggaggcagagguugcagugagccacgaccgcaccacugcacucccgcuugggcaaaagggcgagacucagucucaaacaaaaaaaaaaaaaaacagccagaaaauaacaaauguuagcaaggauggggaaaacuagaacccucagaugcagccagugggaaugcaaaauggcacagcugcuguggaagacagucuggaaguuccucaaaaagcuaaacacagaaugaauacaugacccagcaauuccaccccagguacauacccaagaaaaaugaaaacauguauucacacaggaaacuugugcaugaaaucagcauuauucacaauagucaagaugcagaaacaccacaaaugcccaucaacugauaaaugaauaaacaaaacgaggcguaagcacacaguggaauauuauucaggcauaaaaaggaaugaaacgcugacacccgcuacaacacagaagaacccuggaaacaugcucugugaaagaugccaggcacggaagaucacauacuguaugauaccauucauaaaaacuguccagacugagcaaacccauggauacagaguagacugcuaguugccaggggcugaggagagaaugacgucuggcugcuaauagguucagaguuuuuuuggaaugauaaaaauguucuggaauuagccagugaugaugacuauaaagcugauaugguuuggcucuguguccccacccaaaucuuaucucaaacucuaauccccauaauucccacauguugagggagggacgaggugggaggugacuggaucaugggaagguuuucuccaugcuguucuugugauagugagugggcucucacaagaugugaugguuuuauaaggcaguuuuccccacucuugcuugcucucucacgccugccuccauguaagacgugccucuuccccuuccgccaugauuguaaguuucccaaggccaccccagccauguggaacugagucaauuaaaccucuuuucuuuauaaauuacccagucuuggacaguucuuuaggcagugugaaaacagauuaauacaacacccuuaugaauauauuaaaaacuacugacuaggccaggcacaguggcucacaccuguaaucccagcacuuugggagcccgaggcagauggaucacuugaaggcgaggauaucaaggcaagccuggccaacauggcaaaaccuuaucucuacaaaaaauaaaaaaauuacccaggcacaguaccacacaccuguaaucccaguuacuugggaggcuaaggcagaagaaucccuuaaacccaggaggcagagguggcagugagccaagaucacaccauggcacuccagccuaggugacagagccagagucucucucuccaaaaaauaaaaauaaaaaaauuuaaaaauccacugacuaguacauuuuaacaauagugaaguuuauggcauguaaauuauaucucaauuucuuaaaaacauuaauugaugauaguuucaaauuccacauaauuaaucuuugagaaacuauuguuugucaaauuuugguguaauagcaaaaacagauuugcauacuucucagaaaagacugugaaaauacuauccccucuuccaauuauauaucuacaugaagccagauuuuguucaugaacuucaauaacaacaacauauugugacagauuaaaugcaaaaguagauaggagaaucagcuauccucuagcaagccagauaguaagacacuugcaaaauuguaaaauaacugccaucuuccuuauuuauuucuuuauuuugagauggggucucacccugucacccaggcugaagugcaguggcauaaucacggcucauugcagccucaaucucccaggcucaagcaauccuccugcuucggucucccaaguagcugggacuacaaguacacaccaccaugcuuggcuaauuuuuaauaauuuuuguagauggggucucacuauguugucggggauggucuugaacucccuggcucaagaaauccucccaccucagccuaccaaagugcugagauuccagaugugagccacacacagccccuucuaauuuguuuugaaaaauagucauuuuucacuaaaacauuguuaguauuaacaugaaaucaacuuacuguuauuuuuaaauaaauauuuuuaaacuuucugauuuuuaacuucuaguauggcaaacauugauagauuaaaauuuucuuuacaaguucagcaggacacacuggcucacaccuguaaucccagcacauugggagaccaaggcaggaagcucgcuugaggucagguguuugagaacagccugggcaacacagcaaggccccagcucuaucaaaaaaaaaaaagguaaguuaucugagguccacagcaauuuauaaagagguccuggccaggcgugguggcucacgccuguaaucccagcacuuuaggaggccgaggugggcagaucaccugaggucgggaauucgagaccagccuaagcaacauggagaaaccccaucucuacuaaaaauauaaaauuagccgggcauaguggcaggcgccuguaaucccagauacucgggaggcuggcaggagaaucaccugaacccaggagagggaggcugcagugaaccgagaucacgccauugcacuccaaccuggguaacaagagcgaaacucccaucucaaaaaaaaaacggaagagauccugagaccaaacugugugaaacucuugauguaugcaaaggaauuaagaacaacaaaaauggaaauuauguggauaaauauuaaugacuuuuguucucaauuuuuaaauacuuuaaaagauaaaagaaagccaaaacagcacagcugggguagaaugaaugacaacacaaaggucagcgaggaaaagaugcaucuucugcuauuugugcaauggcaucacuuugacuugcaggcagccugugacggucuaaagaugcacacaggaacccuaaagcaaccccgacaaaauacaggaggauaaaagggaguacuuaaaaaaaaauccaaaauaacccuuaaaagagggaagaaaaagaaaagagauaaacagaaacagaccagaugguaaaaccaagccuuauggauaaucacauuaaaugcaauugguuuaaacacucuaagagauugucagaugaauaaaaaagcaagagcaacuacacagcaucugcaaaaaauucacuuuaaagagaaagacaacaagagguuaaaaguuaaaggaaugaaacauacaccgugcagccacuauucacaagcacucuugaauccacauccacauuaaaugaaguagacuucugggacaaggauuaccaccagugaugaaaagcaacaucucauaaugacaaaaggguuaauucaucaacuaauaucgaaaacuugaauauguguaaacguaacagacuuugaaaauacacaaaguaaaaacugacagaaccaaauggcggguuacaagugcacagcucaggaccuuccacccuccucucagauuaaccuaguaauaggacuaaagacaggaaaacgguaaaggagacacaaacaccaccaacaaccaaucugaacugacacugaagacacucuaccuucaaacagcagaauauucuuuucaaaugcauauuaaacauucugcaagguaaggcaugucacggacccuaagucccaauaaacuuaaaaggaugaaaaucacagaguauguucccugacaacagaauuaaaccagaaaccacaacacaaaaagcuaucuagaaccucucuuuaaguaucugaaaauuaaacaucugacuucuagauaacccagugagaaaacaagaauccacaggggaaacaaaauauuuuaaagagaaugaugaaagacauggccuauaaaaauauauaaugcacggcugaagugccgcuuagagaggaaucgacagcuuuaaauaccugccuucaaaaugaaaaaagacuucaauaacuaacuccccccuuaaaaaacuagacaaggagaacaaauuaaacccaaaauacaaaauaauaauaaagguaaaaggaaauuaaguauuaaauagagaaaauaaaaacuaaaagauuuuuuagaagauuaaugaaguugauaaaucggacuaaucaagguaaagaaaaaugaaagaaauugccaaccucaggaaacaaacaggacacugucacuacagaucgcagguauauuaaaaggaaaauaaagaaauauaaaccuuaugccaauaaauucaacuacuuaaauaaaacugacaaaucccuugaaagucacaaauuaccaaagcuagcacaaugcuaaauagaaaaucuauuaucauauguauauuaaagaaauuaaauucauaauuaaaaucgucuaagaaaacuccacucccagauugcuuuaccagugaauuuaauauuuaauuuccuuuuaccuuaauacuucccaacucacuuuuuuagcccaacauuaccccaacaccaaaacaagagaaauacaucaugagaaaaaaaacuagagaccaguaucugccgagagcauugacacaaaaaucaucaacaauauauuagcaaaucgaauccgucaauauauaaaauaaauaauaaacacaaccaauuuguguuuguccuggggaugaaagggcugguucaacaucugaaaaucaauuacuguaauucauuguaucaacagacuaaaaaugaaaagucauauaaucaucucaauaaauacagaaaaggcaucugacaaaauucaauauguauucaugaaaaaaauacccuaagcaaacuuaaaauagaagggaacuccuggccaggcgucggaggccaaggcaggcggauccuuugagcucaggaguucaagaucagccugggcaacguggcaaaauccccucuacaaaaauuuuuuuuuaauuagccaggcguggugcugugugcuguagucccagcuauucagcaggcugaggcagaaggauugcuugagcccaggagaaugaggcuacaaugagcuaugaucguaccaccuguacuccagccugggacacagggugagacccugucucaaaaaaggggggggggggccacaggggccgggaacuccuaauaaagggcaucuaugaaaaaaaaauuacaaccaacauucaucauuucaaugguuaauacaguaaauguuuauucccuaagaugaaauacaagcaaaaaugucuucuuucaccaauucuauucaauauucuaucugagguacuaaacaguacaguaaggcaaaaaaaaaaccuuuauaauuaaaaaagagcauacauauuaaauaguaauacaaaugacuuuauacacagacaacaugaucuuguauguagaaaaucuuaaggaauuuucucaaugccacuagaauaaauaaguuuagcaaggucacaaaauauaaaguuaauauacaaauuauuaauuacguuucuacggacuaguaacaaacaacuggaaaaugaaauuaggagaacaccauuuauaauagaauccaaaacacaaaagauacagaauaaaguuaaacuauauacaaaauguuacccugaaaaaccauaaaacauggcugagagaagcugugaagcuguuaggucuacacagaacggagagagauaagcaugucugugggcuggaauaugcaauacuaauaacacaucaauucucccgaaauucaucuagcuucaaugcauucccaaucaaaaucccagcaaguauucuuauagaagcugacaagcugacucuaaaauuaaggguaggcaugcaaaggaccuagaauagugaaaacaauuuuuuuuuuuuuuugacacggaguuuuacucuugucgcccaggcuggagugcaguggcaugaucucagcucacugcaaccucugcuucccagguucaagcaauucuccugucucagccucccaagcagcugggauuacaggcaugugccaccaugccuggcuaguuuuuuguauuuuaaguagagaugagguuucaccauguuaggcaggcuggucucgaacuccugaccucaagugacccacccgccucagccucccaaagugcugagauuacaggcaugagccaccacgcccagccaaaaacaauuauuuuuuaacacaaaggauauggcuggaagacuuaacauuguccaauuucaaguauuccuauaaaccagacacaaagaucgguggaaccgaauagaauccagaaacagacucacauauaugugguuuacugauugucaacaaagaugucaaaguaauucaauaaggaaaggaaaaucucuuccauaaaugguuucagaacugcuaucuauaugaagaaaaaaaugaaccucaacccuucccucauaucauucauaaaaaugaacucaaagugggucacagaggcaaauguaagagcuaaaacaaaaaaacgucuagaagaaaacauaggagaaacuccucacaaccuuggaguaaguaaagaugucuucuauaagacacaaaaggacaaaccauaaaaggaaauacugauaaauugggcuacaaagaaaacuuuaaaagccuuugcuuguuuuuugaaacagucuugcucugucacccagacuagagugcaguggcaugaucucagcucacugcaaccuccaccucccugguucaagugauucuccugccucagccuccugaguagcugggauuacaggcgcccgccaucacgccuaauuuuuguauuuucaguagagacacgguuucaccacuuuuggccaagcuggucuugaacuccugaccucaggcaaucugcccaccucggccucccaaagugcugugauuacaggugugagccaccacacccagccaaccuuugcuuuuugacagacacuguuaagaaaacaaaaagguggccggccugggagaagaucuucaugauacauacaucugacaaggcccuugauucccaaauacauacauuucuaaaaacucuugcaacuugguaagacaacccaguuaaaaauucggcaaaauauuugaagcagcaccucauaaaagaauguagacaagcaucuuuacccauuaggaaaacauuaaaacgacaaugagcgacaguuacacauccacucaaauggcuaaagagaaaagacggacuguaacaaguguagagcaaccggaauccuaucuugcuagcgggaguucuaaaugguacaaucacuggaaaacauuuuggcaguuuauucuaaugacugaacuuacacauacuuguauuaaguuauauauacuuaucacaugacccagagauucuacuccuaaauuuuuacuuaaagaaauaaaaauauugcugggcacaguagcugacaccuguaaucccagcacuuugggaggcugagauggguggaucaucugaggucaggaguucaagacuagccuggccaacaugaugaaaccccgucccuacuaaaaauacaaaaauuagccaggugugguggcaggcgccuguaaucucagcuacuugggaggcugaggcaagagaaucgcuugaacccaggaggcuaagguugcagugagccgagaccuugccacuacccucuagccuggguggcagagugagacuacaucuaaaaaaagaaagaaauaaaaauauaucugcacacaaaugucccuaguagcuuuauucaaaacaggcaaaaacuggaaacaacccaaguguccaucaacagguggacagauaaacgaaccaugguauaugcacacgauggaacucuaccaagcaccgacagaacuucugacagaugcaaugccacaggucaaucucagaaacacuuuguucacugaaagaagccaaacacaagaagagcacacaccgcacaacuucacuuuuaucaaaaccuaaaaaaaaaagcaaaacuaauccaccgugaagauggcagaugaguaguuaccugcauugggguagaggauuaacugcaaagcaccaugaaagagcuuguuuagggugauggaaacauuaccuugauuguggugaaugcuaaacaaaugacugcuuaucaaaacucaaggaaaaagauccacugacuucauauaaaauacaucucaguagagcugucuuaaaaaaaaaaaaaaaaagaaaaaaacaggccaggagugguggcucacaucuguaauccuaccauuuugggaggccaaggcaggagaauugcuugagcccaguaauucaaaacuagccugggcaguauaguaagaccccaucucuaauuaaaaaaaauuuuuuuuaaucagccaggcacgguggugcaugccuguagucccagcuacucaggaggcuggggagggauaauugcuugagccugggaggucaggcugcagugagccgcaaugacacaacugcacuccagccugggccacaaaacgagacucugucuccaaaaaaacaaaaagagagaaagagacaacaacaacaacuggcugggcaucaauaaaaaauaaaaagagccccugcaaggugauucauggugaaacuucagagcacccgggaaggaggaaaaccugagugaggucaucugggucacauacaggaugggaaacccgcauggcagcagauuccucagccuggaagagagaagacagcugggcaacccccucaagcuggggaaagcgcuuccaucuaguuacacaaucaccagggaaagguggaggaaggccccuucagaagcugucucagaaauggucccggaaaugcacagcauuagccuuuccucagacggcagggaggcuccugcacccagguagggaccccggccaggaggagacgggugagcggccuggagcagaggugaagggagggaaaguccaggauggcagacaugcagguggcuggggcagcaaccaugcaggcaggggcaggacagagucccagagggaugccacagaggaggagagacucagaacauggccauucccccacagaugcugcagaggacgacacagagccaaacccaaggagggauuacccaggugugggugugagaagcugaaaucugcacucaaaugcaccugcgcacagcaggcaucuuggaaacaugguaucuaugcccaaagggaauucagaccuuaugcaucaaagaauugaugcuggagaaaaaacucacccuuauggaaaucguaccaacagccccaagcuuauuaaacaugcagcaauuuccaauggggagaaaccccaccuguagagugaaagcuuuggggcacagcucgaagccagugaagcaucugagaacccacaccggagagggccuaggaacacagcgcgggugagagaguuugcucggggaacucgcacuuccuacacacccgggcauucacacugcaaaaggugcuuuggaagcauucagccgguaucgcauccugcagugaggacucgcacccgggagaaagucacauaaggagaaaccacuaacguaaggaacuuaaauucauauggaaauggcaagaaaacaguaaaauauggaaaacacugaauacaaauguaaauaaugcaugagaaaaaagaaaaggucaugaaaacuaaaccaaguauuaacuccaggaaaaacaaagcauaauacaaggaaaggaacaugaguugugaaaaugggcgccugaccacaggaacaucaagucugacugugaacguguccaaagcugucaaugcaaccgcaggggaaugaggaggaggggaguggagggccauggaaacuguaaucacuguaauugccauuugucacaauccuaccucaguagaucauguccacaaaugaggagucaggagccggaaauacaauguauuucuuuaaaauacagagguagaaacgagaauagcauggaaggaaaaugaugucucugguuacaaggagaccaccuucuauuuaucugccaaguccacagaaacacagaggccagcaacagccugaaaagucacuuacaaaugcacagcaaaugagaaacgugaccaagcaggggaaaaagaaacauacccucuugcccaaaaaaauacgggcaaagauaacaaacaagugauucaccagagaaggagaguaagggacagaugcucuuacccagaaucugcaauuuuacccagaauuaaguuuuucuaugucuuuaccauagaaaaagacacuauuuuucaccuuucaaaugggcaaguaauuuuuaauaaugcccaagauaugggaagacaugggaaaagacaccuacacaaacuaauagaaaggaaaauguuacaaucuuuagguucagauuuggccaaaaaaaaacaagcaaacaaaaaacaaaguccuuaaauaugaacaaccauuccccucgcaggaacguggccugagggaaaucaucguggcuggacggagacuacugcacagauggagaggagacaacuugaccuccagcaacacugagaucacagaagggccacaggggagucacuggaacggcugaaaucagauaucuggccaaugagcagaaacucacugcacaguaccguaccaagcagaaacguggcuuacgacagaaagcacaguaggcuccccacuguguuguaggccuauauaacacauacaaaucaagaaaaacuaucagaauuuuuaccaaaauguuaaccauuuucauaggugauaagauuacggguaauuuacauuuuauucuuuuuguucauccauaguuucuacauuuucuauaacuaugucauuucuaauacgaggaaaaaucaauaaaagauauuaaagaaaagcuaaaauuugacuuuugaucacaggaagcuuccacuagcauuacaggagcguccccgaagcucaggcuccucuggaaaugugaacuaggccugaacaccauuuuccacagaauucuugcaagcacuucccacaugcacgccgccaggugagagccagggaugagugagacauggcgcucaccaccaagaggcguccucauggguagaggcagaguggggcagagaugcuacuggcugacacccaaaucugaacuagggcccggaggcuccacugaguccuagaaaacccuguggcuuucugucccuaccucaccgcaggauaaggaaauguaaggagucugcccauccaccugguucaccaaccccaagcuuggguaggaaaacagcucaagagcagggcaacugucuuagaaaaagucgaaacacaaacgucugccaacuccugacaaagacccgccuuucacagcgacggaggggucuuccagggagccagcagauggagcaccggccuggcucugcaugugcaagcuaacuaucaguaacuccagaaccauccugcgugagccucuuauucaggcgcgcuaauacagccucacauggggccacacaaccuucuaguuccuuugcuguguuaaugcgcaaacuuaaacaccuuuuugcauaucaggaugcuuacuaaccaaaggcuccgguaagguaaccuuauaaaucauuagacacuacuaaaaguaaacauucuuuacauauauuguauuuaaaauuacacuaugagcuucuaaauguaaaaggagaaaacagcauuugggaaaaugccauuuuuuuuccuuaauaaucaaaaugcuucugaaggcauuuugauaaacuccuuuauugcauauaggugcauacuaugaaaauaaaaagaaauuauucacuggccaggugugguggcucauuccuguaaucccagcacuucaggaggucaaggagggaggacuguuugggcccaggaguucgagaccagccugggcaacacagugagacucccucucuacuaaaaauuaaaaaaaauaaaaaaauuaauuagccaagcauaguagcacgugccugugaucccagcuacucaggaggcugaggcaggaggaucacuuggagccugggaggucaaggcugcaguaagccaugaucgugccacuguacuccagccugggggacaaagugagacccugucucaaaaaaaaaaaaaaaauuuaaaggcacucaaaguaccgacaugugcugcauuuucagauauaaauucaucacccucuacucucggccugcgggagaaacaccugcuugcuuugcuucuuuuuaacuacagcagacacauuucuggacacaaaauaugacuggucccaaaugaagggcugggucucagcgugacagacaaggugugcugcucucaagugaaaaggagaccggccacagaagcagagucacacaccacaucuaggcagggcacucaccuuguugauccagaacaccauggcauccucgaggucguacggaaguucuuucgaggcacugaacguugagaagcgcuugacacuggccaccaccuucucgaugcugaucaucuccacaguguaggccaucaucagggcauccaccauugccaugugggcacucuaggggcagaggcagcagcuauaaucccucaaacccaccccucuuaccagguucugaugcagggaaccugcucauacucagcauucuggccuaauuucuucaucccucgcccuuuccgucugaagagauacucagauuugagaccugccucccccgcaccaucacuguuccaagccuggcauuucuggucaagccucaagaccgucuggaaccaggaguccguucucaggcaggcaggccagcccuguggcccacagugcacugucucacacuguccuuucuuaucuccucaacagcccugugggacucccaggaaaggcggugcagcucccaggucgugguugugggaaggcagacaggagaccugccccaggccaacugcccaccagaggccucuggcuccuaguccagagcucuaccugcuacagcugcaccacgccuuagugcagcuuccucauucgacaggaaugacacucucuucaaccaccgcacggcacccgcagucucaccgggaacgccaugggagcaaccaaacaaaggcagugcaggaggcaccgagaauggcccugacccagaacgcucuggaaaaggcacaccaguagcaaggcuucagagaaagaugggggugggauacuugggggagaaaaaggcagacugaguuauuuuagcacaaaguaugcaugaaacaaccuaacagaaugggugcaacaauuacauuucucaucuguaaaaagucugcuucaaguauuuuuauuaacaggccucacuccaaucucagcauucacagagcauucccaaugagaaaaagagcucaaugaaagcucucuuuuccccauucuccacaacagucaugugcuuuaaaagauaugcaguuuccuaaggaacgccagugugcaaaagcacgggucuccaccaccucgccgcacaccguguucacaccauccaugcaccaggugcgccacacgagagcccacggcuccagaggauggccccugggggcggccaccgcagaccacucaccauuuuuaugggugcgcgacugaggucggacucugucacgggggugucaucacucuccaucacauagaucccuuuccgggacagggccuggaugacagacuggugucccuguaaggcggccaccugguccccuuucaggaugaggcugcagacacggcaguacagcucgcuggacaggagaagcuugauaacaggcggcuuaaugugcuccugcucauacuggucaacguagaaagggucucugagguccucagggauguuaucuaagacagggaggggaugaccaggugagugccacacacaagacccaaaggaaggaguucaaggcugcagugaacuaugacugugccacuguacuccagccugggcaacacagggagaccaagugucaaaaaaaauaauugauugauugauuaaaugagcaacuaacaacgugaaaaggcucuaggcuuuucaauaauucuacugucuucuguacuuacaaaggcaacuaacuguagcaucucagacuacucugugaacacagacaacugaaaucauuucgugaccuccaccgugaccucaaaggaugacuguccuaacuuaacagcaguaagaagguagacaugggagcccugaguguguuaauggggcugaggggaaaccagcacaggcuaggaccauguagugccuggggacaccagcggagacagcaugugggcagggcuggcaucagcccggggagggagcccagcauccucuuucugacaugaaaaucagaagugauaacagagggugaacacccauggucuuuacagaagagggagccaggcaggcguggugccacuguaaccaugacgacacagcagcagcagcagcaaucagccuuuauccauuuuuggaccaggcagcaucaaacucuugacaugaaccacgcuacuuaaucuugccacugcaguucccucaaaugaggacuaccaucugcacauuacaaaugagaaauugaggcacagagaaaguaagugcucaaggccacaggaggcagagaccagccugaacccacacaaucugauccagagagccuacuguauacuuccggcugcaacauacgccgccucccacacaaacagcgcaggagcagcauacacacgggacaccgaaugugucacagcuggccucacccacuuuucuagccuugccacuaugccccucacacugucucacaagacaucaacggcugucccacuaaagacggaggacgagggaugucugcagucagacacauuucggaaacacgugacccccaggucuuuaaugugccccgcgcccaacacucugcuaggaggugcagauacucccaccuccacagaguuuagaaaggacuaccaccuccacagaacagcucaugaagaaaccccacugacuccuagcguucagacaaccaguaacacuagagacauucauggggacacuaacaaaccugucuuguguuccgagccaagcucuccuaagcucuuccccaggggaagaaccagcuguggcgaugguuccccacagcaccccucucucucugcugccaucucuucuggcuuccuucacuauuuuccugagcccugagucacuucauuauggucccauggagucuggucauuuccccacaaucugagcaccucauagcugguuuacuucuaaacggcagcagucaccguuuacacagcauuuuuguuuuaagcaugguuguacacaaugauuaggucaucacggcaacccaagggcagccagggcuccagcuauggaaggcuggcuuaguggauguuaacagacucaaauccuauacuugcugaccacaucgaguagcccccuaaucugaaaucauuggaacuuuugaaauacaacagagcacagcaguaacacaaggaacaggccccaaugccaagcacaacgggaagacuucugcuguccuuacaaacugcucaaggaaagcugaccugcagaggugagcacagagccaccccgcacacgccggagugagacgucccaggaaacaagagcaagguggccagggacaaacaggcggccugugggcccauguuuguccaaguucccuccacccaugggccguggagggaagucaggggagggcacugagcaagggaucccauaaccugaaaacguuugcagcaguucacaccggcugcggggaaagaugcgacagucacucucagccuuccucuuauucaacugaccacaccagcagcccaccuagucagggcucuuggagggagcugccuuucuccuuucgggguaccuggccucuuccucccaucucgcugccugcuccauccccaucuccuaggccagcugccccucacuucuccaaauauuggaaggggcacuuccuaucucacuccucccuaaugaccuaauucagucucauggcuagaaauaccacagacacacagucauccccaaauguacauuucuggcccugaucacuucccugaacugccuaucugacaucuccauguagaugucugggggcaccucgagccuaaccggccugguccaagccacccucuccucccacuuagacaacugugaugcagucccccuaggagagcagaaacuggcacagcugaggagaaaggccccaggggaccccucagagugauggcucugugcagagugggagacgggacaggcacguaaguggagggcuggcauuagauggaagcagggugagccccagggagaauggcagagccuaccucacagaugcagaaaccuggccagacaggaaaaagcaaccauggcucugauuuaaguuucucuuuuacaaucuaccaaguagaaacguuugccauagggugacccacuuuuaaaauuaaucaauauaaagugauucauauaaucaccuuuuugaaucauauaugaauaugcauaacacaacuaauucacauaaauuucagaugcaggaaaaugagaguuaaaggaaaaugacgcacuuacuaaagauacaagcuucagacuguggugaagcccuccuaacuguauguuacuccuuuccauccggccuaaggaagacccuggccagacccccaacugggugacaguggccacacuccuccauggcccugcuguggcaguucugcccucagacacugcacuuguccaugaguaacuggcuucagugaaagcaacuacugcgagagcuggaugugcacaguucuagaacguuuaacguucuaucaaaaucaauaccuacuuaaaaaaaaaaaaaaacuuugugaugccuucaauguauuucuaauaguuucuuguuguuuuuucuacaaaccaguaagacuguuagaauuaauacacauucauucgacaauuauuaaguacccaugugagccagaaaauguacaaaaaugccagggagucaaacaggaagagauaaagucacuguucucaggcugagccucguaagacaacugaaaagucaacagguaauuuccacgcaauguggagggugucacacaggaugagugcugggggacuggggugcaggagacaccagucccgcacugaggaguggggcaguggggcagugggaugugcagguggagaaguuucuuagggaaggaagcagccaguagggggguggguaggagcgagaggaaaacaugaaaaugacccuguuaagagaauuucagcaagugacagcaguucagaauugcgcggaagaggcaaacuggauguuucauucauuagcucaccaggcucuugugcgugccugcgcugggaggaccugggcccugcgggaucugucagcagagcgagacaggcuuaggcgggcacacaaggaaugcaaugagaccacaucaaguaagggggucagacaagccagaggacgaggagaucccaucugcuggagcuccccguaaacaagaguggagaaugagcguggacccaggaggcugcuguggucaccgccaggagagacaauggaggcugacacaggcaggcagccccgggaaggggaaccacugcccaggaggcgugagcagcaggccugugccugaugcaguacgacaaaaacaccaaacuuauaauuccugccagccuggagcaggacggucccuuuuccuaagacaggaaaccaguaguguggaggaggagggcagucggggacaggagagaugagccugugggacccaaggggagcuuugcaauggagagguguagagacuggaagcgcaagaguaaagggaccagcuggagacgugcuuuggaacccauuacauauacacagccaucgaugcccagggggacgagucauccagugagagccgggcgcagugggagaagcuggucaaggcaaccugaggacaccaagcccacgggacagaugucgggagagaagccaaagaaacggacaagugaacagagaacggggcggggccagaacauggugcugccaaggccagaggagguuuugaaggggcagugugcaccaaggaaggcugagaaggaugcaugcaugaagaccacagagcccgccggacucagcuggcagccucgggaagagcauucugagaacuggugaagagacagccgcaggcacagaaggaaggaagugagaacagcgggaacugugccucugcucugaggggaaaguguggccaaaaaagaugugucugcuuuaaggauuggagaaacggugacgaaagaaaacccaaucaaugggagaggcugaagaggaggaggcugcuccugagaaaggaggccccucgggaggcggaggggagggaugcagggcccagguagggcagugucuuucacugggucaggguacagacgcagggaaggggugggcggcccaucagcaccugcaguuugucuuacuauguuaagcaggaggcagggcaucugcugagugggagggcccagccuggaggaaguggggagaagugcggcuacagggggcagagugaaagucaaacaaggacacgggcagggcaggggcccauggagacuggagacaagagucggcaacggcacugucaggguggcagcacugucacuccucggacugcuacgucaguacccaugagcaacgcauucgcaguggcugcuggacugcuguggggcaggccucggcgggagccacacagaaaggcccugggaaggggucagaagacucuaaccagucugcaguggaagugaggucaacacuaagugcaggaggaacucagagggguggcaacugacggagagcaggaguuggagcgcuggggucucccaagggcagggcccagcacagccaccuggcccagagucccagcuuggccucuuacuggaucccucugaacccuggcccccuaccuguccguuccgaacaacgaaagggucuaucuccugcccugcgccagcugagcauaagcucuguggaugcacacgggagucucagcuguuauuccuuccgucgcuauuacugcaaugaggaugaaaaggcaggucaggaaguggccaucugucgacugcagcccucccgcggcaccugcacggggcucgggaggagguguccacaccaaccgccagcucuuccacggcagcacacggcaaagaccccucuggcaggugcuacaacuguggccacugcccaaccuaaagccagcuacucccguagccuccaacucagccccaggaaaaaagaccaggccacugcagugccaggcacagcccagagacgugcaggacagugagucucugcucuguugcuugucugagccaccugggagcugagaccagcucucccagaauguccccgugggcggccuggcuaucugcauuugacacugagaaagucaccucugcagaggccccaaaggugagugucuccaccuggaaaacguggauacucuuccuguuuggauauaaggagucaacggaaauaauuccaacucaagguaaaagcgaccaguaguccacgccccagcuccauccuggagaggccagacacaaggguaagaaaagcugauguaaugguccccacagggccaagaccaccugacccccacccagggacaaccaguaacaaacugcaccuugacagcggagcgccaggugcacagacaagcacacaccccacagggcgcuggcccgggcaugccacaccaggcucaggugcagacuuggcuuccagccagaaggccagcaagggagacccucgggaacccucagagaggggagaggaucccagagaagagggggcuggauagggagacccucuaaaucugugucacauccuggccacuccugaagcaacuacaguggcacagcagccacucugagggccacagcccacagcccagccagagcggcaggacgaagaccgaaaaugaaaccuacgcucaacuguauguagcccccaggagcaggucagggccugcagucucgacguaacuggguggacuaccugcuagaacaaaccaaaaccaacaccucaggccuccaacaggacccacggccuccaaauacaauauugcaaaugcccaacacacaacccaaagcuccuuaacaaaaaagaaagacccacaggaaaaccugcaacuuccaggagaaaaggcaaugucccaagguugggacugucugacaaggaauucaaagugaccauggaacaaugcuccaagaagcacaggcagaagcccgaacgaaacaaaaacucucacagaaacucagagaacucccagcaaagagaagccccaguguggagaaaagaccaagcccggagcagaggccacgugcuggugaggagaggcuggaggggcugcagagccugccugcuagcagcugcccugggccaucucaugagcgcagugacagagaccucacugggccaggaggcagacacuaaggggcaacccucauagccccuccuccuccuuccccugagcucuucugagaggccgugggagcgcaugggaugguuagaguggagcacaaacucuaaggccagaggcucugcaccugaggcccggccggccacccucauucacaccucagaaacccagcaggaaaggugcuggcaccagguccucuccccguaagcucccacccguagcucgcuccccugagcucacgaagaaaucucgaggcccccaagggccacaaccacugcaaccgaaacacaaacugcacagccugagccuggaaaggaggcauggagcaaaggugggcaaaggagcaugggaggccccucggggugggaugggagggagccuccuuccaggcacgguggacccugugcuaggccaguaagcccccguggcagacacaguaggacagugcacacagcucacacccgcagaggcuccgcaugcccaacccacacccauggaggcuccgcauguacaacucacaccuguggaaugcuccacacacauacagcucacacccacagagccucugcacacacaauccacaccugcaggaggcuauacacacacaacucacagccacagaggcuccacacacacaauucacaccugcgggaggcucuggccggccaacuggguggugaggaaucaccaggccaaguucaggcagaagacgcaauccagagaacccgucccucuuccuggaccgcgguuucccccugagggcgccugggaggagcuguccgugccaggagaggugguaaagacggcaggcuguguuucuggcaccgcaccuuucuaaggacaaaaucuggacucuagggccugcccaaugacgccuaccacauacucuggguggguaaccugaagggcugcacccaggagcaggagcaaacgugaagcagcccagccucaggggacuagagcacggcucugaggcaccuccaccagggccucgcguggggugaccagaucuguuccugucuccaagggaccgcuggaagccaacggaaacucccccugggaaaagauuauaucuuaggccucagacuguuuccaaaaucuuucacauacaauggucaguuaagcaaaaugacaagacaucaugagcaaaagccagcagaaacaguaacagaagcaagcucccagacuccugaagccugccaagaugaagacaguccaagacagccccucucucccgcugacaacagcuaaaaacucuggacaaaagacaaacaccuaccuaaggacucuggaaaguaagcugcagcaggcacacuggggaggaggguccauccugaagaaggaacccaaaacaggggacuccucagguucguuuucucuuuucugcccuggcuggaccugagggcagccccagacagccaggcucagagagaaacccugucuuucucuggcuagaggacgaggaaaaggggccccuacaagcuggagggggaauccugagggcucccacuuuucucucccagccugacccagcuggcugcagucacagagcugugcaguggcagcaugagcagcagaaacagggaagccuaggcacgggguaaggaaggaggaaagcccaucuuucuaggcagaggcugaggaagaagguuccucggagccagaaaguguguaaggaauucacaaaaggagagcuggagagggauccccagagacguguaugagccugcaagaucugggcuuacuccugagcugugugugccuugggcaggcccggggccacaggcaaaagcuguggaagcugaaccaacacugcagccaccacccaugacagcaaaacggacuccugggcugaacccaaugggguuuauugcaacccagcugcaaaacaaaaucaacguuauccaaaggacuuuaacaggacccagaaaccagucucacagcaugauguucacagagcccaauguucacagagcccaauccauaauuauucaacaaagaaccaggaaaaugugaccaauuuucaaaggaagagacaaccaacagaggccaaccccaaaaugacccagauguuaguuaucaaagacucuaaaacagcuauuauaaguuccaugagguaaagcuacacucucuuaaaauauaugaaaaaauagagaucucagcagagaaauuaaaaacuagaacgaaaauuucaggacuaaaaaguacaauggcaacauaaaauucacuggaugcgcucaacagaauggcaacgacagaggagucagugaauaugaaaauagaucaauagaaagaauccaaucugaagaacagagagaagaaacugaugggauaaaauggcaagucuugaaguaugagacgaugucaaaaguuccaacacugucgguagagaaaagguugaugcaaaaaaguauaugaauaaauauggcccaaaucuccccaaaucuggugaaagacaccaauuuacaggcucaggaagccuagaaaaccccaaacagaauaaacucaaagaaaaccgugugcagacaugguucauaauaaacugcugaagaccaaaggugacgaaacaggcccgcaggaccccacaacuugagguaccagccacagacuuucaguuaccaugcuucaaacaauagcaacaaaaaagacacgauuaaaauuuuggacagaaaaguggaaauuacaaaaaaucaaaagaagaagaaaaaagaacuugacagauuagaaaaagaacaaaauaggcugggugugguggcucacaccuggaaucccagcacuuuggaaagcuaagucaggugcagugcaucacuugagcccaggagaccagccugggcaacauagcaagaucccaucucuauaaacaaauuuuuucagaaaacaacaaaucauggccaggugcaguggcucauuccuguaaucccagcacuuugggaggccaaggcggguggaucacgaggucaggaguuggagaccauccuggccaacguggugaaaccccgucucuacuaaaaacacaaaaauuagccaggcaugguggcaugcgccuguaaucccagcuauucgggaggcugaggcaggagaaucucuugaacccaggaagcagagguugcaguaauccaagaucacaacauugcacuccagccugggcaacagagcaagacugucucaaaaaaaaaaaaaaaaaaagaacuaaucagaaauuauaggcugggcacaguggcucacaucuauaaucucaacacuuugagaggccaagguaggaggaucauuugaguucagcaguuugagaccagccuaggcaacaugaugagacccuaucucuacaaaaaguuuuaaaaauuaggcgggcaaaguagaaccugccuguagucccugcuccucaagaagcugcagcuggaggaucacuugagcccaggaguucaaggcuacagugagccaugaaugcaccacugcacuccagccugggagacagaaugagauccuguugaaagaagaaaagaagagaagagagaagagaaggagagaggaggacagugaaagaagaaaaggagaagagaagagagacgagaaggagagagaugaaagaaagaaaagaaaaaaagaaaaaaggcaggaaaggcaggaagaaagaaaagaaaaggagaaaggaaaaaacaaaaaagaaaaagaaaaggcaggaaaggcaggaagaaagaaaagagaaggaaaggaaaggagaaaggaaaaaaagaggaaaagaaagaagaaaaggaaaacaaaacaaaagaaagguuguagaacagaaaaacauaguaacuaaauuuaacuuuauacaaugggcugaugaauagauuagauacagauaagagaauuaaagcauccugagugaagaacaaugagacagaaauaacauacacugugccacugacauguaauuggaggcccaggaaggagaagaaaaaauggggcagaaacaguaaacauauaauggaugagaaucuuccaauacuugugaagcucaugaaaccauagucucaagaagcacuacaaaaugccagcaggauucaaaaaaagacaucuacagaccaaagaacucacaguaauacugacgaaauccaaagacaaagagaagauuuuucaagcagccagaaggaauuucuggccaggacaaaauggcacacacuugucucucccuguuccucuccucuaagcacaaccauaaacccuggagagaacccuagagacaaaggaggacucugaaagguggaagaggaaagcaaacuggcuuagggccucaggacuggaggaccaacacagcaacaggguguucuuacgaccccccacccaacgggaggugacacaggccugaugcuuccugacucccugccuagcaacagaggcaacccagguacacuuauucugcccuggauugaguaggaguuccaccuaccacaccaggcgagcccaagcccuacuaacaaucagcagguagggacaucagcaagagaucccucagcccagaagcacucuccuuccccaucaggcggaccugagacaccccucccacaaacuagacacacccugcaccaagggaauccagcaagugggaccaccaucaccagcaccuggccuaggaggcacucuccuuccccacuggucacgggacuccucuccccacugagggaagccauccgaggggaggggcggacaccggcacaggagccacacuccacgcaccugacggugaugcugaaauguuccaccccucagaggcagggguguaaaacaaacacccagccugggaagcucuugguccugugcgcagagacucccauguccauccagaggcagcacgcugcccagccuaaggagcuccugcugcccucgagcaacaucaguggggacccauggaagccccaggggagaggcuaagucaagcgaccaaaacagcaccacaaaggcuaggaaggucagacuaucaccagaaccacagucacaaaaguaggacaggccugcaugcuaaaccugaacaaggugacuacugcuaaaauaaaaccaguacccagaguuuccuaacaaaauagacaaaaugaucaggaagccaucagaaaugacuuuaaucagaggaugaugaacuggcacaaacaccaugauaaaucaaauguuggaacuaucugacaaggauuuuaaagcaacuggcaugaaaucacucccaaguaaucacaaauucuccugaaacaaaauuagaaaauucugguaaugagagccaaaugaagaacuggaaaauacaguaacagacauuuuaaaacucacuggaugggcucagcaauaguugagaugacagaagacagaaucauugaccuugaggucagaucaagagaaucuacccaaucugaacaacaggcagaaacugcaauggagaaaagaagaacagagccuccaagaccugcgggagaauaacaaaagauccaaggguucuaucaccggagcccagaucaaagaggagaaacagcaacagaaagagagaaaaucuucccaaacauguugaaugacaggaaugaaugaaauguuuuaagaaacugagugaacuccaaaaaagauaaaccuaacgaaauccacaccaggacacaucaugacuaaacuucuaaaacuaaaaacaaaauauuuucaagcagccaaaggggaaugguacgauacauacaagggaacaccagcuccaaagacuucucaucugaagcuauggaggccagagggaaguggcacaguuuucaagugcugaaggaaaagaacugucaaucaaccacaaauuccauauccagcaagacuauccuuaaaaaaaugaagaggaaauaaagauguuuucuggugaagaaaaauaaaauaaucugucaaaccuuaaagaauggcuaaaggaagcuguccaaagagcaagaaaauaaggaaucuuggaggaccaggaagaaaaaugcagagacaugaguaaugaguaaauacaacagacuacccuccuuaugaguuuuuuaaauuacauacgaugacaaaaauuuuaacacugucagauggucaagacagugguauuuaaaaguggagagagcaagggcggcuaaauggaaaaaagguuuccacauuucacugaaaacaguaaaauaaggauaucaguaaacuguuguaagucacauaaguauaccguaauacccagagcagucacuaagaaauuauacagagauacacccaaaaacaauauaaauaaaucuagagaaaauccuaaaaaauggucaauuaaccaauaagaagucaagagaagagaaacaggaacaagaaacagaggaaacaaacagaaaacaaacuauaaaaugucagacucaaguccuaacguuauaaauaguaauuguuaacaauauaauguuauuaguaaauguaaacacucuaaauacaccaaucaaaagacagacugguagaggguagauuaaaaaacauaacaucauuacaugcucuuuacaagaaauacacuucaaauucaacaacuuaaguagguuaaaaacuaaaaggagggaaaaaagauacgccauucaaacacuuuuuuaaaaaaagcagaacuacauuaauaaaguagaaaaauuacgagaggcaaaaagggacauuacauaaugauaaaaggaucaaucuaccagaaagaccuaaaaauccugaaaguccacgcaccaaacuauaaagccucaaaguacaugaaaaaaguugacacagcuaaaaagaggaacagacaaaucuacaaguauagcuagggacuucaacacccccuagacagaauuacuagacauaaaaucaacaaagauauaaaucagaacacaaccaacuagcagaauacaacugauagaacacuccaccaaguuacagcagaauacucauuuuuuuccaaaugcccaugaaacauucacuaaaagagaacauauccuaggccacaagacaaaccuuaacaaguauaaaagaaaucaaacuagguuaucuuaaugaaaucauaugggaaauacauaagacaaaacaggaaaaucucugaacacuugaaaauuaaaaguuugaaaucauugaggagugcuguggucugaguguuuucugccccugcaaaauucacacggcaaccuaauccccaauguggcaguggugagagguggggccuuucgggggugaauaggucacaagggcccuacccucaugaaugagacuaaggaggcuugagggagccuguccucuucugccauauaaggacacucagaaggugccaucuaugaggaacaggcccucaccagacaccaaaucuguuggcaccuuaaucuuggacuucuuagccuccagaaccaugaacaaucaauuucugucauuuauaaauuacucaaaaguacagcaguccccucuuauccccaagggauaagcuccaagacccucagaggauuccagaaacaaaauauauacauauagggcucaguacuauacuuuccuacacacgaaaguuuuuuugagacacggucucacucuguugcccaggcuggagugcagugguacaauuacagcucauuguaaucucaaaucccaacucaaacgauccucccaccucagccuccugaguagcugggacuacaggcacacagccaccacacccagcuaauucuuuuuuuuaauguggauccuaggucuugcuauguugcccaggcuggucucaaacuccuagacucaagcuauccuccuaccucagcuucccaaagugcuuggauuacgggugugaaccaccacgccuggcccucaaaacaacuuacuguacuauacucacacuucucaugaggaugugagaugagaaaaugccuacaugaugagaugaagugaguugaaugacauuaggcauaguagugaccuagcuuuaggcuacucccaaccuucugacaauaggucagacagagaacuaucugcuuggagagauccugggucaucaagccaugaugacguccauggugggaugucaggagcagaugauaucaaugacuuacgagaacagcauauacaguguggacaugcuggacaaagggauaagucacguaccaggcaagauggcguaagacuucaucaugcuacucagaacagcaugcgauuuaaaacuuaugaauuauuucuaaauuuuccauguaauauauucaggccacaguugaccaaagguuacugauaacaggggacuacuauauuucguuauagcagcccaaaugaacuaagacaaugagucaaagaaguaguuaucaaaggaaauuuuuaaaaaauaccuagaacugaaugaaaaugaaaaaacaacauauaugugagaugcagcuguggcaguacuaagugggaaauuuacagcacuagagucuuacaucagaaaagaggaaaggucucaaaucauuaauacaaguuccuagcucaagaaacuagaaaaagaagaccaaaauaaacccgaaggaagcagaagggaaggagacagguguggcuagaaaagggcaacaguagagguccuccugggauggaaugaucuguaccuggauuagauaaaggucaauauccugguguaauauuaugcuacaauuuuagaagaagucaucauuagggaaacugaguaaaggguaccaaggaucucuguauaguauuucuuuaaaaugcauguuaauauacaacugucuccaacuggccaggcgugguggcucccgccuguaauccuagcacuuugggaggcugagauggaagaaucacuugaguccagaaguuccaaacuagucugggcaacacagugagagcccauuucuacaaaaauaaaaauuguuuaaagaaaaauauauauauauacacaauuaacucaaaacuaaaauuuaauuuuuuuacauuagccaaggauuuuaagauacuucauagaaaaagguacucgaauggccaauaagcauauaaaaaugcucaucauaagucaucagggaaaugcauacaaaaaccacggugagauacaacccaccuacuuacauaacuaaaaucaaaaagacugacaucaucaaguguuggcaaggaugcaaagcaacuggaauucacauaagcugcuggccaaauaaauaugucacuuuggaaaacaacugggcacuuucuuacaaaguuacacauauguaucuuauuaucacccaguaaucccaagcacagcuguuuaagauaaaugaaaacaucuguccacauagaugaauguucacagaagcucuauucauaauagccaaaagcuggaaaugcccccagauaaucaccaacagaugaauggaguucuaaaacgugagcuagccauaccauggaauauuauuacuaagcaaaaaagaucuacacaacaugaauuucaaaaauacuacgcuaagugaaagaagucagauuagaugcacagaggaaacucaucuacaauaacagagcagagcagugaagcccuggguggguccugccgggcaggggcacaaaggaaacucgggaaguaaugagaaugcugucuugauugugguuguggucacagugguuuaaauuccucaaacuacacucuuaaaacaugugugcuuuaccagauguaaaucacaccucgauaaaagugguucucucaaagguccaaaauggccgggcgcgguggcucacaccuguaaucccagaacuuugggaggccgagacaggaggaucucuugagcccaggaguucgagaccaucccugacagaacuugucucuauuaaaaaaaaaaaaaaaaaaguccaaaacaaaagucuucacuuuauaccuuacaaugggcauuaaccauuguauccuagcagggacuucucugaaaagcucagauuucauacaucucuccccuccucagaaaccuucagugguuccccaauucccacagagcaaauccccaaucuacgaaucagccacucaaagcauucugcgcucuggccucagcacuuuuuccagucuaauuucgccuuccaacucugcagccacuacccccaugaggccaccagccuuucccacacggugugcacaucacgcacuccccuccacuucccccuauugucuuugcuucucuuaauucguucccuuaccuccaucugauucucacacaccuagacuacaaacucaguuuucacucuaauggaacauuccagauucccucaggggagucucccucccucuacuccccuguucugccaguagcaucugcccuuuagagagccagccuccucaagcccgucauuaugggucucuguauaugcagacacuuccauugcuacaggaggccugaaaaggauacgaagggccccacaguucacaauguaaugcccaacugaacucauguaaguuuaaccuuuuuugagacaggaucuugcucuguuacccaagccgaagugcagugucacaauuauggcucucugcaggcucaaucuccugggcucaacugaucuucccaccucagccucccaagcaacugggacaacaggcgugcaccaccaugcccaacuaauuuuuauguucuuuguagagacagucucacucuguugcccaggcuggucucaaucuccugggcucaagcaauccucgaccucagccucccaaagugcugagauuucaggugucagccaccacacuccacccccagauauaaguuuaauuuugacuaguugaguuugaagugaugggacgagagugacuggggaauaauaaaccacucuaagaaaaagagggccgggcacgguggcucacgccuguaaucccagcacuuugggaggcugaggugggcagaucacgaggucaggagaucgagaccaucccggcuaacauggugaaaccccgucucuauuaaaacaauacaaaaaauuagccgggcguuguggcaagcgccuguagucccagcuacucaggaggccgaggcaggagaauggugugaacccaggagacagagcuugcagugagccaagaucaugccacugcacuccagccugggcgacagagcgagauuccgucucaaaaaaaagaaagagaggacuaggugggagcucaggaaagccagaaauaaaaaaaacucaaagaucuuucuuuucuuugagacaggguuucacucuguugcccaggcuggagugcaguggcguagucucggcucaccgcagccuccgccuccuggguuuaagcgauucgucugccucagccuccugaguagcugggauuacaggcgcaugccaccacacccagcuaauuuuguauuuuuaguagagacgggguuucaccauguuggccgggcuggucucaaacucccgaccucaggugaucugcccaccucaacgucccaaagugcugggauuacaggcaugagccaccacgccuagccucaaagaucuuuucuguagugacaacaaaaguuaugaaaguagaaaaaugcuaugaaauaaugacuaaauauuccugucaagggcaccaucguuccugugucugggcuccccauggcaguucagcugacuguaacucacccuuagccaccucccacagccacugucaaucaguccagcuccauagauucagcuuguauaucuguuggcucuaucuacccuuccuauucccucugccgacagacaggcaaguccaucugggcacaguggacuaacucacucacucauaccugugaucccagcacuuugggaggccaagguggguaggagcacugcuugagcccaggaguuugagaagccugggcaacacaggaaaacuccaccucuacaaaaaauaauaauuaaccggaccaggaggugcaggccugugguccuagcugugauccuagcaacucgggaggcugaggugggaggaucacuugagcucaaggaggucaaggcugcaguaagcugugaucaugccacuguacuccagccugggcaacagagcaagacccugucucaaaaaaauaaaaacaagaacaggcaagucuuuggcauuuccagccuaacgacaucaacucucagguagaacaccugucuauggccucuacccacucaaaccugcuaaaaacaucuucccaggcucgcucucucggcacgacaucccccuacuuaaaaacccucccaggcgaacaucaucaaagaaauccccagccaaccugagcaccauaaacaaucuggccccagacuauuuuccaaacuaaucacuuacuauuucaguccacaaauccuccgccucaacaagguuaaucuacucaguacacccgaagacaccucuccucugcacagggcuguagccagcugcccuccccucugcucuuaggggcuaaccauucaacaaguauuugagcacucuguacuguggacacagcaguaagugggacaaccauaaucccuggccucacagagaugcacacauaacuaggcagcaggugguucucaggacaccucugcagaggaaaggucaugcuagcuggaccaacuagcaacucccacaguauuuaguaccaccuaacaggugcucaggaagcauuugaagaugcucuguaacccccaugucagaaacacccaaaucccuugucaagaacaaccaaagacgauuuaaauauacaaucuaaacucauaaaccaauaaucugaacaagucaucaccuucagaaauguggcaaugugcuuacaagugugcugccaucaagagcagccucuucacaccaagacuccaaccacuguugcccuccugccaacacagggaggaagacacgcagugguuucaccuguaaauuuaaauaaagagucucaauuuuuacacaguuuuacacaggagggcaaguucuggagguggaaaggggcucugagcacagauuucauuuuaacgaaaagucacuacaaggaaacaauauggcgacccucuggaguugauuauaaagggauuuugcucaucaugucaaguuagcaaaccggaguguaaacucuucuuguugccuauaucaugaaacugcuggucccugagauggggacuaaaacccaggcuucacaggccacagcauccucacacugauuucuuauuccauaacaugguuuccaaaucaguaguucgaauuacucuagcaagagaaaaaaaggaggggaucagacaauuccucccaacagugugccucugggcaggccauguggcuucugcacagggccacgugcugucaguaaggagaggggaugaacuggcgaacccuaagcucccauccagugcccuaggguucagggcagcuuggcucugcaagcaaaaggaaaaccugguuuccacugagcuacaccgccgacauccuugcaaagaauugagugcaugcuaguacuugcccuggguuguuuuuuaacauuguccuugagagauaauaaaagcuugcucuccacauuguccccugaaaccaaggccuagauaccucugaguuuccuaagggcauguacaaaacgcacaguggccgagaucaacgccaggacugcacugcucuaguccagcgugcuaugcgguaaaauaaagggaacuucagccaccgccucaacuuuccaccaauuuauuacaacuuucacucaaacaucaccacaaaaugugaugacuagucagguucugcaccuucuuauagacauuuuuaagcggacaauuuucaacauguccaauacauuauuucuuuaaaaaaugcaaacacugucaaugaaacaagagaguuaccaaaagaaagggagggggaccuaaaaauaaaagcccaaggcggccacaauucuuggcuguggccccaggaacgaaugaaacugaaggaaguguuucugcacagccauaugccacaaggccucgccaagggcaagcucuccugagcccacccacuuacuacaauggcagacugguggccccaggacaccaaaaaucucaaaaggcuaaugcaaaacaagacagcagccagcccuggaguuucagcaggcuuucaaugcuuucaaucuuuacacaaauggaggaugggcuuuaguuagcaaccuaaugaacaagccuuuaacaaguuaaauauugaagccacuuucaccaucauacccccaaaagcgauuuccaauuaaaacauccauauugaaagaaccaugucugauuaacugaaaacuaagcuggagagguacauggagacauucaaaagaagaaacaaagcaaaugcugcuggauuagaagaaguguuggggggacccacacuguccuaccaaaacccccuccccacucagucucuuacaagauacagccacacuggguagcagcgaaucucacaccuaggcugugaccccaacaacguaaaucacuucagcugagcugaggcaaguauuucggucaucugaauuacgaucucuccaaccuguaaauuuaaagagagucucaauuuuuacacaguuuuacacaggaggucuaagugcggugccucaugccuguaauccuagcacuuugggaggccgaggcgggcagaucaccugagcccaggaguucgaaacuagccugggcaaacagaccccauuuuuacaaaaauaaaaacuguuuaaagaaaacccccaucucuacaaaaaauacaaaaguuagccaggcgugguggugcaccuguagucccaacuacucgggaggcugaggagggaagaucacuugagcccggcaggcggagguugcagugaaccgaggucacaccacugcacuccagccuggccgacagagcgagacccuguccuccacaaaaaaaaaaaaaaaaaggaaaaaagaaaauuacacacgaggcugaagcaggaggaucacuggagcccaggaguuggagaccagccugggaaacacaggcagacuccaucucaaacaccuggccucaagugaucauccuaccucugccuccgagucacuagaauuguaaguauaaauuaccacaccuggcuuaaaaacuuuuuuuuuuguaauuacauaugcucccccugugaagcaaacuauagaauguaaaagcccucucucggcaaaaagaaguggaaaccagccaggcgugguggcucacaccuguaaucccagcacuuugggaggccaaggcaggcggaucgugaggucaggaguucgagaccagccuggcaauauggaguaacccgucucuacgaaaaauacaaaaacuggccgggagugggggcgcacgccuguaaucccagcuacuugggaggcugaggcagaagaaucgcuugaacccaggagguggcgguugcggugagcugaggucgcgucacugcacuccaggcuggacgauagagcgagacuccgucucaaaaaaaaaaaaaaaaguggaaaccagaccuccuaaaaucggagucugaugugcgaaggcacugucacccaccaguaaggggcacuccagucucagcuccuaagaugguguccagucuucuccagcuccuguucauguuucuuuucuuuaaaugcccaccuuuuaauaauuccagaacucaaaagcccauguuaguaucagauugugaauucaucauccgaugagucaacaaggauuaaagagugaccugguaccggaagugaaacuagacgaacccaauacuaacacagagacacgcguacuuauuucuggauggcugacaaaucccaugcugaaugccaaagcuaaaugcaaugaaauaaaaaaugcaugcaccuugcuaaagaaauuggaaagcagaucgugaaaguucuuuuuauagcaauuugucuaacauccgcugccugagcccucagcccucuccacauauaaaaucuuaaaaaacaugcaggaguaaaacuuugugcucggaucccaggagccaugcccaagaaugcacugggcuccacagcaccuacgggagcccagccagcgcccacgagcagcugcggugaacaguccucagugagacacuccacagcagcggaaauguggaaaagugaagaugaagucaagaagaaccuaagaacguaacgugggauaagggaauaacaaaagccagucucagaaagagacaucauuggcaaagguguaaaaacuaguucgugguguaagcacaugcggcaaaauacaaagaaaagcaaaacagugacuaacacaaggugugaggcaggugagcccacgcagccggcagugacugcaagauacccaggcguccgcucucgggcuguucuuugcaccugacucaaguuucauaccuacaucuuaccaauuccguucucaaaaacucaugugaagucuuggauguagcaguguuucuuccucauuacaacacagaaacuaagguuccacugagccaguaaacaagaacuguaaaacugaaaacugucaaaggaaaaacucuuucccaauuacuacuuacacaguacaaaaaccaguuugaaauaaggcgaguuauuuaaucccuaaaacuuacaaaacgcguuuguccuuaugacuaacucgagucuagcuggggcacaggccacugucaaacagggcaacgccuacucagcguuuuccaaacuggucaacugaacucuucucuggaagggcugucuccuuuagucuuacucuaaaaaggguaauuuuucaccagaauaaaggcaaauauuuuaagaaugcuucaaaugaaaagaggauugcagaaauauuaaccuuuaauuguaccugaaacaaagcaccugaaauuaauaaagaagucagccacugacgagaaucacuaggucuguccuguucccagggcacgaaacagaagcgucuuaauccacuaagcacauuagggccuaacaaacuggacugaguaacaagguuaccuaguucuuccaaacaggaauuaaccaaaggggaucauuaugauuaagcacaaugcgcggaauacgcaauuucuaguuggggaauucaacagcugacagcuuguaagcaucaaaauucauaacaagugcaaggcucggaaucacagguccagcacuggacgaugcccggcgcgccgggaagcggcgccucagacggcggccccgcguccccauggucccucccugcgcccagaaccgggcagcuccuucccgccgccgccgccgccaacgggaggcugggggcacucccgaaauaggagcggaagccccgacccacgccgcccuccgccgcagggacgcccacucgccaggugaccgcguccccacgcuccgcguugcccgggcgccgccaggaccucggaggcggccggcccagccccgacccugugcggacgcggcacaaaggcgcggcgcgcggaccccgacccggccggaccccggccgcgucccccggccccggcccgcgccccuggcccccgccccgcgccccucacccggcccaccucggccguaggccuuggcgcagauccacugcagguuggcggcgaucuuggcgcgcgccgcgucguagcgguccaggggcacgaggucggcggcgccguccggcggggccuccaucuuccuccagcccucggcggcggcgcggccgcucgcguccaccau

SEQ ID NO: 192920 - RNA, 34827 nt, Homo sapiens
uaauuuaacagucauaauaauccuuuauuaguaccagcucuuaaaauuuuuuuuuuuugccagagcuaaacaauuuaauauaaaaaaugccauuuuuuguccauacaguauuuauaaaaaaguacauagugguuaguuuugcaauaauuucuuuuuagccagaugucauaucaucauauaaaucuaugaauauaacaaaugacauaagaacaguauaaauaaguuuuuguaguauuuacacuuacacagaaacuagcccaaaugguguccuaagaaauuguuuacaguuaaagugaaacuacugauucaacauacugacacuccaaugcuuuuuaaaguuucguauuauuuucuauacuaguuuuggcuaugauuuugcauagaauuacuuauaaaguaugagcauuucacaucacaguaggagcuuuuaguauaauaguacaaaaaaacuagcucagaaaaggucaaauccuccuaaaucuaguuuuucuuaacaucuggcuucuuacuuuugggaacaaggaaaacauugccaucucuuguuugcugcagggaguauucacuaggagaauaagguuuuccaucuucaucacguagcaugcugaaaacuucgagauauaaggugcugaguuguuuuuucaguaggugaaggcuuuugucauuuucuccuuuuucuuugagcaauuuuucuuuuucaucuuucaaaugaucuaaaucuugcucuaguucuacuauauuuuccaguuuucuuuuucugcaauucugagcagccacuuuauucuuaccccuccuacguauaucccgaauuaaugcaaguugagcuucauugaacugcucuuuggacaucauuucguugaagucaacaacagggagguuaaugauuuuuucuacagggaaugggauauggagagcuuuugcccuaaguucaucucuugugagaugagccuccaagcggcuugaauguuugucuuuugugaaugggguuuuccgaugaccaggacuuacaggcaauucuuucucugguguguucucacauugggcaucaugcacgugagugcucugccccugagauggugacaaggguuguaccauauccccagaagaauguacugguguuuuaggaccauucuguuugacacuuccaggggcacuaucuagcucuuccacuucagaaucacugaggccaaguagugugucuccauagcuggaagauuccacugaguguucuggugaugccacacugggacuuguguuuagugaaaugccggagucagaaucauugaauucugcugugcuuucagggugguuuugguugaaagcuuugcaaagugauagaucagaaacaucaaugggcccauuuagaaguucagagagugaauggcuuaaaguagcaggugagggcaugcuguugcugauacugggcucagcuaugaaagcagaauaaaauucaucaccaaaaucuguguugacuguggcaucugaauuuaaugaguucacugucaacugguuggggucuucuguggagaggaugcugcugaaggaauccucaaaagcauuaagaaaauguggacuacaguuaccuacuucuuuuuccauugaggguauagaugaguaaaaaugauaauugucaacuucugucaguuuggcuucuggacuuggaaccaugguagucucaaccagcuugucauuuucaauauuaagacacugcaugagaaggaaguuuauacuauauaaaucaaaguuaauccaugauaauacgugauaaauuuagauaaacucccuacccacauuaucuucaggcuuaucucuauaauuuauuaucuauaauucagagauaauucucauuuccaauacauauuuacgccuaagcguuauguauuauuuucagaguucccagaucagacgucagguuuauaacauucuauccucaagauguccaaccaauuuaacuagcaugggcaguacucaugacuaaguuaauagcacccuccaauccuuccuauaaauaggugguauauaaauaaucagaaugacuaaaggcacugaauauaaaaaaaaucuccaguauuacauucuauuuuaguuaccuguaacucaggaauggauaauagcuccucccaaacuugcucaauguccuguugcauaccgucuaaaucaacaggggcuaccugagcaacagaaguuucaggugacugagccugauuaguagcaaugaagacugggcucucgaugugaccgggaauaucaggaacaagugacugaaacguagccgaagaaaccuaaaauugauaaggcauugauuuaugagucuuccaccaacaggggaugaguaagcucuaaggcaccacuacaaaacaaaauggaaucagcugcaguucugugucucucuacuuacuaaccagucaugaccccguuuguaaauaacaaaucuuuuuuuccuaccccacugacucaaauuuauaauuugcuggucuguuucagcuuaagcauuugaaaguaaacuuuaaaaugcguaaguacaaucuuuaggauuuaguuuauauaauaucuagcacagugguacuagauaaaacagauuuauuaaaauuguuaacugaacaagucuucguuuauugcccagcuggcucuuuacucaccaaaccucuuagauacuugcagcaaauggguuauuuguuuccaugguuaugcuguccauguuucuggcuaugcaauagucaaugguuuugguuuuguauugugugaaggguuuuuuuuuuucuuaauuguaaaguuauuuauaggcuaagguuuccuugacaagaguauuuccuugguuaaaaaauuuccuccuaaaaauguuuuuauucuuuuaaauggagauucauugacgggacuuacauagaauagauuguuauuuuauaguuaugauggaguuuuucuauuaaccagguuauuuuauaccucaccucauugucaucuacaaacgggaaugucugcgccaaaagcugcaugcagucaucaaaguacaaagcaucugauuugggaaugugggcaaccugauaaaagggaaugacacaaaggaaaacaaaaaugguuaaauauuccauugccaagcuaaauauucaauaauugauguucauaaaauauuuauaaucaaguuaaguaaauauuuaucuuauuucagagaucacuuugaugcacaauuugaacuagaccacauggguucagaucuuagcuccuccaauuuucugagugaucugggcaaauuauuuaaccuuugugagcuucaguugcucaucguagauaaaacagggauaaugguaacuaauuaauauaguuguguuaauuaaaucagucaguauauguucuuaaaacagugcuugccacacacaguaacgccaguaaucccugcuacuugguucuccugcuacuacuucuguugcugcuacuugauccuuacaggauguuucuauacuuuacaaaacucuuugguguaacuuaagucuucccaauccucacaauaacacuguuaagaucaauagguuggguacugaacucagguuagguacugaacucaucaggaggcugagguuggaaaguagauuugacaagguuaaguaaaagaaaggcaaagcuggaacucaaauccagauauuuuaauuccuugcucaguguuuccuuaaaccugccauaacuuucccaagaacugaguacucuguaccugggaguaguuggcagauccacugguuucugacuggaugugcugggcuggcugaauugggagaaauucaccugucucuucaucuaguuguaacugagcgaaaaaggcuuucucuugcuccuuuuggaguuguucuugucuuuccuuuucaaguuuuuucuguuuuuccagcucauacucuuuccgucgcugacugaagucaaauacuucucgacuuacuccaagaucuauaucuugccuccaaaguaugucaaucaaauccauguccuauguuuaagacaaaaaaaggaaggagagagcucauguuuuuuaaaugacagauaccacauaaauuaauucacauuaugccacuguugauggugggaaguggggagauuacaaauacaaucuaaaugagaacacagauccaauguucuagaagagcacaguuaauuccauucaaugaaucuauucauuaaagacaacaaacaaccuacaaacacauagccauccauucuaaucacuuggaucauuaaugauagggugaugguagaggucacuaaagggcaaagucacaaaugguuugaaugagaagaaaucccacccuuguuuaauggaauauagaaauuagagcaagcacucuaagccacuggcuuauauaagagaaguggggucuggaaaacauuacugaauacauggaguuuucuuuaaacuuugcucagcaaauauccaguuuauagagggauaacucucaaguuaaagugucaaucuagcaguugugaaauaucaccauucuuuccaucuuuccuacacuagauuaucuucuccccaucacugcuugcuacucuuaucucuguggcuuaccuauaugccuguaaucccagcacuuugggaggccaagguggguggaucaccugaggucuggaguucgagaucagccuggccaacauggugaaaccacgucucuacuaaaaauacaaaaaucagccggguguggugguacgugccuguaaucccagcuacucaggaggcugaggcaggagaaucggcuugaaccugggaggcagagguugcagucagcugagaucgcaccacugcacuccagccugggcaacagagcaagacuccaucucaaaaaaaaauaaaauaaaagcagacagggacaggugcgguggcucacgccuacaagcccagcacuuugggaggcugaggcagguggauugcuugagcccaggaguucgcgaccagccugggcaacauggagagacccuguuucuaccaaaacaaaaacaaacaacaacaacaacaacuggugugguggcgcacaccuguggucccagcuacucaggaggcugagguaggaggaucacuucaguccaggaggucauggcagcagugagcuaugaucgugucacugcacuccagcccgggcaacaaagugagacccugucucauaaauaaauaaauaaauaaauaaaacuauggcuccagggaaggauuaaagguauuaaguuuuaagacauaggaagaaucuuacaaagagggaaugguuuugaugaggagaggcugagcuuggugacucaggccuguaaucccaggaguuugggaggccaaggcaggaggauugcuggagcacaggaguuacuagccugggcaccauagugacaccuguuucuacccaaaaucaaaacaaauuaguugcacguggugauacgagccuguagucccaacuauuagggagacugaagugagaggauugcuugagcccaggaagucaaggccauggugagcugugauuguaccacugcacuccagcuugggugacaagacccuguuucacacacacaaaaagauacauggggagagaauuuauaugacuaggcuaggcauaggaaccacauccagauuuuccuaaccaaaaaugugucaauagcaguuuuucugauuuguaauuuuagucuuuggaaaaaucuaaauagguaggaaaucuaaaucuguuuccauuccacaaaucaccuauaggggaaauaauuaauuugagaauggaaaaaaaucaagaugggggaacgggaguugggacuugaaggccaguggguacaguguagacacgucacacuuugcauuucauucugcugacagcuggcaacgccagacuuagaguucuauuacuuucagcuucccaaggacgcaaauaacauggugguuguuucagugaggagucaggcuauuuuuauccaacagaggagcaggccacccagccuggaggcagcgcagcuagcuagauggcacaggccaccuguguccaugauugaagguuggcguuggaaucuuaaaugcuaugaaacccugcucauggggcucauuauucuagccuugaacaauauauauuguaaagcacacaaaguaggcauaguuaaaguagcacuuguaguuagguauaccucacuaggacauaccuaauuaucuuuaagccaguaucuauuaagggcuuccuauaugcuaugcacuguucuaaguacuuuacauauagaaacuauuccucaaaacagccuuauacagagaaaacauuccuguuauacaguauaagaauacugagguuaagaaaaaagauacuaccagaaaguggcugaacaaagacacauacccaggcagcuucagucggguucaugcuuuauuagccaugagccuacacuauuauaaaauggcauggcauuugcugcaaauaaccuaugcauaucccuuuauauacuuuaacucaucccuggauuacuuacaauaccuaguaaaguguaaaugcuguguaaauaguuguuauacuguauuuuauguguguauuguuauuuuuucggguuuuuuuuccacuuuuuuccuuuugaaauuuuauuauuuauuuacucauuuugagauagggucucacucugucacccaggcuggaguguggugaugcaaucauggcucacugcagccuucaccugggcucaagugauccucccaccucagccucccaaguagcugggacuacaggcacaugccaccaagcccagcuaauuacuuuuuguagagauggcgucuugccauuuugcccaggcuggucuugaauucccgggcuccauugauuuuccugccucagcuucccaaagugcuaggauuacaggcaugaaccacuccacugugcuuggccuuuuuccaaauauuuuugaaccaaucugccauugguugcaucauggaaccagaggcugcaugggccgacuguauauacacuuggcuuuggaaucuugguaguaugaagcggccagucugcaggucagauuaagucuguaggucaccuagaucaguuuccuggccaagagcaacaaaauagcaaccacagagcauucagucgacuauacauggcuaucuucucagggggauucccacuaaaauagguaugagaauaauuucuauuuuaaaaaaugauuuguuuccauucugauggacauguuuacccaaagguuaucaugggagacagaaaauucaaagguauagagaaaccuacuuuauuuuauuuuuuuuugagacggagucucgcucugucgcccaggcuggagugcaguggcacaaucucagcucacugcaacuuccgccuccaggguucaagcaguucucucaccucagccuccugaauagcugggauuacaggugcgugccaccaugcccggcuaauuuuucuauuuuuaguagagacaggauuucgccauguuggccaggcuggucucgaaccccugaccucaagugaucugccugccucggccucccaaagugcugggauuacaggugugagccaccacgcccagcugagaaaccuacuuuaaaauucugauuagcuugggccgcuucuucucaguaaaucuagauacauagcaggguauccugucuagacuuucugcaaacuggagcuaucugcccaagcaagguauuaaguguucaauauguucccaucuucuagguacuagcaccaaaaaugaaaggaaugcaugauccugcgaucuuaauugaacucuguaaaauaggcaguccauguucccacccaucucaagaagugaugugcaaagugugcaaagcucuuugcaaagucaaucaaagaaacucaaauacuugucccuguacguggggaaaaguguacuuugacacaucccugccucacccuagacuuccugggccugagguuuuuucuuguuaaggagaucccaggauaaaaaucaguaaaagguugugacuuuuucaugcaacugaagcaauuuagguugcaaacaucuucugcucauaaaucugacuugcaaaguauccuuacaaccaacccucaugagcuggaagaaaauauugaauggaauuuauaauugucagugucaaucaugccaagaauugaaauaacuauuuaauuuccuuucccccccuuuuccuucccaucagaugauaauauuugagggguuuggauggcuuuagcuauacauuguuuaauuauuccauccuacccaagcauacagauguuaguggaucaaaugaggcacgugaaaaguaucucucuauaaauguaaaauaugcaaauguuuacauguugacagugauaggcucuacuacuugcuguauaagcgagaccaaaguccaggccaauggauaauaaugagguuguggaccuaacuagggggagccuaaaauaauguugggacuaccuagauggucagaaagaaugagccaauuaacuucuaaaaucauggacagcuucauugcuugguucuuccucagggcaggucugaauuagacuacuauuaacauguuguaauaaaaaaggauuuugaucucagagauucugaauuauuuacaaauaauaaagcaaauuaauaagcaaauuagaaguuuuaguggauauugcucuugauggugguuuuguuacuguugguggggguaauggugauggcagugggcacgcccauauacauuugcauacacucuaauauaaauguuuacaaacauacacacacacacauucaauugccacucaauuccugcugugaguacccuucaauggacagcuccaaaccaauucaauguuuuuuauuugaauuucccuugacaugaccagaaaaagacaucuuuaugaauccuuaucaacaaacaggaaaaauaagacaugaagcauuauuuagacuagcucuugagcauccuguucacguuaccugaaacaaugcuggacccugggagacuaagcagcuccugcggcccuagcuuacugucuccaccaagaaugccaccaaaugacaucuaauugcucuucauuaggcugggggacauucagugcaaucguaauaggaccaaaauagguuucaaaguguucugaaagguuuuccuguguauuuuuaaguuuauauuuauguggccaggcaugguggcucacgccuauaaucuuagcacuuugggaggccgaggcgggcagaucgcuugugcucaggaguucgagaccagccugggcaacauggugaaacccugucucuacuaaaaauacaaaaauuagccgggcgugguggcaugugccuguagucccagcuacgugggggacuaaggugggaggacugcuugagcccaggaggucgaggcugcagugagccaagaucgugccacugcacuccagccuggguaacaaagugagaccuugucucaaaaaaaaguuuauguaauguuuuuucuugcuaugagaggucucaaaacaaaacaaaacaaaacugcuucauaaaagaaaaaagcuaaauuugaagcaacuauuuuggauucccaaaaacagacaucuugaucaaauuuagaaugcagcaacaauagguuuauuguuauggccuuaaugucauacucugugcuacucagauuuucacaucuguuucagcaggcaaaauccugcagagauuugauacuguaugaaacauucaaagcuuuauguuaaaaaaaaaaaaaaaaaaacagcagaaguuaacugaagacucacuguuggggaccacaagcucacuacuguauuuugugcuaagcuaauaugcaccaaccauuuccuguaaggagccgugugacugggcacaugauuuauuccacaaaugacccagcucucugcaaggcucacacaucaucuaagaggaaauaaucgucuggguggagcccauaacaaacaagaacaugacacuggacaggaggaaagggaagugccuaaggaagaacuaaaacugcucuucugcacagaaauccagggcuuugaggaagugcaagucccccauggaggaaggccacaguacaaaguguuagauaaguaggguuuggguagagagaggaaagcagguagauggguugcacagcacugcacagauacuuucuuacaacgggugagaaagcuucccaagggccaugcgagcacuggccaggagccuuugcauggcauauggagcaaaugccgucugccacuuggugucugaauuuuuuuugcucuuguccuuuagugauuccugaguguguuccaaauuauguugcuagcuuggcuuagacaaaagaagacaauuugauaagaaacacaaauguuggacaauucauguuaaaucaccaucuggccuaacagaaauauucauguuuaaaaaauauauaucaucauuugccaacuggguaaucuguuacacauuuuagggaaaucugaaguuggacaauuaacucauaccacuuuaaaacaaacaucuuuguaccaggauaaacaaagaagaaaggacuugaacacagaauccauauuaaauaugucuuuugcaagucaauuuuagugccuugaauaaaccagcaucuaucaugcuuagaugauccaaaauauuggaaaagauaaagcaaagauaauacaaucccuguccuaaauuaaagcuauucaguaaacugagacaaaguauuugaaaugaaaaguaaucuuuuagacacucaaaugucuaauuaaggcuugcaccucccauucccccgagucucccuucccucuccuacccucuaucuugcccugagaaugacaggaagguggugggagauuuccuucuaaaaauaaauuucaucaauaaacuguuaaaaaaaauuaauuauacacacuacuaacucucaacagaaagcgaaacugagccuugcuccaaagagaaaacugauccuugaucuuuuuacuuucauguaguauaaaguuggaaugucuuaaguuauuccuucuuaaaaucauguauuuccauuuaaaaaaaaucuuauuuuaauguuauuccccugagauccuuccuucauccaaaucuuaguuaccagcauucagagucuaaguuacacuugauuauauuuuucuuucuuucauuucauucuucauauuauucccaggugauuauauuauuuaccuaaaagcuaaaucugguucaauguuuuuuuccauagacacugucuaaguauuucugaagaaaaccagguggaacaugaaucauauccuaccaucuggaugaauauaaaccaaauuaagagcuauaugaggcugcaaaaauauuugagggcaugcuugaauuuugaggaauugauaaaauaacagccaggcacgguggcucacaccuguaaucccagcucuuugggaggcugaggugugagaaucacuugagcccaggaguuugagaccagccugggcaacacaggccucaacucuacaaaaaaauuuaaaaauuagccagacauggugagacacugcuguagucccagcuacuugggaaacugaugugggaggaucacuugagcccaggagaugaagguugcagugagccaugaucauguacugcccuccagcccugucuuaaaacaaaacaaaagcaaaaacaaaacaaaaacaacagagaucuccuucauuuacaaaucucugccuugcagucguaauccuuauuagauaaagcaaaaugacaccaagcagauguguuuuuaaaauacaucuugcugaugacuaauuacauuucauagauauguaucugccuauuuacuucucuggcuucucucacacugcauuacaagaauauagcaauaccaauuguuuucucagcaagaauucuaggucauucuuucuauuucccacauuccaguacuuuugguuuuauuagacugauuugcuaucuugauuguguugcuacaguaaguguaaaguaggugauuaaaauacagaaacacagaauacuggagacaaaaggggccuuacagccuaucgaggccaaguguaaauguugccagguuuauuucuauguaacuacagugccuuaaaaaaaauaacuggccuagcaacauguuguauacaucagcagagacauuuaagagguagcaacaguuaccacgaauccaaguuuuccuuucccuuaucuugaauaacuagagacuuuuaacagcauaaaaaagcccaaauacacacaaagacguauuauucaacaaguuaaaacccuaguucacaaauuuaccauucccugaguuauagaaccauuuuucugcccuuuuaucuuuccacuagaaagugguccgguuucuucaaucuggcagguuacuaugugcagccauuuucaugggcugcuuccuguucccaaacaaguuccucagucaugacucaaucuaagaaauaugauccagccaauuuacuggaacucucacccauuaugcuugucuguaaacugcagagcaugaugcaaagauaaagcaaaacuggaaagugaagaaagcaagaauuuggauuauuuucucaagaggcacaugcagaguucggucaaaaagaugucagaaaaaaaguuaauuuccaaaacagcaggugauccuaccugcuacaaaaagcacaugguacugaauuuuccaugagagguucacaucugaguccccaaggagguuuuguuuuuuuuuuguuuuuuuuuuggugguuuguguuugaguaggauacugcugcuaggcuucaaaggacuuauguaaggguuucacuacuuugcugagagaauggcuugguuugacaagcaaacauuaggauaaauuuuucuaaucucuuccccauuuuugaacaagccauguauguauugaguucuaaaugcuguccuccacagagaggaacuucucaccuuugggauuaggucuuguacugcccuuagaaugauccaacccuccccacacccgacccgaccccugccauauuaccaacagaaacuucaggaacauuggauccaacucccuaaccuacuuuaccaaaccuccauagaaauuaacugggcauggacugaccagguggcucagaucuccaccuugaggucaaacagcuuugcugcccaugcugguguacccucauccuccaaggaagucccccaugagggugggcacacacaauccagcacauucacaccguaaggcuucuacagauacuucugccacuucuaaacuccccaagugauccuuuacccucucuuuugauccuggauuuguaaagauaaauguaaagauaaaguucaauccuugggguccuuuucagauuuuuuuuuuaaaagagauuaagagucuugcucuguugcccaggcuggagugcaguggcaccuuccuagcucacugcagcuucuaauucccaggcucaagugauccucccaccuuggccucccaaguagcaugcaucaccaugccugguuaauuuuuauuuuuuguagagaugguucuugcuauguuacucaugcuggucucaaauucuuggccccaacugauccuccugccuuggucucccaaagugcugagauuacaggcaugaaccacugugccuggucaauuuucagauguaacuaccuacaaauagcuaaaaguaauaauaagucaguauagucagucauccaggcuugggggcuaaguaaguacuaaaugccauuuacugcugcuagccggagaccuugugugcuggugguaugaauuuuagauacauuuuauuaacaauauuauuauauguauaaaacacuuagcuuuaaaaaaaaaaaaaaagauccuugcugggugcgguggcucacgccuguaaucccagcacuuuaggaggcugagguagguggaucacaggaucaggagauugagaccauccuggcuaacacggugaaaccccgucucuacuaaaaauacaaaaaaauuagccaggcaugguggcgggugccuguagucccagcuacucgggaggcugaggcaggagaaucgcuugaacccggggaggcagagguugcagugagccaagaucgcgccauugcacuccagccugggugacaagagcaaaacucugucucaaaaaaaaaaaaaaguuaaaacuuguagaaugguggugguuauaaagguaguagucaagaucaacaagauuaguguaaauacccuaaguggaucacuaauccaucuacccaucagauaccacccccucagaugccagggauacaaagaugaguaagacacagucucugaucugaguuaugagacaaagugaugagaagcaaguagaagcccaggcagcauggaggaggugccacuaaaucugcacagaaagaccucacagaagagguaacgacugccacaaaguguauaacuggccuacugugugaauauccuuccaauaaacaaggguuaaaucuauuuuccaaaggcccagcccaagugggcauuugaaagcaaaggaggcuauggagauggcaagaacacacaagaaguaaauaaucucggcugggugcgguggcacacgccuguaaucccagcacuuugggaggccgaggcgggcggaucacgaggucaggagauggagaccauccuggcuaacggugaaaccccaucucuacuaaaaacacaaaaaauuagcugggcgugguggugggcgccugugucccagcuacuugggaggcugaggcaggagaauggcgugaaccugggagguggagauugcaguaacccaagaucgugccacugcacuccagccagaaggacagagugagacucugucucaaaaaaaaaaaaaaaaaaaaaaaaguaaauacaucuccauucucuuuauacauccuucgucucccuucuuggugguggcaauguuuucccucaucuccuccccaagaggcucugagucucuagcucaaggaaaauucucauacauaaagagacuucuuccucguauuuugacuuuucaguuaguaugacucauccaucucagccaagaugggaauuacuguuaaugccacacugucacggaacgcuacaacuggaagggaccacaggaaucacccagacagccccucuuguuuugcaaauaagggaacaggucuaaagggugagaucauuugugcagggucagaggucaaaggauuaucaaacuacuaagggucuacuuuucuaauuuuacaacucuugccaaguuauuuggcagagggaaaagaucuuugcuucaccuuaauucuuuuuaaauuagcaucucuugcucuugucugcuggccucacagguaccuaacagcuucuauuacaccugguguuugcauacuucaugguuuacaggaguguucaugggugcuaucucauuugagccucacuacaguagcaugagggaguugggccagguauuguagucuuuuuuuuuuuugagacagagucucacucuguugccuaggcuggagugcaguggcacaaucucagcucacugcaaccuccaccuccuggguugaagugauucuccugccucagccucccgaguaguugggauuacaggcaccugccaccaugcccagcuaauuuuuguauuuuuaguagggaugggguuuugccauguuggccaagcuggucucgaacuccugaccucagaugaucugccugccucagccucccaaagugcugggauuacaggcaugagccacugcguccagccuguaaucuucauuucuagaugaacacguugaggcuucggggauuaagcaaccugccccaaaucacauauucaccaaguagcagaggcaggacuccaguccagaccuucugaccuugagccugggaagcuuguccacugcuccuugguguucacaccacaacagacacguucuggaaaccacuuuagcccugugccuucucccaaggcaggaaacuaagaguuaaaggucugcccucuggacacucagacuugccugccccauacgacuuaacaggcaaaucaggccaacguaacuugccuaaagagagcuuagcauugaaaucaggacaacucccuugcauagggagaguuuugcauugaaaucagucuucccauaaagccaguaauuaccccauacuuuguaugucuuacaggauuuucuuacuauggucugacuaaacucauuuagggcaugaaaauggcuuuuuaaaaauagauaccagguguacaugguauaagauuuaaaaguugcaaaaguaauuucccaguuacccuccuccaaggcaaucacuaguaucagguuuuuuuuuguuuucuuaggaagccauuaaauacacacaaucgcauauaagcauaguaucccacacucauuuaauauauuuuggagaugguucuacaucagggcacagaguuguaaguugucccuuuuucuuuuuuuucuuuuuuucuaagauagggucuuguucuguugcccaggcuggagugcaguggcagaaucacagcucacugcagccucaaccuccugggcucaagcaaucuucccaccucagccuccugaauagcugagauuacaggcaugugccacuaugccuggcuaauauuuuacuuuuuuuuuuuuuuuuuuguacagacagggucucacuauguugcccaggcuggucucaagcaauccuccggcuucagccucccaaggugcugggauuacaggcgugagccacugcacccagacuuugccucacuauuuuuaaugacuggacauuauuucauuacacagauguacugaaacaguauuacuuaauaacauaauuauuuaaucagucccccaucugacuuuuguuucuuuuugccauuacaaauauugcuauaaugaauauccuuguauauaaaucauuucauaaaugugugaggguaucccuaagauaaauacuuaaaaguggaguugcugggucaaagaguauauacugccaaauagcccuacauagagacuguaccuuuuacacucgcaccagcagugugagcgugcauuuccccaugccuuucccaacucauguguccuucacaccuuguaucauauuggcacaggguacccacucaauaaauacacauuaacugcuuauacaaggccuccuacauuaauuccaggaucauuucaaaauugggcccuucccacuaucucuuaacaauaaaauugaggccaaagaaaggaauaaaggccgggcgccguggcucaagccuguaaucccagcacuuugggaggccgaggcagguggaucguaaggucaggaguucaagaccagccuggccaacauggugaaacccugucucuacuaaaaauacaaaaaauuagccgggcgugguagcgggagccuauaaucucagcuacuccagaggcugaggcaagagaaucgcuugaacccaggaggcggagguuauggugacccaagaucgcuccaagccgagaucgugccauugcacuccaaccugggcaacaagagcaaaacucugccccaccccgcaaaaaaaaaaaaaaaaaagaaaaaagaauaaacuuccacuccagaagugucagccagcaaacagcauuucuuuaaccacuggugugugccuagccaugcuccagccaagcuaauuuucauuugugccuuuggaacuggcagcacauuuuguaggggcaaggaaugcagaggcugggguacccgcagauaagaccgaggcugggcaaagucucaggaacacucaaacgugacaggcaaaaucaguaagcucagccuuucuaauagacaaggcagacuugaaaaagcaaguccagccagguugacccaucuaccggcuccuuaaagauguaucacucaggaacagguguuuacuggccacuaaacuacauuuagaacaaccaacugacuaaggagagcugacagugaucguggagaccgcaguucaaaccccagguuuauaaaugaggauccugaggccugagaugcuaaaugggcaacuggccccaggucugaccuaacugagcagaauccaggggugggugguugucaccuggucaaccuaacacaaauuagauuucaagcuagacuuuccuacugcaauuucuaucacuuaaaaauucauuaaauauuaggaauuacuuuggaaacugacccuuagagaacuguugugugcuauucaagucuguaaccaaauuaauggccuaugaaauuguuaugagaaaauugcccaaugucugaccuguacucuguuucuuuuuuuuuugagacagaguuucacucuuguugcccaggcuggagugcaauggcgugaucucagcucaccgcaaccgccgccucccggguucaagcgauucucuugccucagccucccaaguagcuuggauuacaggcaugcgccaccaugccuggccaauuuugcauuuuuaguagagacaggguuucuccauguuggucaggcuggucucgaucuccucaccuuaggugauccgccugccugggccucccaaagugcuggcauuacaggcaugagccaccgccucuggccucuguacucuuuuuuuuauuuuucagaggacuuuccuucuccaacccacaagcucugaauauugugugguucuguaagacugugccuuugcucucaauacuauaggaauaagagccucccaguucucagcccuuucaggcagaucauguccccugcccagccuccagcauuacauuaucaagcgcaaaccuggcucaaaauuagcgugggccccuaaaaacugccaaaacaggcaugauggcucacaccuguuaucccagcacuuugggggaccaagguaggaggaccacuugagcccaggaguuuugauaucagccuggccaacauggaagacgcagucucuacaaaagagaaaaaaaaaaauagccaggcgugguggcgcguaccuguggccccggcuacucagaagguugaggcaugaggauccuggagcccaggagguugaggcugcagugaaccauguuucugccacuauacuacagccuaggccacagcaauacccggucuccauaaauaaauaaauaaauaaauaaauaaauaaggcauuuucuucacuccggaucugguagaaguucucugcagcucugaugucugcuauguuuccaaguaaaaccaggauccaaggcaaaggcuauaaagccacugggauccaguccccaucugggaggaggucagucauuuuauuguagccucuggccuuggucuuaucacuugcaaaauguuggagcuggauuaggugacccccaagauccuuuccucuaaauaccucugauucuaugaaguccauaagucugaaaauaaugauuuuuuuuaaauaggcuacuugcagcuaaagcagcacuaauagaaauauaaugcaauccacauggguaauuuuaaauuuuuuaguagccuagccucaccaacaaaaaaauaaacaagugaauuuaauuuuaacaauauauuuauuuaacccaauauauccaaaauuauuuuaacaugcaaccaaaauaagaaaauuauuaacgaggugacaaaacacaauacacacuacaagaaaucuuacccagcaugguaacacgaaauguagucuugccaacacuacaagguauauuuaacagaaaaauauuuuauacuauuucuguuuuaaaauuuaaaucaaaauuuaacgaaauuaaaaauucaguuccuugguugcaugagccaaauuucaagcaugagggacagugcaguauaaaccuacaaugugguccuccacacuccuuaggggugacuuugacggaaccaaacucuucgguuuugcaaauuaccuccuaaagauacacugaaaucaaugggaaaauucacccuuccaaaauaccugagacaguauuuguacuguuagcaauuauuuguaaaagcuacucaauaaccugaaagaacuggugugagucugaauuacuaggaaggcucaugauggcuaaauggaucauuuugauguuauucaacaauguuauggugcagaugcuauucaauuaccaugauuauugcaaaggucaucugaagaauggauagaagugagaggccuuaggugcugggaggguacuaccuguuccaacuaaggauauaaauuaacccggaguucagaaauuguauuucaacugcuuucacauguaugaacccacuaaauaauuauguugggguaguguuuaccugguaagcuuucauauuaagaucugagaaugaaagaucucagugucaagauucuaagcccagauaaagacaaguaugauauagucuaaguaguaacauaauggccaccauuuaucuuguacuuucuaugugcucaacacucuuccaaccacuuguccccaugaccuccuucauaugcacaccaauccacccagguggguaguaguaugaucauuaccauuuuggaguaaggaaacaaaaacagagagguuaaguacuuuugccugaagacaucgccccaucugauaaauggugacagugagauccaacucagguuuaucuuaaagaaccagaguuccuauccacucgaggcuuccucagggaggcugcacagugcgaugugcuuaggaagccagggggugccagguggggccucugcugcuaccuagcugcguggguaacuguggccuagccaccgaaccucccugugcuguuccugcaauggaaggccaagaugauaccagcccuuacggaaaaguuuuccauaugaaaaacaaaggauguaaaugccccuuaaaaauaucggacaacccaaggauguccaaggaugagguauuaguacuauuaauaaauucagcuccuguugcaaaugccaaaugaccaugagaagcaucuaccuuuuaggguucugggucuaaccaguaaauaaaagaauagaagaugaggccauuacuuguuuauguaucagcugugcauggcaacaacaaaggugguaaaaauguaaaacguucggcugucaucucccucaagggucuuagauuuucuuucccuucacagcucuggccaaauuuaguugggguaguuauuacaaaagaagugucuuaaagccuuuaaaggguuacgaagauggcaaaaggacaaagccacccaggccagcucaguuccuguuuggauuuagccuuccacugaugcauucccacuuucuacaaacucucucugucccuagaccuugccuauggacacuggguuucuaggcccagaaccucagaguaagaaaugcugccacaagugaagggcugagucuggaaaggaauccuaugagaugguuuaacaauccucauaaguacaaggaauccagcagacaggcuggagggucuuccagaggagccggggcaacguguggggccucugccauucuagggcacacaccaggccugcuaugggguugguuuucugucucagaagaccucagucuccacaacaaccaggaccucacacaaggacaagaagaccaaggagaaugagagguuuauagcaaacagcaaaaaagggcgugaguguuuacacuggaacucgagggauuuuugccaggcgugguggcucaugccuguaaucccagcacuuugggaggccgaggugggcggaucacgaggucaggaguucgagaccauccuggcuaacacggugaaacuccgucucuacuaaaaauacaaaaaaauuagccaggcgugguggcccgugccuguagucccagcuacucaggaggcugaggcagaagaauggcgugaacccgggaggcggagcuugcagugagccgagaucacaccaguccagccugggcgacagagugagacucugucucaaaaaaaaaaaaaaaaagggauuuuuuucaagaagaaauggaaugaugaaaaugaucacaaccaccauuugcugaaggugugccaugugcuauuuccugugcccaguucacuuuguuaauucuaggaagaugaugucacaguaacaucaaucuaaagaugaugaaacggaaacacacccuauugugaaaucuaaugacauaaccucucuuugccucaguucuucaccuacaaaacaggaagaauacuccucaccucacagggcguaguaaggauugcaaagggcagaagaguuugucagagcacuuuguaccgugcccaguguugcagagaguccaacggacugcagcuguuguuaacagcauugcuagauguccacaucugucugcuuggggcucacaggaaaagcucauaggagagaaaagagaggaaauuguuuuuucuugucuugggcaaauauugcuaaucauuguaauuggaagcaaggaucagacuguuagaauuuacuaaaaauaguaaaucaaucuaagagaggggcaaaaagagagaaacucucucugugccaccuugaggaagaaaugaauccauucuuuaagcaaaauggcaacuucuggcuaguuuuuccuccccuuucaucagugaccacacugguggaugaguauuuuuaaagcacaggaacagcggagcaugcaagcuugagcacaauccacuucccuccuuaaaaacggaggcucuaaaaaguuauuuuuacaugucuaacaaggauacaauuuagaguuacaaugacagauccucaaucugugugcugaugucaaaccaacuaagccgucacaacaaugcucagaccuacaccuuggcaggagcccgcucaccaucucccugccuccaaccuguccaucuuccaauucaccugccacaguaacuuccuauccacauccaguuuaccugcccugcccuuuccagaaucuucuuccaugguuuccagaugcccuguacaaacuugaaacagugcacaugagcacugaaggcccucuauggcaacccccaaguuaaccuugucagccccacuggcccaauagucugucauaguccagcucauaucugcaccauugcuugggcuuccagcugaagccugaaccaaacaaaaucuaccugcuuaaaagaaaagucuaguuaaaauggcaguuccuccaggauauccucucugagcaccccaguuagaagucacauuuucucaucugcacugucacagcauugucauguaucacagacuaguuuauauuaaauaucaagcuccuagagggcaguuaauggacucacccucaaacugacugagcaacuauuacguaagcaccaggcauggcgcuagacaucagaauuacacaaaagauuaaaauacagucuuagaggaacucauauccuaagcagaggagacacagaggagcaauuugaaaaacaaaugucccucaagggggauacgugcugcauuaucuuggaagauuaaaacagcuucaugcccugaaagauuccuaggguguguagauaccuaauaaauauuugcggaaugaguacguguauauuauuuagacuaacaauucaguauuuucauugucuaccuaagauauaugggguuagaguucaaauuacuuaaguaacaaagauaccauguuuuauaucauauaugucccaacuacuagucauagaaaaauuauuuaacaucauucccauuaacaauacuucuaaauuauuucuuggauaugcuaccggaaauaaaguacgauaucuuaagaacuauuaacacucaccccuucaaauaaacaauacaauagauuguaagagaacaaaugugauaauaucuucaaauauccuuuaaagaauuuugcaauguggacaauauaacaaucaaucaacugcugauuaagugaauuuucuuagcggauucuaguuacuucccucaggcugauggucagaaaaaggaugagaagugggcaaacuuacuuuccccccuuuacucuccuaucucaguauucagacuucuucaaaaagugcccagcagaaaagguggcuaagccccagagagauaugacauauaugauuuuaacuucaucuccuugaaaauuaaaauaguaacaauguuuaguuuauccuuuuguuaccaauuccuugcagcuguagguccgagaaauggccaacuucagcaguaacaauuaccauauuaaauguugcucugugugaagggaucuggacaagucacucuaccugcauaaauaaaauauacccagacucuaccuuuguggcacuuucauuauauucgaugaccucugucccaucaccugcuucagguuaggauaaaagguauaaacaagcugccaccuggugagauggcaggcuucccuacaaaaaacaagaaaguaauauucugccauuuccuaagaacaagcagcaauguccuggcuucaaauggucucuagaaguccaugcaccaccgugcuuccacuggggcgguuguaucacccaggagcauuaggaauuguauggaggugggguggggcacuuucugcuugucacagcgauccguggaacaggacucugcuccaaagagaaguccagccccaugcgucaacagcgcccccacugguccacauggaaggaacuccuuaaguagcgacacuguccuaucaaucuuuauaaaggagucccucauucuuuagcagcugacagaaugucuguaggucauuagacaaugaaaaaagaaagaagagagggaaggaguaaaacaagcagagaauagggauuauggacagucaaaaucccaguucugcuaccugcaagcaguguuguccuggccaaauggcuuaaccucuuugaaaauauucauuacuuuucccuuuucuuccccauaaucuugccaguucugucuguauucagaugucuccuaacuccaaagucuggcucuuuucacaccauaggaagugagcugguaacaugaaugaagaugaaagacuaauuguuuccucagucuccauuacugcacaauuuacagcacaauuguacuguuaucaagugaacuuuggaaaccuguagcacagagcaagagccgcauacucccggggacccagacuuccaagaguccugcagaggcagaagggagggagaugaaugagcuucuaucuaggcgagucaugucuacccgcaucucucugaggaggaaagacuuuacuucucaggaucaacgagaagagauaugagcuucccccaacuuuucuuaagauacauucccccuccuuccugauccucccaccaaggguggccccuggaucacaguuuggaagucacugcccuaaggauuucaccaaacaggcagugugguaaagaaguuucuaacagagggugaagugcugucucuggaggauaagauacaaccugcacccacaggaugauucucauucuugguucuggucucugcuugggaaccagcaggagaagaacauguggguuggcgagugggggcacugcagcugacacaaaguaaaccagcccuguuccaguccacuaggguugauuuuucuuuuuuucauugagacaugaucuuacucuguugccugggcuggaguacaguggcaugauuauggcucacugcaccuucaaacuccugggcucaagcuauucuuccaccuuagccucccaaauagcuacaauugcaggugugcaccacuggauccagcuaauuuuuuuaauuuuuugaggagacagugucucaauauguugcccaggcucaucucaaacuccuggucucuagugauccucccaccuugacuucccaaaguguugggauuacuggugugagccacugcaccuggccuacgguuguuuuuucuauguguauuuuaauuaugucucauugagaaucaucaagaauaaaaauaacuugaaaaauuggcaaguuuuccuauugcaaguaaaaaacucucauuuuuuaaggaaaaugagaguuuuuuacuugccagaggaagucacuaccaggaauuuuaaugguuaaaaaaauuauuuucuuuuugcgaaauauucaugguucuucaacacucucuagacacaacagcaaggcucccuggccccaguacugcaaaacaaaccaaaaaaaaaguacagguccuuagucagcccucaaacaccucaagaagagguauauaauuccaucaugcaucauaccucugugccuguuaccuucacaaaaggcaacaaagaacuauagucauucuucccucuauucuagucccucaggcagggaauagguuggguuuuacauccaugugcaguauuauaauuuuaugcggaagcagagcagacaagagauugucaggucugaaauaaagcaaaauucuauaugccuuaacagugggcccccuaaauacacagucaauauuguccucauauuaaggucauuucuuucacacagacauugaagguacuaaucuacucugaaugucagcuacauucuugcaaaaaaaaaaaaaaaaaaaaaggaaaggacauugaaugagaaaaugcaagaaguguauguugcauagagccuaaaucuuaacugaaguccuucuguuuugagguacuugaaucacauuauguacaccauucaauacgaaacuccuaaguaaaauaacaggauaccauuuucaaaaucuuaaagcaacaaacuacugaugacuagaauuagaaaagcaugcuuccagaaaggugacuaaauacacccccccaacacaaaggggcaacggucaaagacaagacuggaauugggccuugcgagcucugccuggcaaccuuggcuguggaggccacaguggacagaguuacccacucucuucugggcuuguucccaccaucugugggguggguguauagggcuggggcuaagccagcuucagaagccccccaaccaccaccacaccaucaagucucucaagugggacugcugugcuguggcacgcacacccacacacaaguugccaacaguuuggaaguuagccccaguuuccaaauaugucaacccaaaagccauucagguaaauauaagugggagccacuacaaagugggacuuuaucaggcagauacagagaaccaaaaaaugaaguugcugaaagcugcuguggagauuuaagucuuuuguuuuuaacggaggaagauaaugaggcccaggaacacagcuuccuagaguaagacaguguuccguccuggccuccaggauguucaacaccuaucccaagcuucugagcauucuguccucacuggcuucucucagugcuauuuccaaauaaucuagauugcaaguuaucacaggccacauuccugaaaaaacacagagcaauccugcugacccacuucagggaagcccuuucauaacaaaguuacccaaaucuucuggagggguuuaaugagcccagguuauauauauuuagugaguuucaaacacucgccaggcacuuugaaacacaguuccugaauguagguguuaacuguaaggcugugaagggcaaugaucaaagacaaaagcacuugcuuucaugauuuaaauaagacauccuaaccagauuuucuaaaucacuauauacuucaauggauaccaagcacugagguggguccccuagggcagggguccccaccugcuggcugcggaggggucaguggcccauuaggaaccaggccgcacagcaggaggugagcaguaggcgagcauucccgccugagcuccaccuccugucagauuagcagcagcauuaguuuaucagagaagccggaacccuguuguaaacugaguaugcaagggauguagguugccagcuccuuaggacaaucuaaugccugaugaucugagguggaacaguuucauccugaaaccauccucuaccuccuucuauggaaaaacugucuuccacaaaacuagucccuggugcuaaaaagguuguggacugcugcccuagggcacuggcucucaaaccugacugcucguuagaauccccucagaaucuuuaaaaaauagugaugccugggccccacccccagagauuuugauuucaugagggauauggccugggcauuaguuuuuuaaauacugauggugagucuaauauacaacaguuugagaaccacugcuguaagaaacaaacagaaacauaaaaaguggaaacaacucaaaugaucaucaacuggauaaauaaaaugugguauagccauacaauggaauaguaugcagccauaaaaaggaaugacgcuauugauauacguugcaacauuuuuaaaccuugaaaacauauugcugugaaagaagccagcaacagaaggauaaauacuguaugauuccauuuacaugcuauuccauuuacaugauauguccagaauaggcaaauccauagguacagaaaauaacugaguaguuaccaggggccaggagaguugaggggaaaugggaagugacugcuaauggauaugggguuucuuuugaggguguugaaaauugauuacagugaugguugcauaacucuaugaauaaacuacuaaauucauaggguugcauaacccugaauuagauuaaauggguaaauuguaagguacguaaauuguaucuuacuuuaaaauacauauauaucuauaaauucuaucuacuauagaggaaaaaaaaacagauacauaaguaagacaaguaucaacagagauuuaaaaugccauuagagaggaucaccuaaguaauacagaagguaaacacuauaaacucagaggaggcaucaaagccuaagugauccauauuuuucuuuucuuacucauuuuucuucucugauuugaaaaagcaauagaguucagagcuugucaguguacagcugauaauacaggcccuaaagucucaguucucaccuuauuuggaauggcuauuuagcauugucuuagaauuaaaaacaaauauucagaauacaggcuguugauggacuguaaugacucucaagagucaauuaucaacagagccuuugaaagauggacuuggaggucaggcgcaguggcucacgccuauaaucccagcacuuucggagaccaaggugggcacaucaccugaggucgggaucagccuggccaacauagugaaacuccaucucuacuaaaaauacaaaaauuaaccgggcguggcggcacacacuuguaaucccagcuacuugggaggcugaggcaggagaaucgcuugaacucgggagguggagggugcagugagcccagacuguaccaaugcacuccagccugggugaccgacugagacucugucucaaaaaaaaaagacgaacuuggugcuguaaguccuacuuaugcccuggacuugucuuuacuaguaccagcaguuuggaccaaauaaacuuacaugcucaaauacacaaaaagacuuuuaaauaccaggauuugcaacacacagguauuauaguacauaugccguaaaaacgaaugauuaaacgugccuccccuacucaaaguucuuaauauacuuaauaaucauaguuaagaguuauuuauuauggcagaaacugacacacagaaggcucaaacuuuagguagcacaggauuuuguuuaacagucuuguuuucaugucuaggguauagucugguacaagaaauccaucuaggccaggcgcgguggcuuaagcuuguaaucccagcacuuugggaggcugaggcaggcggaucaugaggucaggagaucgagaucauccuggcuaacacagugaaaccccaucucuacuaaaaauacaaaaaauuagccaggcgugguggcgggugccuguaguaccagcuacucgggaggcuggggcaggagaauggcgugaacccgggagguggagcuugcagugagcggagaucaugccacugcacuccagccugggcgacagagcaagacugcgucucaaaaaaaaaagccaucuguauuucuccaaguuucugaauguuaauauuuaauauuauacacuugaacauauuuuugcuuucauuuacagaaaacauaccauuagcaauugaauaaaucuuggccuauaccuuaaagcccuuuuaauaaauguuuguuggcgcuuauuuaaaagcagguagcagugaaauuucaauagcuccuagaaauuagaugaucaaagaauaaacucuauucucuauuuguggcaaacuuauaaugaauauacauuucuacagucagagaugaagacaagcagguuaaaaaugacaucuaguaaacuuguccuccucuacccugcugugcaacauauuucagucaacuuucagaaaguggcuggaccaagcauuuaaaugcccugagguugaccuggaccaacuuuuaggcaaaucauccaucagauccuauaaguccugcagcacacuuaauucagacaaauaagacaauaauuccaaaaacaacuuaacaauaaggacuaagaaaguguuuaauuuugagauguacuauucucaaagacccaaguaagcuucaacuagauaagaguugagcccuuaugcuugcuauaguucagaagugccaaaacaugagauuaggguugaauuugcgccaucagcuuucugcuagcuguuuucaacucaaauuuuccccauucugcucucuuuccuucagccugguuuaacccugucugucacacucuucaccauauucuuacuaccaaacuuauuuuugagcacuacuucaaaacaaaaagagccaauggaacagaagaaauguaccaaguagcaaggcaaacaaaggcaaagacuccaguagcuaagagauuuaauuaagaaaaaaggcaguuucugaaaaaugugaggcagaaucuuggacauugccaaacaucagaaauuuuuaaaacuauuauuauauuaagaaacagacuggcgcaguggcucacaccuguaaucccaacacuuugggaggccgaggcggguggaucaccugaggucaggaguucgagaccagcccagccuggccaacaugguaaaaccccaucucuacuaaaaauacaaaaauuagccgggcagugggugccuauaaucccagcuacucgggaggcugaagcaggagaaucacuugaacccgggaaguagaggcugcagugagccaagaucaggccacugcauuccagccugggcaacagaacaagacuucaucucaaaaaaaaaaaaaaacaaaaaacaaaaaacaguccugccuuucuaaauugaauccaccgaggccucugugucuuccuuaaaaggaccacaguggguaccauugauggauuguauucacucucccuguauuuaacaagguccaccuccccacgucacauacagugauuaaaugucuugcuaaauggaaaagcugcagacauuaaucuuuuauauuccggccucuccuucccccagaauaggcaaaucucaacuuacccacuuuuuaaagugugagcuuuucuuccuauuuagaguuuaaggaguuuugguacagucuggaaguggugauuagaagcccccaggagucaaaccuguuugaaugcuaccuuggccacucaauaguauggucaccuuagcagguccuggccuuucucuaugccucucuccuaaccuuuccuaaccuaaugccugaucuaacuauuaugccugguuuucccaaccuggaaaccagggauaauaauauuucccgugagguuacuguaaaauuaugcaugugaagcaauuaugucuggcacccagggacgugcccaguaacuuaucuauuauuaucuuagugccaaauucuuccugcauacugaaaaguuaacccaggcuugaggaacaguuaaggaggaaauauugacacaaaacccccuuuaaaugucuucagucaggacagaggaaauucccagaaaaaaaaauguacuuguuggguuccuuuuuuucaugcagcuuuguuaaacaugauuuauccucaauaaaaacaaauauuaagaaaaaugaugcauuuggcuuucaacuuuuccugguaauccuaaagacagagucaguuuuccccccaacauugcuuauaagaacccagggcaagaaagaaagauuucaaaauggcccaaguuauuuuuaaugcguaaaagacugaugugaguuaugcauuuauccuccuacaugcugcuuccacaaccucucaagagauuuuucacauaucuaaaaagucaaguuguucuuugcuuaacauucauucaggagaugagaggccuguccuauuuuucuuuuguuugacuuaaaaauaaucucaucggucuauuucaauaucaacuucaucccucaucuaggaaagugcuuuaucucuccaagacacccuugaaaagaguaauggaugguuccuuccaccuaauggagauacugaaucuaaggcucuccuuacugcccuguuuaucaacacauccucugcacagaaggugaaaaacuauauccuacuaccacuucacaccuggagaguuuuuuuugacaaaaggucaagaaaauguuugacucuguucaaaucuuuauggaugacaacaaucuaauaugaaucauaaacaaaaucaauucuaaauuuucuuguucuuuuucuguuuucaaauaugcaaaucgaugucugauuacaaagguagaaaagcaguuauuuuuaucaaacguaauuggaaaauacacacuuaaugcgguacauauguuucacgcauuuuuguauaaggaauguuauauuacacagcaaagaaagaaaaauucaaaaauaauagagggcuguagacaauuccggaaaucagaaaaacuaaaguucauuuuuaucauauauccuucagucaaacaagcauuccuauagauaacucuugaacagcagcuauuaaauaaaucggaagguacaauuuaauucuucacuaguuggaaccagaagaauacaaucccaaugaagacuggggaaaaguucaagacaaacaacuuuaaagggggaaaaaagcacaauuaauacauuguccauaacuuaaaacuuuacaauagaucuuuggaauuaaccgaaaacuuuacauuuaacagcauaaacguauuuacuguacaucaaguacacauuuccuugaauuccaauuuuuuuccuaaaauucauuuacaaaagaaguuagaaauauaaauaucuacuuuuaaaguuucuacaaaggaugagcagaaacuucuuuucacuuuuauaacaauucacagaaauuagcaaguguuuugaaacgcaagcguuccacucucugccccugcagaagagggggaacauguuaagaaauugaggcaaauucucaacugaaaaggaaacauauauaaaguacucaggggagaaauaauagcugaaagcaaaaaauuacuaacagacuaaaagcaacagaaauucuaaucuacacucgcaacucuuacccuugacagcacagaagagaauaucccgucuuacacauuuuggaauugcaauucugaaacgcuaaauccaaagacaaagccgcucuggggaaaauagcaauugcgcaacagaucaacagcuccaaccugucccuuggcccuggcgcggcgagguuugcacgcuauaaagcaggaaagggccaaccgagggcugcugugacggccaaccgagcgcugucacggaagccaaggccacgcgcgcggugagcgccaccagggggcaccgcguccgaacuagaagccccgggugccgccgacuccggccucagaguccacugcccucgcccgcacuuucccgcggcguuacgaggggccaacuccgggugcccgagcccgaaccccuccccggccgagaaagugcgcggggcccggcucagccgccacacgucggggcuucugagcccgcugggcacuuaaggcgcuccucccucgucccggggcugggcuuucaagagagcucaaggcugccagagagugauccgagagauggaugacuucgcaaagccgcgcccacagacggcccagcggggugagcgcgucgcagcccgcacucaaggaggucuuggggcgcggcgaaggggcuccgggucccagcccgaaggcgaccucaguucccccgagagcggccccgugacuaggcacauuuuugccggcaccgaggcgggggagccgcgcagccccggaagggccgggccgcgccggcucagacggccagcguccgcccccucuugccccgccgcccaccgggccgcucaaacuuaggggcuccggagucccagcucucgggcccggggacgcggcuggauucucccccaaggcccacgcgagcgggcucaguccccagaccuucccgcaacuucccacccguucgcccucgggcucguggucggucggaucacccggccgcguccccgcugccccuccccgcccugccccggcgcaagcgcggcggcucuacccagcgccgcgguccuggcucuggccagacgugggggaagccgguugcggcugucccucccgggccgcgguucccuagcucccccgcccccgucccggcaccaccgcagggcccagagggccgaggcagcaccugcugggacgggagucccggcggcggcagcuccaaguccaucaugaugagcuguggaccguguguuggggcuccccgacggcggcccuguuccggcugccgaggcgcggcgcggacagggcggcucugguggcggcggcggcggcgguggcggcugcgucggcggcuccuccgggcuccccggcacucgguaaucggcuacacgccggcgggccccugccccgcuccgccucccgccccacaagggcggggcaagaguccgggcccuuccuucccccgccggccgcgcgggcugagcuuccgaaaaucccccacccgcgccggggcugacgcaagaagcucgcgguccgggggcgggaagggacugccagcuggggucccagcaggcgggggaccuagaggaggucuccguuagcuccccggugccggcguucaguuugcccucccccgcaaauaagggcagcgcucucgcccgcgagauaaagaguuguuugcgaaggucgcuggaguucggacgcuuugaaacaguuuaaacaguuggaacaaacacacccggagccccggaaaggcguugguguaggagcugcgccucccugauuu

SEQ ID NO: 192921 - RNA, 34827 nt, Homo sapiens
aaaucagggaggcgcagcuccuacaccaacgccuuuccggggcuccggguguguuuguuccaacuguuuaaacuguuucaaagcguccgaacuccagcgaccuucgcaaacaacucuuuaucucgcgggcgagagcgcugcccuuauuugcgggggagggcaaacugaacgccggcaccggggagcuaacggagaccuccucuaggucccccgccugcugggaccccagcuggcagucccuucccgcccccggaccgcgagcuucuugcgucagccccggcgcgggugggggauuuucggaagcucagcccgcgcggccggcgggggaaggaagggcccggacucuugccccgcccuuguggggcgggaggcggagcggggcaggggcccgccggcguguagccgauuaccgagugccggggagcccggaggagccgccgacgcagccgccaccgccgccgccgccgccaccagagccgcccuguccgcgccgcgccucggcagccggaacagggccgccgucggggagccccaacacacgguccacagcucaucaugauggacuuggagcugccgccgccgggacucccgucccagcaggugcugccucggcccucugggcccugcgguggugccgggacgggggcgggggagcuagggaaccgcggcccgggagggacagccgcaaccggcuucccccacgucuggccagagccaggaccgcggcgcuggguagagccgccgcgcuugcgccggggcagggcggggaggggcagcggggacgcggccgggugauccgaccgaccacgagcccgagggcgaacgggugggaaguugcgggaaggucuggggacugagcccgcucgcgugggccuugggggagaauccagccgcguccccgggcccgagagcugggacuccggagccccuaaguuugagcggcccggugggcggcggggcaagagggggcggacgcuggccgucugagccggcgcggcccggcccuuccggggcugcgcggcucccccgccucggugccggcaaaaaugugccuagucacggggccgcucucgggggaacugaggucgccuucgggcugggacccggagccccuucgccgcgccccaagaccuccuugagugcgggcugcgacgcgcucaccccgcugggccgucugugggcgcggcuuugcgaagucauccaucucucggaucacucucuggcagccuugagcucucuugaaagcccagccccgggacgagggaggagcgccuuaagugcccagcgggcucagaagccccgacguguggcggcugagccgggccccgcgcacuuucucggccggggagggguucgggcucgggcacccggaguuggccccucguaacgccgcgggaaagugcgggcgagggcaguggacucugaggccggagucggcggcacccggggcuucuaguucggacgcggugcccccugguggcgcucaccgcgcgcguggccuuggcuuccgugacagcgcucgguuggccgucacagcagcccucgguuggcccuuuccugcuuuauagcgugcaaaccucgccgcgccagggccaagggacagguuggagcuguugaucuguugcgcaauugcuauuuuccccagagcggcuuugucuuuggauuuagcguuucagaauugcaauuccaaaauguguaagacgggauauucucuucugugcugucaaggguaagaguugcgaguguagauuagaauuucuguugcuuuuagucuguuaguaauuuuuugcuuucagcuauuauuucuccccugaguacuuuauauauguuuccuuuucaguugagaauuugccucaauuucuuaacauguucccccucuucugcaggggcagagaguggaacgcuugcguuucaaaacacuugcuaauuucugugaauuguuauaaaagugaaaagaaguuucugcucauccuuuguagaaacuuuaaaaguagauauuuauauuucuaacuucuuuuguaaaugaauuuuaggaaaaaaauuggaauucaaggaaauguguacuugauguacaguaaauacguuuaugcuguuaaauguaaaguuuucgguuaauuccaaagaucuauuguaaaguuuuaaguuauggacaauguauuaauugugcuuuuuucccccuuuaaaguuguuugucuugaacuuuuccccagucuucauugggauuguauucuucugguuccaacuagugaagaauuaaauuguaccuuccgauuuauuuaauagcugcuguucaagaguuaucuauaggaaugcuuguuugacugaaggauauaugauaaaaaugaacuuuaguuuuucugauuuccggaauugucuacagcccucuauuauuuuugaauuuuucuuucuuugcuguguaauauaacauuccuuauacaaaaaugcgugaaacauauguaccgcauuaaguguguauuuuccaauuacguuugauaaaaauaacugcuuuucuaccuuuguaaucagacaucgauuugcauauuugaaaacagaaaaagaacaagaaaauuuagaauugauuuuguuuaugauucauauuagauuguugucauccauaaagauuugaacagagucaaacauuuucuugaccuuuugucaaaaaaaacucuccaggugugaagugguaguaggauauaguuuuucaccuucugugcagaggauguguugauaaacagggcaguaaggagagccuuagauucaguaucuccauuagguggaaggaaccauccauuacucuuuucaagggugucuuggagagauaaagcacuuuccuagaugagggaugaaguugauauugaaauagaccgaugagauuauuuuuaagucaaacaaaagaaaaauaggacaggccucucaucuccugaaugaauguuaagcaaagaacaacuugacuuuuuagauaugugaaaaaucucuugagagguuguggaagcagcauguaggaggauaaaugcauaacucacaucagucuuuuacgcauuaaaaauaacuugggccauuuugaaaucuuucuuucuugcccuggguucuuauaagcaauguuggggggaaaacugacucugucuuuaggauuaccaggaaaaguugaaagccaaaugcaucauuuuucuuaauauuuguuuuuauugaggauaaaucauguuuaacaaagcugcaugaaaaaaaggaacccaacaaguacauuuuuuuuucugggaauuuccucuguccugacugaagacauuuaaaggggguuuugugucaauauuuccuccuuaacuguuccucaagccuggguuaacuuuucaguaugcaggaagaauuuggcacuaagauaauaauagauaaguuacugggcacgucccugggugccagacauaauugcuucacaugcauaauuuuacaguaaccucacgggaaauauuauuaucccugguuuccagguugggaaaaccaggcauaauaguuagaucaggcauuagguuaggaaagguuaggagagaggcauagagaaaggccaggaccugcuaaggugaccauacuauugaguggccaagguagcauucaaacagguuugacuccugggggcuucuaaucaccacuuccagacuguaccaaaacuccuuaaacucuaaauaggaagaaaagcucacacuuuaaaaaguggguaaguugagauuugccuauucugggggaaggagaggccggaauauaaaagauuaaugucugcagcuuuuccauuuagcaagacauuuaaucacuguaugugacguggggagguggaccuuguuaaauacagggagagugaauacaauccaucaaugguacccacugugguccuuuuaaggaagacacagaggccucgguggauucaauuuagaaaggcaggacuguuuuuuguuuuuuguuuuuuuuuuuuuuugagaugaagucuuguucuguugcccaggcuggaaugcaguggccugaucuuggcucacugcagccucuacuucccggguucaagugauucuccugcuucagccucccgaguagcugggauuauaggcacccacugcccggcuaauuuuuguauuuuuaguagagaugggguuuuaccauguuggccaggcugggcuggucucgaacuccugaccucaggugauccacccgccucggccucccaaaguguugggauuacaggugugagccacugcgccagucuguuucuuaauauaauaauaguuuuaaaaauuucugauguuuggcaauguccaagauucugccucacauuuuucagaaacugccuuuuuucuuaauuaaaucucuuagcuacuggagucuuugccuuuguuugccuugcuacuugguacauuucuucuguuccauuggcucuuuuuguuuugaaguagugcucaaaaauaaguuugguaguaagaauauggugaagagugugacagacaggguuaaaccaggcugaaggaaagagagcagaauggggaaaauuugaguugaaaacagcuagcagaaagcugauggcgcaaauucaacccuaaucucauguuuuggcacuucugaacuauagcaagcauaagggcucaacucuuaucuaguugaagcuuacuugggucuuugagaauaguacaucucaaaauuaaacacuuucuuaguccuuauuguuaaguuguuuuuggaauuauugucuuauuugucugaauuaagugugcugcaggacuuauaggaucugauggaugauuugccuaaaaguugguccaggucaaccucagggcauuuaaaugcuugguccagccacuuucugaaaguugacugaaauauguugcacagcaggguagaggaggacaaguuuacuagaugucauuuuuaaccugcuugucuucaucucugacuguagaaauguauauucauuauaaguuugccacaaauagagaauagaguuuauucuuugaucaucuaauuucuaggagcuauugaaauuucacugcuaccugcuuuuaaauaagcgccaacaaacauuuauuaaaagggcuuuaagguauaggccaagauuuauucaauugcuaaugguauguuuucuguaaaugaaagcaaaaauauguucaaguguauaauauuaaauauuaacauucagaaacuuggagaaauacagauggcuuuuuuuuuugagacgcagucuugcucugucgcccaggcuggagugcaguggcaugaucuccgcucacugcaagcuccaccucccggguucacgccauucuccugccccagccucccgaguagcugguacuacaggcacccgccaccacgccuggcuaauuuuuuguauuuuuaguagagaugggguuucacuguguuagccaggaugaucucgaucuccugaccucaugauccgccugccucagccucccaaagugcugggauuacaagcuuaagccaccgcgccuggccuagauggauuucuuguaccagacuauacccuagacaugaaaacaagacuguuaaacaaaauccugugcuaccuaaaguuugagccuucugugugucaguuucugccauaauaaauaacucuuaacuaugauuauuaaguauauuaagaacuuugaguaggggaggcacguuuaaucauucguuuuuacggcauauguacuauaauaccuguguguugcaaauccugguauuuaaaagucuuuuuguguauuugagcauguaaguuuauuugguccaaacugcugguacuaguaaagacaaguccagggcauaaguaggacuuacagcaccaaguucgucuuuuuuuuuugagacagagucucagucggucacccaggcuggagugcauugguacagucugggcucacugcacccuccaccucccgaguucaagcgauucuccugccucagccucccaaguagcugggauuacaagugugugccgccacgcccgguuaauuuuuguauuuuuaguagagauggaguuucacuauguuggccaggcugaucccgaccucaggugaugugcccaccuuggucuccgaaagugcugggauuauaggcgugagccacugcgccugaccuccaaguccaucuuucaaaggcucuguugauaauugacucuugagagucauuacaguccaucaacagccuguauucugaauauuuguuuuuaauucuaagacaaugcuaaauagccauuccaaauaaggugagaacugagacuuuagggccuguauuaucagcuguacacugacaagcucugaacucuauugcuuuuucaaaucagagaagaaaaaugaguaagaaaagaaaaauauggaucacuuaggcuuugaugccuccucugaguuuauaguguuuaccuucuguauuacuuaggugauccucucuaauggcauuuuaaaucucuguugauacuugucuuacuuauguaucuguuuuuuuuuccucuauaguagauagaauuuauagauauauauguauuuuaaaguaagauacaauuuacguaccuuacaauuuacccauuuaaucuaauucaggguuaugcaacccuaugaauuuaguaguuuauucauagaguuaugcaaccaucacuguaaucaauuuucaacacccucaaaagaaaccccauauccauuagcagucacuucccauuuccccucaacucuccuggccccugguaacuacucaguuauuuucuguaccuauggauuugccuauucuggacauaucauguaaauggaauagcauguaaauggaaucauacaguauuuauccuucuguugcuggcuucuuucacagcaauauguuuucaagguuuaaaaauguugcaacguauaucaauagcgucauuccuuuuuauggcugcauacuauuccauuguauggcuauaccacauuuuauuuauccaguugaugaucauuugaguuguuuccacuuuuuauguuucuguuuguuucuuacagcagugguucucaaacuguuguauauuagacucaccaucaguauuuaaaaaacuaaugcccaggccauaucccucaugaaaucaaaaucucuggggguggggcccaggcaucacuauuuuuuaaagauucugaggggauucuaacgagcagucagguuugagagccagugcccuagggcagcaguccacaaccuuuuuagcaccagggacuaguuuuguggaagacaguuuuuccauagaaggagguagaggaugguuucaggaugaaacuguuccaccucagaucaucaggcauuagauuguccuaaggagcuggcaaccuacaucccuugcauacucaguuuacaacaggguuccggcuucucugauaaacuaaugcugcugcuaaucugacaggagguggagcucaggcgggaaugcucgccuacugcucaccuccugcugugcggccugguuccuaaugggccacugaccccuccgcagccagcagguggggaccccugcccuaggggacccaccucagugcuugguauccauugaaguauauagugauuuagaaaaucugguuaggaugucuuauuuaaaucaugaaagcaagugcuuuugucuuugaucauugcccuucacagccuuacaguuaacaccuacauucaggaacuguguuucaaagugccuggcgaguguuugaaacucacuaaauauauauaaccugggcucauuaaaccccuccagaagauuuggguaacuuuguuaugaaagggcuucccugaagugggucagcaggauugcucuguguuuuuucaggaauguggccugugauaacuugcaaucuagauuauuuggaaauagcacugagagaagccagugaggacagaaugcucagaagcuugggauagguguugaacauccuggaggccaggacggaacacugucuuacucuaggaagcuguguuccugggccucauuaucuuccuccguuaaaaacaaaagacuuaaaucuccacagcagcuuucagcaacuucauuuuuugguucucuguaucugccugauaaagucccacuuuguaguggcucccacuuauauuuaccugaauggcuuuuggguugacauauuuggaaacuggggcuaacuuccaaacuguuggcaacuugugugugggugugcgugccacagcacagcagucccacuugagagacuugauggugugguggugguuggggggcuucugaagcuggcuuagccccagcccuauacacccaccccacagauggugggaacaagcccagaagagaguggguaacucuguccacuguggccuccacagccaagguugccaggcagagcucgcaaggcccaauuccagucuugucuuugaccguugccccuuuguguuggggggguguauuuagucaccuuucuggaagcaugcuuuucuaauucuagucaucaguaguuuguugcuuuaagauuuugaaaaugguauccuguuauuuuacuuaggaguuucguauugaaugguguacauaaugugauucaaguaccucaaaacagaaggacuucaguuaagauuuaggcucuaugcaacauacacuucuugcauuuucucauucaauguccuuuccuuuuuuuuuuuuuuuuuuuuugcaagaauguagcugacauucagaguagauuaguaccuucaaugucugugugaaagaaaugaccuuaauaugaggacaauauugacuguguauuuagggggcccacuguuaaggcauauagaauuuugcuuuauuucagaccugacaaucucuugucugcucugcuuccgcauaaaauuauaauacugcacauggauguaaaacccaaccuauucccugccugagggacuagaauagagggaagaaugacuauaguucuuuguugccuuuugugaagguaacaggcacagagguaugaugcaugauggaauuauauaccucuucuugagguguuugagggcugacuaaggaccuguacuuuuuuuuugguuuguuuugcaguacuggggccagggagccuugcuguugugucuagagaguguugaagaaccaugaauauuucgcaaaaagaaaauaauuuuuuuaaccauuaaaauuccugguagugacuuccucuggcaaguaaaaaacucucauuuuccuuaaaaaaugagaguuuuuuacuugcaauaggaaaacuugccaauuuuucaaguuauuuuuauucuugaugauucucaaugagacauaauuaaaauacacauagaaaaaacaaccguaggccaggugcaguggcucacaccaguaaucccaacacuuugggaagucaaggugggaggaucacuagagaccaggaguuugagaugagccugggcaacauauugagacacugucuccucaaaaaauuaaaaaaauuagcuggauccaguggugcacaccugcaauuguagcuauuugggaggcuaagguggaagaauagcuugagcccaggaguuugaaggugcagugagccauaaucaugccacuguacuccagcccaggcaacagaguaagaucaugucucaaugaaaaaaagaaaaaucaacccuaguggacuggaacagggcugguuuacuuugugucagcugcagugcccccacucgccaacccacauguucuucuccugcugguucccaagcagagaccagaaccaagaaugagaaucauccugugggugcagguuguaucuuauccuccagagacagcacuucacccucuguuagaaacuucuuuaccacacugccuguuuggugaaauccuuagggcagugacuuccaaacugugauccaggggccacccuuggugggaggaucaggaaggagggggaauguaucuuaagaaaaguugggggaagcucauaucucuucucguugauccugagaaguaaagucuuuccuccucagagagaugcggguagacaugacucgccuagauagaagcucauucaucucccucccuucugccucugcaggacucuuggaagucuggguccccgggaguaugcggcucuugcucugugcuacagguuuccaaaguucacuugauaacaguacaauugugcuguaaauugugcaguaauggagacugaggaaacaauuagucuuucaucuucauucauguuaccagcucacuuccuauggugugaaaagagccagacuuuggaguuaggagacaucugaauacagacagaacuggcaagauuauggggaagaaaagggaaaaguaaugaauauuuucaaagagguuaagccauuuggccaggacaacacugcuugcagguagcagaacugggauuuugacuguccauaaucccuauucucugcuuguuuuacuccuucccucucuucuuucuuuuuucauugucuaaugaccuacagacauucugucagcugcuaaagaaugagggacuccuuuauaaagauugauaggacagugucgcuacuuaaggaguuccuuccauguggaccagugggggcgcuguugacgcauggggcuggacuucucuuuggagcagaguccuguuccacggaucgcugugacaagcagaaagugccccaccccaccuccauacaauuccuaaugcuccugggugauacaaccgccccaguggaagcacgguggugcauggacuucuagagaccauuugaagccaggacauugcugcuuguucuuaggaaauggcagaauauuacuuucuuguuuuuuguagggaagccugccaucucaccagguggcagcuuguuuauaccuuuuauccuaaccugaagcaggugaugggacagaggucaucgaauauaaugaaagugccacaaagguagagucuggguauauuuuauuuaugcagguagagugacuuguccagaucccuucacacagagcaacauuuaauaugguaauuguuacugcugaaguuggccauuucucggaccuacagcugcaaggaauugguaacaaaaggauaaacuaaacauuguuacuauuuuaauuuucaaggagaugaaguuaaaaucauauaugucauaucucucuggggcuuagccaccuuuucugcugggcacuuuuugaagaagucugaauacugagauaggagaguaaaggggggaaaguaaguuugcccacuucucauccuuuuucugaccaucagccugagggaaguaacuagaauccgcuaagaaaauucacuuaaucagcaguugauugauuguuauauuguccacauugcaaaauucuuuaaaggauauuugaagauauuaucacauuuguucucuuacaaucuauuguauuguuuauuugaaggggugaguguuaauaguucuuaagauaucguacuuuauuuccgguagcauauccaagaaauaauuuagaaguauuguuaaugggaaugauguuaaauaauuuuucuaugacuaguaguugggacauauaugauauaaaacaugguaucuuuguuacuuaaguaauuugaacucuaaccccauauaucuuagguagacaaugaaaauacugaauuguuagucuaaauaauauacacguacucauuccgcaaauauuuauuagguaucuacacacccuaggaaucuuucagggcaugaagcuguuuuaaucuuccaagauaaugcagcacguaucccccuugagggacauuuguuuuucaaauugcuccucugugucuccucugcuuaggauaugaguuccucuaagacuguauuuuaaucuuuuguguaauucugaugucuagcgccaugccuggugcuuacguaauaguugcucagucaguuugagggugaguccauuaacugcccucuaggagcuugauauuuaauauaaacuagucugugauacaugacaaugcugugacagugcagaugagaaaaugugacuucuaacuggggugcucagagaggauauccuggaggaacugccauuuuaacuagacuuuucuuuuaagcagguagauuuuguuugguucaggcuucagcuggaagcccaagcaauggugcagauaugagcuggacuaugacagacuauugggccaguggggcugacaagguuaacuuggggguugccauagagggccuucagugcucaugugcacuguuucaaguuuguacagggcaucuggaaaccauggaagaagauucuggaaagggcagggcagguaaacuggauguggauaggaaguuacuguggcaggugaauuggaagauggacagguuggaggcagggagauggugagcgggcuccugccaagguguaggucugagcauuguugugacggcuuaguugguuugacaucagcacacagauugaggaucugucauuguaacucuaaauuguauccuuguuagacauguaaaaauaacuuuuuagagccuccguuuuuaaggagggaaguggauugugcucaagcuugcaugcuccgcuguuccugugcuuuaaaaauacucauccaccaguguggucacugaugaaaggggaggaaaaacuagccagaaguugccauuuugcuuaaagaauggauucauuucuuccucaagguggcacagagagaguuucucucuuuuugccccucucuuagauugauuuacuauuuuuaguaaauucuaacagucugauccuugcuuccaauuacaaugauuagcaauauuugcccaagacaagaaaaaacaauuuccucucuuuucucuccuaugagcuuuuccugugagccccaagcagacagauguggacaucuagcaaugcuguuaacaacagcugcaguccguuggacucucugcaacacugggcacgguacaaagugcucugacaaacucuucugcccuuugcaauccuuacuacgcccugugaggugaggaguauucuuccuguuuuguaggugaagaacugaggcaaagagagguuaugucauuagauuucacaauaggguguguuuccguuucaucaucuuuagauugauguuacugugacaucaucuuccuagaauuaacaaagugaacugggcacaggaaauagcacauggcacaccuucagcaaauggugguugugaucauuuucaucauuccauuucuucuugaaaaaaaucccuuuuuuuuuuuuuuuuugagacagagucucacucugucgcccaggcuggacuggugugaucucggcucacugcaagcuccgccucccggguucacgccauucuucugccucagccuccugaguagcugggacuacaggcacgggccaccacgccuggcuaauuuuuuuguauuuuuaguagagacggaguuucaccguguuagccaggauggucucgaacuccugaccucgugauccgcccaccucggccucccaaagugcugggauuacaggcaugagccaccacgccuggcaaaaaucccucgaguuccaguguaaacacucacgcccuuuuuugcuguuugcuauaaaccucucauucuccuuggucuucuuguccuugugugagguccugguuguuguggagacugaggucuucugagacagaaaaccaaccccauagcaggccuggugugugcccuagaauggcagaggccccacacguugccccggcuccucuggaagacccuccagccugucugcuggauuccuuguacuuaugaggauuguuaaaccaucucauaggauuccuuuccagacucagcccuucacuuguggcagcauuucuuacucugagguucugggccuagaaacccaguguccauaggcaaggucuagggacagagagaguuuguagaaagugggaaugcaucaguggaaggcuaaauccaaacaggaacugagcuggccuggguggcuuuguccuuuugccaucuucguaacccuuuaaaggcuuuaagacacuucuuuuguaauaacuaccccaacuaaauuuggccagagcugugaagggaaagaaaaucuaagacccuugagggagaugacagccgaacguuuuacauuuuuaccaccuuuguuguugccaugcacagcugauacauaaacaaguaauggccucaucuucuauucuuuuauuuacugguuagacccagaacccuaaaagguagaugcuucucauggucauuuggcauuugcaacaggagcugaauuuauuaauaguacuaauaccucauccuuggacauccuuggguuguccgauauuuuuaaggggcauuuacauccuuuguuuuucauauggaaaacuuuuccguaagggcugguaucaucuuggccuuccauugcaggaacagcacagggagguucgguggcuaggccacaguuacccacgcagcuagguagcagcagaggccccaccuggcacccccuggcuuccuaagcacaucgcacugugcagccucccugaggaagccucgaguggauaggaacucugguucuuuaagauaaaccugaguuggaucucacugucaccauuuaucagauggggcgaugucuucaggcaaaaguacuuaaccucucuguuuuuguuuccuuacuccaaaaugguaaugaucauacuacuacccaccuggguggauuggugugcauaugaaggaggucauggggacaagugguuggaagaguguugagcacauagaaaguacaagauaaaugguggccauuauguuacuacuuagacuauaucauacuugucuuuaucugggcuuagaaucuugacacugagaucuuucauucucagaucuuaauaugaaagcuuaccagguaaacacuaccccaacauaauuauuuaguggguucauacaugugaaagcaguugaaauacaauuucugaacuccggguuaauuuauauccuuaguuggaacagguaguacccucccagcaccuaaggccucucacuucuauccauucuucagaugaccuuugcaauaaucaugguaauugaauagcaucugcaccauaacauuguugaauaacaucaaaaugauccauuuagccaucaugagccuuccuaguaauucagacucacaccaguucuuucagguuauugaguagcuuuuacaaauaauugcuaacaguacaaauacugucucagguauuuuggaagggugaauuuucccauugauuucaguguaucuuuaggagguaauuugcaaaaccgaagaguuugguuccgucaaagucaccccuaaggaguguggaggaccacauuguagguuuauacugcacugucccucaugcuugaaauuuggcucaugcaaccaaggaacugaauuuuuaauuucguuaaauuuugauuuaaauuuuaaaacagaaauaguauaaaauauuuuucuguuaaauauaccuuguaguguuggcaagacuacauuucguguuaccaugcuggguaagauuucuuguaguguguauuguguuuugucaccucguuaauaauuuucuuauuuugguugcauguuaaaauaauuuuggauauauuggguuaaauaaauauauuguuaaaauuaaauucacuuguuuauuuuuuuguuggugaggcuaggcuacuaaaaaauuuaaaauuacccauguggauugcauuauauuucuauuagugcugcuuuagcugcaaguagccuauuuaaaaaaaaucauuauuuucagacuuauggacuucauagaaucagagguauuuagaggaaaggaucuugggggucaccuaauccagcuccaacauuuugcaagugauaagaccaaggccagaggcuacaauaaaaugacugaccuccucccagauggggacuggaucccaguggcuuuauagccuuugccuuggauccugguuuuacuuggaaacauagcagacaucagagcugcagagaacuucuaccagauccggagugaagaaaaugccuuauuuauuuauuuauuuauuuauuuauuuauggagaccggguauugcuguggccuaggcuguaguauaguggcagaaacaugguucacugcagccucaaccuccugggcuccaggauccucaugccucaaccuucugaguagccggggccacagguacgcgccaccacgccuggcuauuuuuuuuuuucucuuuuguagagacugcgucuuccauguuggccaggcugauaucaaaacuccugggcucaagugguccuccuaccuuggucccccaaagugcugggauaacaggugugagccaucaugccuguuuuggcaguuuuuaggggcccacgcuaauuuugagccagguuugcgcuugauaauguaaugcuggaggcugggcaggggacaugaucugccugaaagggcugagaacugggaggcucuuauuccuauaguauugagagcaaaggcacagucuuacagaaccacacaauauucagagcuuguggguuggagaaggaaaguccucugaaaaauaaaaaaaagaguacagaggccagaggcgguggcucaugccuguaaugccagcacuuugggaggcccaggcaggcggaucaccuaaggugaggagaucgagaccagccugaccaacauggagaaacccugucucuacuaaaaaugcaaaauuggccaggcaugguggcgcaugccuguaauccaagcuacuugggaggcugaggcaagagaaucgcuugaacccgggaggcggcgguugcggugagcugagaucacgccauugcacuccagccugggcaacaagagugaaacucugucucaaaaaaaaaagaaacagaguacaggucagacauugggcaauuuucucauaacaauuucauaggccauuaauuugguuacagacuugaauagcacacaacaguucucuaagggucaguuuccaaaguaauuccuaauauuuaaugaauuuuuaagugauagaaauugcaguaggaaagucuagcuugaaaucuaauuuguguuagguugaccaggugacaaccacccaccccuggauucugcucaguuaggucagaccuggggccaguugcccauuuagcaucucaggccucaggauccucauuuauaaaccugggguuugaacugcggucuccacgaucacugucagcucuccuuagucaguugguuguucuaaauguaguuuaguggccaguaaacaccuguuccugagugauacaucuuuaaggagccgguagaugggucaaccuggcuggacuugcuuuuucaagucugccuugucuauuagaaaggcugagcuuacugauuuugccugucacguuugaguguuccugagacuuugcccagccucggucuuaucugcggguaccccagccucugcauuccuugccccuacaaaaugugcugccaguuccaaaggcacaaaugaaaauuagcuuggcuggagcauggcuaggcacacaccagugguuaaagaaaugcuguuugcuggcugacacuucuggaguggaaguuuauucuuuuuucuuuuuuuuuuuuuuuuuugcgggguggggcagaguuuugcucuuguugcccagguuggagugcaauggcacgaucucggcuuggagcgaucuugggucaccauaaccuccgccuccuggguucaagcgauucucuugccucagccucuggaguagcugagauuauaggcucccgcuaccacgcccggcuaauuuuuuguauuuuuaguagagacaggguuucaccauguuggccaggcuggucuugaacuccugaccuuacgauccaccugccucggccucccaaagugcugggauuacaggcuugagccacggcgcccggccuuuauuccuuucuuuggccucaauuuuauuguuaagagauagugggaagggcccaauuuugaaaugauccuggaauuaauguaggaggccuuguauaagcaguuaauguguauuuauugaguggguacccugugccaauaugauacaaggugugaaggacacaugaguugggaaaggcauggggaaaugcacgcucacacugcuggugcgaguguaaaagguacagucucuauguagggcuauuuggcaguauauacucuuugacccagcaacuccacuuuuaaguauuuaucuuagggauacccucacacauuuaugaaaugauuuauauacaaggauauucauuauagcaauauuuguaauggcaaaaagaaacaaaagucagaugggggacugauuaaauaauuauguuauuaaguaauacuguuucaguacaucuguguaaugaaauaauguccagucauuaaaaauagugaggcaaagucugggugcaguggcucacgccuguaaucccagcaccuugggaggcugaagccggaggauugcuugagaccagccugggcaacauagugagacccugucuguacaaaaaaaaaaaaaaaaaaguaaaauauuagccaggcauaguggcacaugccuguaaucucagcuauucaggaggcugaggugggaagauugcuugagcccaggagguugaggcugcagugagcugugauucugccacugcacuccagccugggcaacagaacaagacccuaucuuagaaaaaaagaaaaaaaagaaaaagggacaacuuacaacucugugcccugauguagaaccaucuccaaaauauauuaaaugagugugggauacuaugcuuauaugcgauuguguguauuuaauggcuuccuaagaaaacaaaaaaaaaccugauacuagugauugccuuggaggaggguaacugggaaauuacuuuugcaacuuuuaaaucuuauaccauguacaccugguaucuauuuuuaaaaagccauuuucaugcccuaaaugaguuuagucagaccauaguaagaaaauccuguaagacauacaaaguaugggguaauuacuggcuuuaugggaagacugauuucaaugcaaaacucucccuaugcaagggaguuguccugauuucaaugcuaagcucucuuuaggcaaguuacguuggccugauuugccuguuaagucguauggggcaggcaagucugaguguccagagggcagaccuuuaacucuuaguuuccugccuugggagaaggcacagggcuaaagugguuuccagaacgugucuguuguggugugaacaccaaggagcaguggacaagcuucccaggcucaaggucagaaggucuggacuggaguccugccucugcuacuuggugaauaugugauuuggggcagguugcuuaauccccgaagccucaacguguucaucuagaaaugaagauuacaggcuggacgcaguggcucaugccuguaaucccagcacuuugggaggcugaggcaggcagaucaucugaggucaggaguucgagaccagcuuggccaacauggcaaaaccccaucccuacuaaaaauacaaaaauuagcugggcaugguggcaggugccuguaaucccaacuacucgggaggcugaggcaggagaaucacuucaacccaggagguggagguugcagugagcugagauugugccacugcacuccagccuaggcaacagagugagacucugucucaaaaaaaaaaaagacuacaauaccuggcccaacucccucaugcuacuguagugaggcucaaaugagauagcacccaugaacacuccuguaaaccaugaaguaugcaaacaccagguguaauagaagcuguuagguaccugugaggccagcagacaagagcaagagaugcuaauuuaaaaagaauuaaggugaagcaaagaucuuuucccucugccaaauaacuuggcaagaguuguaaaauuagaaaaguagacccuuaguaguuugauaauccuuugaccucugacccugcacaaaugaucucacccuuuagaccuguucccuuauuugcaaaacaagaggggcugucugggugauuccuguggucccuuccaguuguagcguuccgugacaguguggcauuaacaguaauucccaucuuggcugagauggaugagucauacuaacugaaaagucaaaauacgaggaagaagucucuuuauguaugagaauuuuccuugagcuagagacucagagccucuuggggaggagaugagggaaaacauugccaccaccaagaagggagacgaaggauguauaaagagaauggagauguauuuacuuuuuuuuuuuuuuuuuuuuuuuugagacagagucucacucuguccuucuggcuggagugcaguggcacgaucuuggguuacugcaaucuccaccucccagguucacgccauucuccugccucagccucccaaguagcugggacacaggcgcccaccaccacgcccagcuaauuuuuuguguuuuuaguagagaugggguuucaccguuagccaggauggucuccaucuccugaccucgugauccgcccgccucggccucccaaagugcugggauuacaggcgugugccaccgcacccagccgagauuauuuacuucuuguguguucuugccaucuccauagccuccuuugcuuucaaaugcccacuugggcugggccuuuggaaaauagauuuaacccuuguuuauuggaaggauauucacacaguaggccaguuauacacuuuguggcagucguuaccucuucugugaggucuuucugugcagauuuaguggcaccuccuccaugcugccugggcuucuacuugcuucucaucacuuugucucauaacucagaucagagacugugucuuacucaucuuuguaucccuggcaucugagggggugguaucugauggguagauggauuagugauccacuuaggguauuuacacuaaucuuguugaucuugacuacuaccuuuauaaccaccaccauucuacaaguuuuaacuuuuuuuuuuuuuugagacagaguuuugcucuugucacccaggcuggagugcaauggcgcgaucuuggcucacugcaaccucugccuccccggguucaagcgauucuccugccucagccucccgaguagcugggacuacaggcacccgccaccaugccuggcuaauuuuuuuguauuuuuaguagagacgggguuucaccguguuagccaggauggucucaaucuccugauccugugauccaccuaccucagccuccuaaagugcugggauuacaggcgugagccaccgcacccagcaaggaucuuuuuuuuuuuuuuuaaagcuaaguguuuuauacauauaauaauauuguuaauaaaauguaucuaaaauucauaccaccagcacacaaggucuccggcuagcagcaguaaauggcauuuaguacuuacuuagcccccaagccuggaugacugacuauacugacuuauuauuacuuuuagcuauuuguagguaguuacaucugaaaauugaccaggcacagugguucaugccuguaaucucagcacuuugggagaccaaggcaggaggaucaguuggggccaagaauuugagaccagcaugaguaacauagcaagaaccaucucuacaaaaaauaaaaauuaaccaggcauggugaugcaugcuacuugggaggccaaggugggaggaucacuugagccugggaauuagaagcugcagugagcuaggaaggugccacugcacuccagccugggcaacagagcaagacucuuaaucucuuuuaaaaaaaaaaucugaaaaggaccccaaggauugaacuuuaucuuuacauuuaucuuuacaaauccaggaucaaaagagaggguaaaggaucacuuggggaguuuagaaguggcagaaguaucuguagaagccuuacggugugaaugugcuggauugugugugcccacccucaugggggacuuccuuggaggaugaggguacaccagcaugggcagcaaagcuguuugaccucaagguggagaucugagccaccuggucaguccaugcccaguuaauuucuauggagguuugguaaaguagguuagggaguuggauccaauguuccugaaguuucuguugguaauauggcaggggucgggucggguguggggaggguuggaucauucuaagggcaguacaagaccuaaucccaaaggugagaaguuccucucuguggaggacagcauuuagaacucaauacauacauggcuuguucaaaaauggggaagagauuagaaaaauuuauccuaauguuugcuugucaaaccaagccauucucucagcaaaguagugaaacccuuacauaaguccuuugaagccuagcagcaguauccuacucaaacacaaaccaccaaaaaaaaaacaaaaaaaaaacaaaaccuccuuggggacucagaugugaaccucucauggaaaauucaguaccaugugcuuuuuguagcagguaggaucaccugcuguuuuggaaauuaacuuuuuuucugacaucuuuuugaccgaacucugcaugugccucuugagaaaauaauccaaauucuugcuuucuucacuuuccaguuuugcuuuaucuuugcaucaugcucugcaguuuacagacaagcauaaugggugagaguuccaguaaauuggcuggaucauauuucuuagauugagucaugacugaggaacuuguuugggaacaggaagcagcccaugaaaauggcugcacauaguaaccugccagauugaagaaaccggaccacuuucuaguggaaagauaaaagggcagaaaaaugguucuauaacucagggaaugguaaauuugugaacuaggguuuuaacuuguugaauaauacgucuuuguguguauuugggcuuuuuuaugcuguuaaaagucucuaguuauucaagauaagggaaaggaaaacuuggauucgugguaacuguugcuaccucuuaaaugucucugcugauguauacaacauguugcuaggccaguuauuuuuuuuaaggcacuguaguuacauagaaauaaaccuggcaacauuuacacuuggccucgauaggcuguaaggccccuuuugucuccaguauucuguguuucuguauuuuaaucaccuacuuuacacuuacuguagcaacacaaucaagauagcaaaucagucuaauaaaaccaaaaguacuggaaugugggaaauagaaagaaugaccuagaauucuugcugagaaaacaauugguauugcuauauucuuguaaugcagugugagagaagccagagaaguaaauaggcagauacauaucuaugaaauguaauuagucaucagcaagauguauuuuaaaaacacaucugcuuggugucauuuugcuuuaucuaauaaggauuacgacugcaaggcagagauuuguaaaugaaggagaucucuguuguuuuuguuuuguuuuugcuuuuguuuuguuuuaagacagggcuggagggcaguacaugaucauggcucacugcaaccuucaucuccugggcucaagugauccucccacaucaguuucccaaguagcugggacuacagcagugucucaccaugucuggcuaauuuuuaaauuuuuuuguagaguugaggccuguguugcccaggcuggucucaaacuccugggcucaagugauucucacaccucagccucccaaagagcugggauuacaggugugagccaccgugccuggcuguuauuuuaucaauuccucaaaauucaagcaugcccucaaauauuuuugcagccucauauagcucuuaauuugguuuauauucauccagaugguaggauaugauucauguuccaccugguuuucuucagaaauacuuagacagugucuauggaaaaaaacauugaaccagauuuagcuuuuagguaaauaauauaaucaccugggaauaauaugaagaaugaaaugaaagaaagaaaaauauaaucaaguguaacuuagacucugaaugcugguaacuaagauuuggaugaaggaaggaucucaggggaauaacauuaaaauaagauuuuuuuuaaauggaaauacaugauuuuaagaaggaauaacuuaagacauuccaacuuuauacuacaugaaaguaaaaagaucaaggaucaguuuucucuuuggagcaaggcucaguuucgcuuucuguugagaguuaguaguguguauaauuaauuuuuuuuaacaguuuauugaugaaauuuauuuuuagaaggaaaucucccaccaccuuccugucauucucagggcaagauagaggguaggagagggaagggagacucgggggaaugggaggugcaagccuuaauuagacauuugagugucuaaaagauuacuuuucauuucaaauacuuugucucaguuuacugaauagcuuuaauuuaggacagggauuguauuaucuuugcuuuaucuuuuccaauauuuuggaucaucuaagcaugauagaugcugguuuauucaaggcacuaaaauugacuugcaaaagacauauuuaauauggauucuguguucaaguccuuucuucuuuguuuauccugguacaaagauguuuguuuuaaagugguaugaguuaauuguccaacuucagauuucccuaaaauguguaacagauuacccaguuggcaaaugaugauauauauuuuuuaaacaugaauauuucuguuaggccagauggugauuuaacaugaauuguccaacauuuguguuucuuaucaaauugucuucuuuugucuaagccaagcuagcaacauaauuuggaacacacucaggaaucacuaaaggacaagagcaaaaaaaauucagacaccaaguggcagacggcauuugcuccauaugccaugcaaaggcuccuggccagugcucgcauggcccuugggaagcuuucucacccguuguaagaaaguaucugugcagugcugugcaacccaucuaccugcuuuccucucucuacccaaacccuacuuaucuaacacuuuguacuguggccuuccuccaugggggacuugcacuuccucaaagcccuggauuucugugcagaagagcaguuuuaguucuuccuuaggcacuucccuuuccuccuguccagugucauguucuuguuuguuaugggcuccacccagacgauuauuuccucuuagaugaugugugagccuugcagagagcugggucauuuguggaauaaaucaugugcccagucacacggcuccuuacaggaaaugguuggugcauauuagcuuagcacaaaauacaguagugagcuugugguccccaacagugagucuucaguuaacuucugcuguuuuuuuuuuuuuuuuuuuaacauaaagcuuugaauguuucauacaguaucaaaucucugcaggauuuugccugcugaaacagaugugaaaaucugaguagcacagaguaugacauuaaggccauaacaauaaaccuauuguugcugcauucuaaauuugaucaagaugucuguuuuugggaauccaaaauaguugcuucaaauuuagcuuuuuucuuuuaugaagcaguuuuguuuuguuuuguuuugagaccucucauagcaagaaaaaacauuacauaaacuuuuuuuugagacaaggucucacuuuguuacccaggcuggagugcaguggcacgaucuuggcucacugcagccucgaccuccugggcucaagcaguccucccaccuuagucccccacguagcugggacuacaggcacaugccaccacgcccggcuaauuuuuguauuuuuaguagagacaggguuucaccauguugcccaggcuggucucgaacuccugagcacaagcgaucugcccgccucggccucccaaagugcuaagauuauaggcgugagccaccaugccuggccacauaaauauaaacuuaaaaauacacaggaaaaccuuucagaacacuuugaaaccuauuuugguccuauuacgauugcacugaaugucccccagccuaaugaagagcaauuagaugucauuugguggcauucuugguggagacaguaagcuagggccgcaggagcugcuuagucucccaggguccagcauuguuucagguaacgugaacaggaugcucaagagcuagucuaaauaaugcuucaugucuuauuuuuccuguuuguugauaaggauucauaaagaugucuuuuucuggucaugucaagggaaauucaaauaaaaaacauugaauugguuuggagcuguccauugaaggguacucacagcaggaauugaguggcaauugaauguguguguguguauguuuguaaacauuuauauuagaguguaugcaaauguauaugggcgugcccacugccaucaccauuacccccaccaacaguaacaaaaccaccaucaagagcaauauccacuaaaacuucuaauuugcuuauuaauuugcuuuauuauuuguaaauaauucagaaucucugagaucaaaauccuuuuuuauuacaacauguuaauaguagucuaauucagaccugcccugaggaagaaccaagcaaugaagcuguccaugauuuuagaaguuaauuggcucauucuuucugaccaucuagguagucccaacauuauuuuaggcucccccuaguuagguccacaaccucauuauuauccauuggccuggacuuuggucucgcuuauacagcaaguaguagagccuaucacugucaacauguaaacauuugcauauuuuacauuuauagagagauacuuuucacgugccucauuugauccacuaacaucuguaugcuuggguaggauggaauaauuaaacaauguauagcuaaagccauccaaaccccucaaauauuaucaucugaugggaaggaaaagggggggaaaggaaauuaaauaguuauuucaauucuuggcaugauugacacugacaauuauaaauuccauucaauauuuucuuccagcucaugaggguugguuguaaggauacuuugcaagucagauuuaugagcagaagauguuugcaaccuaaauugcuucaguugcaugaaaaagucacaaccuuuuacugauuuuuauccugggaucuccuuaacaagaaaaaaccucaggcccaggaagucuagggugaggcagggaugugucaaaguacacuuuuccccacguacagggacaaguauuugaguuucuuugauugacuuugcaaagagcuuugcacacuuugcacaucacuucuugagaugggugggaacauggacugccuauuuuacagaguucaauuaagaucgcaggaucaugcauuccuuucauuuuuggugcuaguaccuagaagaugggaacauauugaacacuuaauaccuugcuugggcagauagcuccaguuugcagaaagucuagacaggauacccugcuauguaucuagauuuacugagaagaagcggcccaagcuaaucagaauuuuaaaguagguuucucagcugggcgugguggcucacaccuguaaucccagcacuuugggaggccgaggcaggcagaucacuugaggucagggguucgagaccagccuggccaacauggcgaaauccugucucuacuaaaaauagaaaaauuagccgggcaugguggcacgcaccuguaaucccagcuauucaggaggcugaggugagagaacugcuugaacccuggaggcggaaguugcagugagcugagauugugccacugcacuccagccugggcgacagagcgagacuccgucucaaaaaaaaauaaaauaaaguagguuucucuauaccuuugaauuuucugucucccaugauaaccuuuggguaaacauguccaucagaauggaaacaaaucauuuuuuaaaauagaaauuauucucauaccuauuuuagugggaaucccccugagaagauagccauguauagucgacugaaugcucugugguugcuauuuuguugcucuuggccaggaaacugaucuaggugaccuacagacuuaaucugaccugcagacuggccgcuucauacuaccaagauuccaaagccaaguguauauacagucggcccaugcagccucugguuccaugaugcaaccaauggcagauugguucaaaaauauuuggaaaaaggccaagcacaguggagugguucaugccuguaauccuagcacuuugggaagcugaggcaggaaaaucaauggagcccgggaauucaagaccagccugggcaaaauggcaagacgccaucucuacaaaaaguaauuagcugggcuugguggcaugugccuguagucccagcuacuugggaggcugaggugggaggaucacuugagcccaggugaaggcugcagugagccaugauugcaucaccacacuccagccugggugacagagugagacccuaucucaaaaugaguaaauaaauaauaaaauuucaaaaggaaaaaaguggaaaaaaaacccgaaaaaauaacaauacacacauaaaauacaguauaacaacuauuuacacagcauuuacacuuuacuagguauuguaaguaauccagggaugaguuaaaguauauaaagggauaugcauagguuauuugcagcaaaugccaugccauuuuauaauaguguaggcucauggcuaauaaagcaugaacccgacugaagcugccuggguaugugucuuuguucagccacuuucugguaguaucuuuuuucuuaaccucaguauucuuauacuguauaacaggaauguuuucucuguauaaggcuguuuugaggaauaguuucuauauguaaaguacuuagaacagugcauagcauauaggaagcccuuaauagauacuggcuuaaagauaauuagguauguccuagugagguauaccuaacuacaagugcuacuuuaacuaugccuacuuugugugcuuuacaauauauauuguucaaggcuagaauaaugagccccaugagcaggguuucauagcauuuaagauuccaacgccaaccuucaaucauggacacagguggccugugccaucuagcuagcugcgcugccuccaggcuggguggccugcuccucuguuggauaaaaauagccugacuccucacugaaacaaccaccauguuauuugcguccuugggaagcugaaaguaauagaacucuaagucuggcguugccagcugucagcagaaugaaaugcaaagugugacgugucuacacuguacccacuggccuucaagucccaacucccguucccccaucuugauuuuuuuccauucucaaauuaauuauuuccccuauaggugauuuguggaauggaaacagauuuagauuuccuaccuauuuagauuuuuccaaagacuaaaauuacaaaucagaaaaacugcuauugacacauuuuugguuaggaaaaucuggaugugguuccuaugccuagccuagucauauaaauucucuccccauguaucuuuuugugugugugaaacagggucuugucacccaagcuggagugcagugguacaaucacagcucaccauggccuugacuuccugggcucaagcaauccucucacuucagucucccuaauaguugggacuacaggcucguaucaccacgugcaacuaauuuguuuugauuuuggguagaaacaggugucacuauggugcccaggcuaguaacuccugugcuccagcaauccuccugccuuggccucccaaacuccugggauuacaggccugagucaccaagcucagccucuccucaucaaaaccauucccucuuuguaagauucuuccuaugucuuaaaacuuaauaccuuuaauccuucccuggagccauaguuuuauuuauuuauuuauuuauuuaugagacagggucucacuuuguugcccgggcuggagugcagugacacgaucauagcucacugcugccaugaccuccuggacugaagugauccuccuaccucagccuccugaguagcugggaccacaggugugcgccaccacaccaguuguuguuguuguuguuuguuuuuguuuugguagaaacagggucucuccauguugcccaggcuggucgcgaacuccugggcucaagcaauccaccugccucagccucccaaagugcugggcuuguaggcgugagccaccgcaccugucccugucugcuuuuauuuuauuuuuuuuugagauggagucuugcucuguugcccaggcuggagugcaguggugcgaucucagcugacugcaaccucugccucccagguucaagccgauucuccugccucagccuccugaguagcugggauuacaggcacguaccaccacacccggcugauuuuuguauuuuuaguagagacgugguuucaccauguuggccaggcugaucucgaacuccagaccucaggugauccacccaccuuggccucccaaagugcugggauuacaggcauauagguaagccacagagauaagaguagcaagcagugauggggagaagauaaucuaguguaggaaagauggaaagaauggugauauuucacaacugcuagauugacacuuuaacuugagaguuaucccucuauaaacuggauauuugcugagcaaaguuuaaagaaaacuccauguauucaguaauguuuuccagaccccacuucucuuauauaagccaguggcuuagagugcuugcucuaauuucuauauuccauuaaacaagggugggauuucuucucauucaaaccauuugugacuuugcccuuuagugaccucuaccaucacccuaucauuaaugauccaagugauuagaauggauggcuauguguuuguagguuguuuguugucuuuaaugaauagauucauugaauggaauuaacugugcucuucuagaacauuggaucuguguucucauuuagauuguauuuguaaucuccccacuucccaccaucaacaguggcauaaugugaauuaauuuaugugguaucugucauuuaaaaaacaugagcucucuccuuccuuuuuuugucuuaaacauaggacauggauuugauugacauacuuuggaggcaagauauagaucuuggaguaagucgagaaguauuugacuucagucagcgacggaaagaguaugagcuggaaaaacagaaaaaacuugaaaaggaaagacaagaacaacuccaaaaggagcaagagaaagccuuuuucgcucaguuacaacuagaugaagagacaggugaauuucucccaauucagccagcccagcacauccagucagaaaccaguggaucugccaacuacucccagguacagaguacucaguucuugggaaaguuauggcagguuuaaggaaacacugagcaaggaauuaaaauaucuggauuugaguuccagcuuugccuuucuuuuacuuaaccuugucaaaucuacuuuccaaccucagccuccugaugaguucaguaccuaaccugaguucaguacccaaccuauugaucuuaacaguguuauugugaggauugggaagacuuaaguuacaccaaagaguuuuguaaaguauagaaacauccuguaaggaucaaguagcagcaacagaaguaguagcaggagaaccaaguagcagggauuacuggcguuacuguguguggcaagcacuguuuuaagaacauauacugacugauuuaauuaacacaacuauauuaauuaguuaccauuaucccuguuuuaucuacgaugagcaacugaagcucacaaagguuaaauaauuugcccagaucacucagaaaauuggaggagcuaagaucugaacccauguggucuaguucaaauugugcaucaaagugaucucugaaauaagauaaauauuuacuuaacuugauuauaaauauuuuaugaacaucaauuauugaauauuuagcuuggcaauggaauauuuaaccauuuuuguuuuccuuugugucauucccuuuuaucagguugcccacauucccaaaucagaugcuuuguacuuugaugacugcaugcagcuuuuggcgcagacauucccguuuguagaugacaaugaggugagguauaaaauaaccugguuaauagaaaaacuccaucauaacuauaaaauaacaaucuauucuauguaagucccgucaaugaaucuccauuuaaaagaauaaaaacauuuuuaggaggaaauuuuuuaaccaaggaaauacucuugucaaggaaaccuuagccuauaaauaacuuuacaauuaagaaaaaaaaaaacccuucacacaauacaaaaccaaaaccauugacuauugcauagccagaaacauggacagcauaaccauggaaacaaauaacccauuugcugcaaguaucuaagagguuuggugaguaaagagccagcugggcaauaaacgaagacuuguucaguuaacaauuuuaauaaaucuguuuuaucuaguaccacugugcuagauauuauauaaacuaaauccuaaagauuguacuuacgcauuuuaaaguuuacuuucaaaugcuuaagcugaaacagaccagcaaauuauaaauuugagucagugggguaggaaaaaaagauuuguuauuuacaaacggggucaugacugguuaguaaguagagagacacagaacugcagcugauuccauuuuguuuuguaguggugccuuagagcuuacucauccccuguugguggaagacucauaaaucaaugccuuaucaauuuuagguuucuucggcuacguuucagucacuuguuccugauauucccggucacaucgagagcccagucuucauugcuacuaaucaggcucagucaccugaaacuucuguugcucagguagccccuguugauuuagacgguaugcaacaggacauugagcaaguuugggaggagcuauuauccauuccugaguuacagguaacuaaaauagaauguaauacuggagauuuuuuuuauauucagugccuuuagucauucugauuauuuauauaccaccuauuuauaggaaggauuggagggugcuauuaacuuagucaugaguacugcccaugcuaguuaaauugguuggacaucuugaggauagaauguuauaaaccugacgucugaucugggaacucugaaaauaauacauaacgcuuaggcguaaauauguauuggaaaugagaauuaucucugaauuauagauaauaaauuauagagauaagccugaagauaauguggguagggaguuuaucuaaauuuaucacguauuaucauggauuaacuuugauuuauauaguauaaacuuccuucucaugcagugucuuaauauugaaaaugacaagcugguugagacuaccaugguuccaaguccagaagccaaacugacagaaguugacaauuaucauuuuuacucaucuauacccucaauggaaaaagaaguagguaacuguaguccacauuuucuuaaugcuuuugaggauuccuucagcagcauccucuccacagaagaccccaaccaguugacagugaacucauuaaauucagaugccacagucaacacagauuuuggugaugaauuuuauucugcuuucauagcugagcccaguaucagcaacagcaugcccucaccugcuacuuuaagccauucacucucugaacuucuaaaugggcccauugauguuucugaucuaucacuuugcaaagcuuucaaccaaaaccacccugaaagcacagcagaauucaaugauucugacuccggcauuucacuaaacacaagucccaguguggcaucaccagaacacucaguggaaucuuccagcuauggagacacacuacuuggccucagugauucugaaguggaagagcuagauagugccccuggaagugucaaacagaaugguccuaaaacaccaguacauucuucuggggauaugguacaacccuugucaccaucucaggggcagagcacucacgugcaugaugcccaaugugagaacacaccagagaaagaauugccuguaaguccuggucaucggaaaaccccauucacaaaagacaaacauucaagccgcuuggaggcucaucucacaagagaugaacuuagggcaaaagcucuccauaucccauucccuguagaaaaaaucauuaaccucccuguuguugacuucaacgaaaugauguccaaagagcaguucaaugaagcucaacuugcauuaauucgggauauacguaggagggguaagaauaaaguggcugcucagaauugcagaaaaagaaaacuggaaaauauaguagaacuagagcaagauuuagaucauuugaaagaugaaaaagaaaaauugcucaaagaaaaaggagaaaaugacaaaagccuucaccuacugaaaaaacaacucagcaccuuauaucucgaaguuuucagcaugcuacgugaugaagauggaaaaccuuauucuccuagugaauacucccugcagcaaacaagagauggcaauguuuuccuuguucccaaaaguaagaagccagauguuaagaaaaacuagauuuaggaggauuugaccuuuucugagcuaguuuuuuuguacuauuauacuaaaagcuccuacugugaugugaaaugcucauacuuuauaaguaauucuaugcaaaaucauagccaaaacuaguauagaaaauaauacgaaacuuuaaaaagcauuggagugucaguauguugaaucaguaguuucacuuuaacuguaaacaauuucuuaggacaccauuugggcuaguuucuguguaaguguaaauacuacaaaaacuuauuuauacuguucuuaugucauuuguuauauucauagauuuauaugaugauaugacaucuggcuaaaaagaaauuauugcaaaacuaaccacuauguacuuuuuuauaaauacuguauggacaaaaaauggcauuuuuuauauuaaauuguuuagcucuggcaaaaaaaaaaaauuuuaagagcugguacuaauaaaggauuauuaugacuguuaaauua

SEQ ID NO: 192922 - RNA, 76908 nt, Homo sapiens
gcagccauuuuaauucauauuugagugggcgguggcgauugguguuggcggucuggcucagcugggcaggggguaacuuuacugauuugggggugguuuuuaguuuaauuuuucuuuucuagcuucccaucgacggucagugcgcacguuguaaucagcugaggccaugucaggagacggagccacggagcaggugaggaaggagagugguggggccucguggcgaccucuucuccacgucuguuccuccgacugcuccagacauguucggcugaggaaggaauugggucuagugaacccgggggacaggguauauagaagaguggugggaauggggagcaagaucuaagauuuaauuuuuuuuuuuuuacuucucucucuuaggcaugaauacgaguaaauacuugauuuagacaauagcgguaggcugcuucguccuauuuagauucaugggacuacuccagaugggaugcuuuccuuugauaucguuuugguauuagaguggauaggaauuauuuuaacgugcacccgacguuuuagaaaaacuugacaguguuucuuuuaccccgccaaauauacuguacccagaaauagguuacuaguuugagaaauauuugagacaaagcuaaucuggagaauuaagacuuaaugagagcgagugaagaaagaagcaaguuaugcugagguuuugggaauuuuguggcuuucuuucguuuucuuuucuuuuagccacauuucguuuucauuuuuccagcuacauaaacauugcagguauaaguugaaaaugagaagucuguuuuggccacuguaaauaaaagcaucuguuuuaauaguaaauaugagugacaacuaaauauuuuaaaauucacacuuuuagguuagaucagugugauuuguuucuuuugcucuuuguauucagaauuuuguaggauaguauuuaccuuuuagugugaaagaggaagcuaaauaguuaugaaaaaugccauuaaauguguuuuucgaucuaaguccugguguguuuagauaaauacaguuucuaaaauggaggcuagguagccugcagucucaauuuccugaaauuucccauugccauagcaacgacaugcacuuagguuuucguuuuucagguucccuagcuuauaacguggaagauguuauuggagguuggcagagaugaggcaaaauaggagcguucuauugcauagucuguaagacuguagauuucauuaugucggcaguuugauuaaauuguuuuguguuugcccgaggacugguuucaguccagaaaucuucgcacuauuuacauuuuacauaguguuagcaugcccaagcaugcaaagucuuaaaauuacuguaucaaaacuguuuaccccuuuucugaucuaguauuuguuaucugaaagugaaggacuaaugaacugagguuucauugaaaguuuucgaaauucauuguuaauucuuagaauuuaucuaaaauuacaaagacacggaaauguuaccaugaccucuugaauguuuuagaacugugguguuucagugggacagaugguggugaaaauuuauagaaaaauaauuucucccaaagguuuuauugugcaaaguuuagaacauagagaaaaguugaaagaaaagugcagugaacaccuguaggacaacucuucgccuggaaucaacagcugaaagccuugccauauuugcuuuaucuccccaugcugauagauugagaacagagucuuugucacucacacuagagugcugugacgccaucacagcucaccauagcuucgaccucccugcgcucugugauccugccaccucagccuccuccguagcugggaguacaggcgcgcgccaccaugcccagcuaauuuuuuuuuuuuuuuuuuuuuuuuuuuugagauggagccuugcucugucgcccagacuggagugcaguggcgcgauuucgccuuacugcagccuccgccucccgguucaagcgauucuccugccucagccaccccaguagcugggauuacaggcgcccaccaccaugccccgcuaauuuuuguauuuuaaguagagacggggauuuugccacguugcccaggcuggucucgaacuccugaccucaagugauccgccuaccucugccuuccaaagugcuggauuuacaggcgugagccaccguaccuggccuaauuuuuguauuuuuuuuguagagacaggaauucaccauguugcccagccuggucuggaacuccugggcucaagcgauucacccaccucaguguccccaaguguugggauuacagacaggcacgagccaccacgccugguccacgcauguuuauuugaaaguauuuugacacauugcagccccaaguauuucagcauucucuuauaaauaagagcaaaauguuguuacauaaccaccauaccauuuccccacccaagaaaauaguauuucuaaaaucuaguucuuuaaauuuccccauuugucccaagaaugugauuuuuuuuuuaaccagaaucaaucuagauuuacauauugaaucauuuacuucugucucuuaaguagucucaccauucuucuccccuggggcuguugucuauucgaagugucaaggacacuuaacacugcuuuucuggguguauuuguuuuuuguuguuuguuugcuugcuugcuuuugguuuggggguugaugaugucauuuaacuugucccuucaucuguauuuccugaaaacuuuacaguuaggucuauacucagccuugauauuuggguuaaguauuuuuggauagaauacuuaacauuauaucauuacauuagcagguacuucugcuggguucuguuaggaugguuaaguuugaucacuugguuuagggugaucucauuguuaagggucauguuccccuuugcaguuaauaaucugugaguugauaaccguuuucuuuaaaaucaccuuauaccuaguuaucaauugauaaaucuugacuaaaucagcucuuacauuggaaguagcaaauggugguuuuguuuuguuuuuaaaacccacaauucuguuggucugugucuguuuacuggcucauacuuucugcaaaaaagacuuuuuuucuuccuaaagauuaaguaucgcuauggauucauggauuucucuuaguguguuaguaucagugauagccauuuuucuuuugcacacucaacuuguccaaaccuuuuuggugguucuuauaucuuuuccuuaagucugaaaggcaauuuagacaucugauuaucaacaaggaagucaucuucauauagccuuuucuuuaacuuuuuaauaauacauuucaaacauguaagaaaaacaguauaauauaugaaguaccugucauagagcuucaauuuauggcuaaucuuguuuccuccaugacuucauuugcuucucucacccccauuacuucgaagcaaauccuagauacuguauucagcuucaacuaaaauaaccauuaaauaacaccuuaaggauggaaaauaugaaugagcuguaccuugcuugauauuuaagacaauauugaaaaucuggaggaaaagagaguauccaaaauaaccugaaaucauggaugagaaaaauaaacucaaugagacuaaagaauaauaagaaaaaaauuaaaaccauugaaucauggauuugcuuuggaaaaaugccaagggaugggguggacaaagaguccuacaagaugcagguguagauuuagccuuuuaguagcauugaaguucaaguuuguagaauaaaccugauacuaucuuaaauuuauuacuaaaauauauggauagucauuuuucucuuggugcuaagauuugugauuugugcccccuaacagagggaaauuauugcagacaagcaaaaucacugcuaaagguuuauugcugugauuuuuuuuucaacucuaguagggaaguucaauuuugcauguagagagcuauuggaauuaccuuauaguguucaaggaucucuucugaagcuccuugcuuauuguuuuugccaguuuaauggugaaaaaacuauuugcauauagguuuaccccccuaacaaacauaugauuucuguguggaauuauggcuguauuauuuauuucaugguuuuguuuuuuuguguuuguuuuuuguuuuuuugagauggagucuugcucuguugcccaggcuggagugcaguggcacggucucggcucacugcaaccuccgccucccagguucaagcaauucuccugccucagccucuugaguagcugggauuacaagcacacgccacaaugcccggcuaauuuuuuuguauuuuuaguagaaaugguguuucaccauguugaccaggcuggucuugaacuccugaccucaagugaucugccugccucagccucccaaagugcugggauuacaggcgugagccacugcgcccagccugugguguuuguuuuuuuuaaugccugauucaacuuuugaucucauucuuaggucuauuuaaccuugugcacuacucuuaaggcauuuaauaugcuguuauuuagacauuuuccauuggguuuugaacuucuuuaguugaagagaugauguuauucaucuuuaugucuuaaagaccuaagaaauaauauuuugaugcuuaaagguauucaguaaaugaauggauuaaguuugcaucuuuuaaaaaaaauuauuuauuuacuauuuagguagagacgaggucucacuguguuucccaggcuggucuugaacuccuggacuuaagugauccuccugccucagccuuccaaacuguuggauuacaggugugaguccagccauauuucaccuuuuaaauaauguauaacuuauccuagaauuuggaaggccuaaaauacaagccaaaugauccucagcuuggaaaagcuacaugauucuaagaagcgcaaauuaauugcugguaguucuuaacaaaggagcauuuaggcucauaaauacguguuuuuagugaaaaauaauuuugggaagauuuagaaaauaaugaagaguauguguccuauuauauacuuauuauuaauaaggaaagaaaaaguugaaacacccacagcauugaaaccugaaaccugguuuauuucguuagguaaacauuaguacuuaagcuguuuagaaguaacaguaucgccaauuuuagucaaggugcauauauguguagggguuagaagaggcagagaaagagccaacuauguguguuggacaauguguuuuuuuggauuuauuuuuuccaaaaucuuucuguaacagcccuuccuaguuuucugccuccuauuuuuagugaugcuuguuugguguaacaguuuugggcaggcaaauugauuugaucuuuauuguugauauuucuuaggaaacuggagcauuaucaaauauucuguuuggggacaguuguuccuaagagaaguugcucugugcuuaaagaaugagaauuggguuuuucuuagagauacagcagaaagguacuguguuaggugauacugcauuccuucaacauuauuucagggaauguaggcauuuacaucccagauagaccuucagaagggcaaaaucuguauuuggguguuuuuaccuauuggacaauuacccauaccaauucaugauuuuaagcuuuuuuuuuuaaaucuucgauuuggugacggugauuuuaagcuuuucuaccaugucucugaaucuuucucuuuagauaggaccuaccugugaauuugagucuuuuuguuuuguuuuguuggacaguugguaauggugugagaauugggcuaaaaaagggauuugaguuggcaguuguuuaaacuaucuuuagauuaauggacaacuuaggauacauaguaaauauugaauaaaaucagaagggcaaagcuucuguguguccuaauuaauguuuuucuaauguuugacuuaguuuauuuaguguauuaaaucuggauuauucauauuugaaagaagucucaucuuuuaaguuccaaacgguuaagauuuuaauuuauauuuuguagcuauuuguuuccuaggggaugaauaugcaaguuuacuaagcagauaaugguaaauauaauuauuugaacuaauauguuaagccaagaucuuuuuuuuuuuuuuaauuuuuuuauuuuuauuuuuucgagacagagucuugcacuuucgcccaggcuggagcacaguggcgcaaucacggcucgcugcaagcuccgcuuccuggguucacgcuauucuccuaccucagccucccuaguagcggggacuauaggugcccgccaccacgcccucacgcccagcuaauuuuuuauauuuuuaauagagaugggguuucacuguguuagccaggauggucuugaucuccugaccucaugauccgcccgccuuggccuuccaaagcgcugggauuacaggugugagccaccaugcccggcccaagaucuuuuuuuuuuuaaguuuuugaguuguuuguauguuuagauuuuuaaucuauggaugauuuggagggauuaguuuuguauuguaggauacauguucaguuucauucacaacaaacaugaaguaggguuugguugcauugguaaaggaacacagaacuaagcugacaucugguccuaauauccggucucauugugacaccugucacauauaguucuuuauuaucugggcauaugaauggaaucaguuagguuacuccucuaugaaagucucagcacggcaccguggcucacgccugucuguaaucccagcacuucgggaggcugaggcuggcggaucacuuggucaggaguuugagaccagccuggcuaguauggugaaacuccgucucuacuaaaaauacaaaaauuagcugagugugguggugcauaccuguaaucccagcuacuugggaggcugaggcaggauaaucacuugaacccgggagucggagguugcagugagccaagguacagccacugcacuccagccuaggugacagagugagacuucaucucaaaaaaaaaaaaaaaaaaaaaaagaaagucuuacggagugcuacuccggucuacuuuuaauuuugaaaaaaaguuaaccacagagagagacuuaagacuucaaauauauaguauauucaguuuucuuaauauuuuagcaaaaaauucacuuggaaugacagguuuguugccaccuuauuuuuaaugaaacgugacauuuggaaaacauuuguggaacagauagaugaggugguacauauuucuuaaaguggagcccauggcccauuuaugucauaauuaggugcguuauaaaaguauagauacguagacucugauuucaaaccuaacuguucaguggggcugagaaucuucguuugaaacagguaccacagugguuuuuaugucaauaaaagcuugcagaccacagaguuagaugauagcugguuguuuuaaaauauauucuugauaaauaaguggaugaaaaaauggcagauauuugaggaugguauuuuacugauuuuuccugcccaccugcuccccacccccauauauuuaguuauuacccugaauagcgagaaauacucauuauaaaaccaggguugaggcucaacucugcuuuuucuguuggucauaguaaaaagcuuacaucgucuuaaaucuuucagucuaccaucuuucucccccucuauucauacuuuuguguuaucacuuuaacugaucccuacuuuaacuuaauuucaguauggcuccuaauauaacacccuucuaauuuaucaugaaaguagcuauuuggagaaagagaauuaucuuuuuuuuuuuuuuugucuguuuuaccugcauggucgaaauggaagaaauuagauuauuauuauuauuguuauuauuacuauuuuuuuuagagaugagaucuugcucuguugcccaggcugcagugcauuggcguggucauagcucaccacagccucaacguccuggccucaaggacuccucccaccucagccucccaaagugcugagauuacaguugugacccacugugcccagccuuaaauuauauuauuucagucauuaacaugauagugucugucaccucuucacaucccaccuucccauuaacaaccuccuaauaaaaguuaugagcucauauagaaagaaagugguuaggaguuucaauaaagcauaacucauagggcuuuccagaggcuacaucaccuauccacaauuguauguaaaggcuguuaaaaauggucuuuccucccuuuuccaacuacguaacugugaggcuaaaauuuuuucauauuuuucaucuaaaacaauauauuguaacagauugaaagaagcagauaaugucuucuauucagccagacauuuaaaagaucaugaaaauguaaaauggugccauucuuuugacuuuuuuuuuuauuuuggaaaauuuccuucaguaaaauauuuauauucauauuuaaggaauuuauuauuuuuaagugaauuaaauacuuuaauuuuuuguuuuaauuucuuaugugaguaaugauagaaucccucugggcuccucaauuauuauuguuauuuuuuuuuuuggaggcggagucucacucuugcucaggcuggagugcaguggugcgaucccagcucacugcaaccuccaccucccggguucaagcgauucuccugccucaccuucccaaguagcuaggacuacaggcaugugcccacacccagcuaauuuuuuguauuuuuaguagagacaggguuucaccaaauuggccaggcuggucucgaacuccugaccuugugauccgcccaccucggccucccaaagugcugagauuacaggcgugagucaccgcgcccggcccaagcuccucaguuuuuaagaaugugaagcaauccuuuacaaaauguuugagaauaguuggaauaguacaucaugucugugaagccaagauuguaaguucuauuucucugaguuaguuagcuucacauaacagacgguuaaacauggaaaguggcaaggcaucccacagaauaggauacaguuuuuguaaaucaugucugauaagggauuuguaacuccaacauguaaaaauucauuaaugaaaaaacccagccaggugcgguggugcacgccuguagucccagcuauuugggaggcugaggcaggaggauugaucgaacccaggaguucaaguccaaccugagcaacauagcaaaacuauaccucuaaaaaguaauaauaauacguccaguuuuuauuuuauuuauuucuauuuuuucaagacauagucucgcucugucgcccaggcuggagugcagcggcacaaucuuggcucaguggaaccucugccccuccccgccggcucaagggauccucccaccuuagccuccugaguaggugggauuacaggugccugucaccaugccuggcuaauuuuuuguauuuuuaguagagacaagguuucaccauguuggccaggcuggucucaaacuccugauaaguccaguuuuuaaaugggcaaaauauuugaacagacauuucuccaaagaagauguacaaauggccaauaagaaaaugaaaagacgcucuacuuugauagccaucagagaaauguaaaucaaaaccacaaugagauaucacuucagacccacaaggauggcuguaauaaaaaagauaauaucaaauguugguaaggauauggagaaauuagaaccccuuauacuggaaauguaaaauaguacagccccuuuaaagucugguaguuuuucagaagguaaaacauaagaguuaccacauuacuuagccauuccauuucuagguauauauccaagaaaaaggaaaacacacaaaaugaacuccacaaagaaaucuuacacacuaauguucauaguaacauuauucauaauagccaaaacuggaaacaauccaaaguccaucggcugauacauaaacaaauguaggauaugcacauaauggaauauugucaaaaguaaaguacuuaguauaugcaaaaacaugaacuuugaaaacacgcuaacugaaagccaaaacaacgccagucaugguggcucacggugguaaucccaacacuuugagaggccgaggcagguggauugcuugagcccaggaguucaagaccagccuggacaauauggcaaaaccccaucucuauaaauuauaaaauuuagcugggcaugguggcacaugccuguaguccauuaucgggaggucuaggugggaggauugauugagcccaggagguugaggcugcagugggccaugauugugccacugcauucgagccugggugacagagugagauccugucucaaagaaaaaagaaaacuagaaacaaaaagaacacauauuguaugauuacauuaaauaugggcacaucccuagagacaaaauagauuaguaguugcccagggcuuagggauuggagggaaaugggagugacugcuaacagguacagauuucucuuuggggugauaaaauguuuuaaaugugugaugguucuguaaacuugaauauauucauaaauaaaaacuauugaguuauacacuucagaugggugaauuguauguaugugaaucaugucucaagccaguacuaaaaaagaaauuauaaaagcuuaaauacauaauaugcuuauucuacuuucaaaccuuuuuuuuuuuuuugagacagggucuggcccuguugcccaggcuggaaugcaguggugugaucuugguucacugcaaccaacaccuccugggcucaagccauccucccaccucauccucccaaguagcugggauuacagauaccugccaccacacccagcuaauuuuugcguuuuuuguagagaugggguuucgcaauguugccaggcuggucuccaacuccugagcucaagugauccaccugccucagccucccaaagugcugggauuauaggcgugagccacugugccuggccccccuaccuucuuucuuuuagccaguuguacaugguuguguuauucacagagaagauaaaauuaagucauugguaauauguaugucuugauaacuaguccaguuuuugcucuacuccuuugauuuggggucccugccuguuccccauuaacaucgccugaaaaaugauauuaggauuauagauuauuauuucagaagcaaaacuggauuuugauaguuuuugauaguaauaaguuuuugggaugcauaagcaugggacagcuguucuugcuacacuaagcaguuuguuacagaagggcauuggaaacuugcccuguuuucuuuucuuuucuuuucuuuuuuuuuuuuuuuuuuuuaguuugagacagagucuccaucuguugcccaggcuggacugcagugguaugaucuuggcucacugcaaccuccgccucccggguucaagcaauucuccggucucagccucccaaguagcugggauuacaggggccugccaccacgccccgcuaauuuuuguuuuguuguuguuguuguuguuguuuguuuguuuuguuuucaagacggagucuggcucugucgcccaggcugcagugcaauggcaugaucucggcucacugcaaccuuugccuccuggauucaagcaauucuccugccucagccucccacguagcugggauuacaggcguguaccaccaugcccagcuaauuuuuguauuuuuaguagagacaggguuuuaccauguuggccaggcuggucuugaacuccugaccucaggugauccaccugccucggccucccaaagugcugugauuacaggcguaagccaccaugccuggccaauuuuuguauuuuuaguagagaugggguuucaccauuuuggccagacuggucuugaacuccugaccucgagugaucugcccgucucggccuuccaaaguacugggagccacucugcccagccuguuuucuuaaaaugaccuguucuggcaacagauucagguaauaauacaacuucauuccuuauggaggcccagucucucuuuuggguacuacaaaacuguucaguuuuucuuugcccaguagcauuaugguaaccaggccagaaaacaaaaaugcuucacucucagcguuggcuacccaagugguucauagcuguuauguuaaaaggcuuuuuauugugagaauuaaaugugaccauaaccagcaggauaugcucuugagcauucugguuaacuuccauuguuaauuaaugcgguugauugagaauuacauguauagauuguguuacgaacauuugacuacugaggagcuaggccagaaaaaaacauuuagugaugcaacugauacuucugcuaauuccccagguaucuggauagcauuuuagggauucugugaaauuggaugggggaaaagacuuucacuaaucgcuaacugaaauugagcauucccuuuuauuauuaauguaggccagaauuuacagagguaauaguguuagcagcagcacucaucacucauguagugaauuggccccuaaagcuuguuauuugauguauuaaguauauauuacuauaaaaaaccucuggagcaaggagcggugguacacgccuguagucccagcuacgugggaggcugagacaggaggaucacuggagcccaggaucucuagaucagcaauguagagagagccugucucuuuaaaaaaaaaaaaaaaaaacacagcaacaguacacacacacaugcuuuuuccuuggaaaucccucagaauuuauguauuuaagaauauuauucugagaaaaggcucauagguuucacuagacugcagaaagauucuguggcaccaaaggagcaaccaacuagagagcauaguuuuuuuuuuuuuugagauggagucuccucugucacccagguuggagugcuguggcguaaucucggcucacugcaaccucugcuucccagguucaagcguuucucccaccucagccuccugagugugugagacuacaggcacauaccaccacgccugcuaauuuuuguauuuuuaguagagacggggugucacuguguuggucaggcuggucuugaacuccugaccugaagugauccaccugccuuggccucccaaaaugcugggauuacaggcgugagccacugcacccgaugagccaugguuuucaacuaggacugcuauacguuagaauuacuugaaaaguuuuuaaaaaauauugauaguauguacauuccuagagauucagguuuaguugauugagggcgaggcuuggacaucuuuuaaaaucuccuucccuuaggugauucuaaugcagagccaggauugagaaucacuaaagggcuggcucauuugauguauuaaggagacauguauacgucuuauugugauuaugcuugguuggauaucagauucuaugcucuucaguuggucucuuuuacagauuauaugguauaccuuaccugauuugguagguuaauuugagcaagugggucuugagcuccagaauaucuaugaacacuaaaguaauuuaaauagcucucuaaaugcaaaauugaccuuguaucaagaguaaaaacaauuauagcaguaaaccuuggcagugauucugcuugucuacaauccuuucccucuuucagagggcaaaaaucacaaaucuuaauaccaagagaaaaacgaccauauguuuuaguaacaaauuugagauuauaucagguuuauucuucagugauacugaaaggcuaaaagaaaucgacaacucauaccuuguaggauucuuugucuaucccauccccuggcauuuuuccaaagcaaauccaugauucagagugguuuuggguguuuguuaucacugauuaccuaaagcaguucaaguauagaugaacuguuuuuugguucccauaucaguuuuauuucuuaguuaaucguuaucauuuuauagucgguaucucaagacugaaauucuaguuuacguaaaauuucuuuuuuuuuuuugagacuaagucucacucuguugcccaggcuggaggcucacugcagccucugccuccuggucucaagcgauucucuugccucagccucccaaguaucugugacuacaggcacgcaccaccaugccuggcuaauuuuuguauuuuuaauagagaugggguuuuacuauguuggccaggcuggucucgaacuccugaccucgugaucugcccaccucgggcucccaaagugcugggauuacaggugugagccaccaagccuggccucuuucuuucuuuuuuuuuagagacagugucucacugucacccaggcuggagugcaguggcgcagccuuagcucacugcaaccuugaacuccugggcucaagagaucuuccugccucagugucccagguagcuaggacugcaggugccugccaccacgccuggcuaaguuguuuuuguuuuguuuugguagagacagagucucacuguguugcccaggcuggucuugaacuucuggccucaagcaguccgccugccuaguagcuagggcugcaggcacacaccaccaugccuggcuaauuuuuauauuuuuuguagagaccagugucucacuauguugcucagcugcucuugaacuucuggccucaagcgguccucaugccuuggccucucaaagugcugggauuacaggcaugagcuaccaugccuggccuaaaauuucuuuuaauuuuuuuuuuuuucaagaaguaaacccauugaaagaauucuuuauuuuguuauguaucccaagggccacuacaaugucugacacauacuaggcacugagugaauauuucucagacgaauaagaaaaauucaaacaaaccagaaggguauauggcagaguaaguguauguguuguuugcaugucucccugcucaccaucacuuuuuauuuuccauguggcuaccugccaugccuuuuuuuuuuuuuaagugacuacaaauuccauaauuuauuuaauugguccuuuuuuauauguauuuauuuaauuuuaacaaauagagacaggguuuuguucucuuacucgggguagagugcaguggugugauuauagcucaccgcauccuugaacuccuggggucaagcgaucuuuccaccuuagccucuugaguagcugggacuauaggcaugcaccaccacaucuggcuauacauaguuauuuaauuuauuuucagucuuauguaacuauagucuaguagcugacucauuauauaucuuuguguacaugugcaguaggguguuaauagaaguggaauucagaaucggacauuuauauuaaacguugaucaguuucuuuuuuucuuuuuuuuugagacggagucuugcucuauuacccaggcuggaguggagugcaguggugugaucuuggcuuacugcaaccucugcugccuggguucaagcaguucuccugucucagccucccgaguagcugggacuacaggugugcaccaccacucccagcuaauuuuuguauuuuuaguagagacggggguuucaccauauugguugggcuggucucgaacuccugaccucaggugauccacucgccucagccucccaaagugcugggauuacaggccugagccaucgccccuggccacauugaucaguuucuacuugcccuugcuaacaauaugagaauaucuuuuucugcuuacccucaccagugcaauuuaauuauaaaauguuggaucuuuguuuucugguuuauauuugcauuucuuuuuuuuguuuguuuuugagacggagucuugcucugucaugcaggcuggagugcaguggcgccaucucugcucacugcaagcucugccucccagguucacgcuauucucuugccucagccuccugaguagcugggacuacaggugcccaccaccacgcccagcuaauuuuuuguguuuuuuaguggagaugggguuucacccuguuagccaggaugguuucuguucuccugaccuagugagcugccugcuuuggccucccaaagugcugggauuauuacaggcaugagccaccgugcccggccaauauuugcauuucuuuugagucuuuaaaaaguuaauuauaaacuguucauaugcuuugcccuuuuuuuuauuuuuaaauuuuuauuaaaaaauguuuuuuugacacagagucuugcccugucacccaguuuggagugcaguggugcgaucauggcucaaccuccugggcucaggugauccugccaccucagcuucccaaguaggugggaccauaggugcaugccaccaugccccacuaauucuuuguauuuuuuguagagacgggguuucgccauauugcugagguuagucucagacuccugggcucaagcaauccuccugcccacccaccaaccccaaagugcugagauugcagguugagccucugcauccggcugcauuuucuuuuugaaccacuggugguuuauugauuguacuuuaauaaauuuaguauuuuugucauguguuggagguuuuuuuuacguuugucuuuuuuuauuuugguacuuuucucaugcgcaaauuuuaacuuaccauguaaguuuacucuuuaaaggcuuuuuuuuuuuuaaagacagggucuggcucugucacccaggcccgagugcaguggcggcaaucucaguucccugcaacuucucccucccgggcucaagcgaucccaccgcagcuucccaaguacgugagacuacagguguguggcacacaccuggcuaauuuuuguauuuggguagagacgggauucugccguguugcccaggcugguccagaagaacgccugagcucaaggaauccucccgucucggccucccaaaaggcuucugaagagcuuuuccaaugcagaaauacauuuaaccguauucugcucuaguucugucuuguguuuuguuuuuaacauuuaaaucuuugaucucucuuaaguuuauuugggcagaaagaguaaaguaggaauucaacuuuauuuugauaaaauugacuucacaguuauucuaacagaugauuauauaguuauucugaaaccauuuauugaaaaauucaccauucugauuugaacaugccaccuuuauuauuugcugauuuuccauuugcuguucuuucugagccuguaguuucauauaugggaagagccaauagucccuuauaaacuuuacagcuuuaguuccuugagcaagcuauucauaaaguucuuauauguuaggaaagcauccuaauuuuaauuuugaauuacaguagucaacaugucuuuuuuucuaaauaaguaaaugcuuaccaguggugcaagcuaauuuauuccaaagaaaagaguuuauuucuccuagguaauuaaaaaaaucugaacagauacuuuuuuuaaacuuuuccaaacugguguuuugacugaauuguuccaugaaauacuaauuccacuaaaaaaaagggggaguggugggggagaaaagugauaggggcagugcuucccucuuuaugcucggauauuaucaauauauauugccauuuauagaugucaggauguccuagaaaaaaggcaaaacaaaacuucauauaaauuaacuuuuuuuuuugagacguagucucugucacccaggcuggagugcaguggugcuaucucggcuaacuguaagcuccgccuccuggguucacgccauucuccugcuuuagccucccgaguagcugggacuacaggcgcccaccaccaugcccggcuaauuuuuuguguuuuuaguagagaugggguuucaccauguuagccaggauggucccaaucuccugaccuuguaaucugccugucucagccucccaaagugcuguguggcuuugucacccaggcuggagugcaguggcgcaaucucacucacaguaaccucugccuccuggauucaagcaauucuugugccucagccuuccagguagcagggauuacaggcacacaccaccacgcccagcuaauuuuucuguuuuuaguagagacuggguuucaacauguuagccuggcuggucuugaacuccuggccgcaaguaaucugccugccucggccucccaaagugcugggauuguagaugugagccaccacaccuggccuguauaaauuaacauuuaucuggcuuauuugaccaucccuuuuugugguacacaguaguauucugaacaacaauuugagaauuaauacuuuuauuuuugcuucaagugcuggcuacuauuuuaggcauuuuuuucaaaaauuaaauuucuauaauaaaaguaaaacuaccuuaccaaaggauuuggggaauauugaaagaaaaggggaaaaaaaaucagccucuaauucuacugcuuaucuuccaaggaugaccagucuaagcauuugaauauauuuuaaaaaucucuuuaauugcagauuucuuuuauaguuuucauuguauuguacauacaauugugaauuguguuuuuaaaauuucuuuacaucgaaauaagauuuccaugucauuucaugcauuuucuuuguggcgcaggaugaaugcuuuaacagcaguguuucucaaaguugguccaggaaccccaaggguuccuaaggacuuucagaggaucugugacuucaaccucucucauaauaaaucuaagacauuauuugcccuuuuucacuccuaaucucucacgggcauacaguggaauuuuucagcaucuguaugaucugauagggcagcagauugaauacagaagcagaugugaaaauucagcugccuuuuaaaaagucaaacauugaauggauuuauaaauacguaaaaagcgacauucuuauuacugaauuuuaaguuauuuuuuauaaagaaaaaacauguaaaaaguuuuauuuguaaaucaaucaauauuuaaauuuguuuuaauuucuaauaugguaaauauugauaaaacccacauaaaagcucuuugugguucuuaaauuuuaagagcguagagggguccugagaccauaaaguuugagagcugcuguuuuauaguauuuaauacaaaaguaaguuuauuugaauaaaaaauacuugaucacuugguuuuauuaucuuuaugcaaguuacuucugauuacaaauacaaucgucccucaguaucugugggggauuguugccaggacacccccuuagauaccagaguccaugugugcucgugucucuuauauaaaaauaauguauuugcauauagcuuacauauguccucccaaauacuuaacucauaucuagauuauaauaacgucauauaauacagaugccauguaaauaguuguuauacuguguuguuuaggaaauaaugauaaauaaaaaggcuguacguguuuagugcugucuuuuuuuuuucucucugaguauuuucaauccacccuugguugaguauaaggaugcggagcccacagauaaggaaggacgauuguacacaucgguucuaggaaacacacuucucuuuuauaagaggauauuuuuaugcuuuguaaugugacauugcaucugaggacuuuauuguucaugaauuaaguuaggcaugagauuuuuaaaacaguaacuuuaguucacuguuguuuuuuuuccccaggcagcugaguaugucccagagaaggugaagaaagcggaaaagaaauuagaagagaauccauaugaccuugaugcuuggagcauucucauucgagaggcacagguuuagugauauaggauuacauuuccuucucuauggguccaaucacacuacuugguucugcagugaauaauauuuucauaauccuaacauuguaaaugcuguuuauugguuuucaauuuuagaaucaaccuauagacaaagcacggaagacuuaugaacgccuuguugcccaguuccccaguucuggcagauucuggaaacuguacauugaagcagagguuacuauuuuauuuuauuuuuucuuauaucaguauugcagcauucacuguagugauagaaaacaaguuaggaacauagccaauuaggacaaggaggauuuaaaugugucuuaccuuuauuuuguaaaauagguauaaaggaguaauuaaaaugaauuuuugaaauuugggucuuuuacaagcugaugauuguugcauuuuggaguugcaacaacauuaaaacaguuucaaugguauuggagugcuuuagccuuuuauuuacuugucaugugucaauuuauugccuccugugucauuuauuuagaacucauuuuucuuuuuauuccuacuuacaaacuaauaugaaugggaguauaugaaaauacagaaauguuaacuuaguuuuucauagaguauuuugagugucuggugaaaugaaacauuuuaagagaagaauuacuucacauuuuaauuuugugaaaaugcaugguuuaucaauguaagcacuucaauaauuuaacgauuuuucuguaagauaguuuauauuaugcaagaauaagcuaaugugauucaaaccuauuuaauccuauuuaaucauaauuuuacccaaugauacuuugauauuuuuuucuugcuuuuuauaucuugaaauuugaacccaggcauguauauuuuaaagaguaaggaccccauucaugauuaugguuaggaggaaaauguuaauuuuugaagacuggaauuaguaaaaaugauaauaaaaguuuuaaugugucaauaacaauuggcaccaaguagucauuuucagguuauuaauauaaauuaaugauauggaagggguaagauguaaauaacugauauccacauuaagcugaaaauuauacgcauuucuuuuuguaacuuaugcaguacucuuauuuuuaauauuaauuuugugauauagauuuucagcauaaucaaguacacugcagccucaacauaacauuuucugcuguaccugaaauuugauaauauuuaggucuguuuuggaccuauucaaagggcuuuggucaucagcaguacugaauauacuucagcacaacacagugucaucugugauauguccucagaauggacccaaccaauagcagauuuaaauagaggcuacaguguacucauuguauuugugcuauaguuuagauuguauuacuugguggggagggaaauuacuggauaauagcaggaacauuguguguguuuuauuuuugugugugugguuguguaugugguauguauguuuguguguuuguauguaugagagagauugugccuuauguggagucugguaguuuuggcccaugaccauaccuuaaaguuucaucaccuauccucugggaccauuucuuuccuuaauauauuuaaaucaccaaaguagcuuggcacaaaacaggugaggccugucugaaauaugcugaagcccgugcugcuuuguauuaacucauuaaaacaaggaaccuggaucaccugcaccugaucugcauucuagucuggcuuuagaaacacauuagacuuaaauucaaacgcaccagaaaugaaaauaauugauauauaauuguuuuuguauagugaaguagaacuuucugaguuuuugaaauuuccuuguuucucaauuauucaggcauuauucaugcauuuuauuauagcguaaguuaaacugaaauaggcaguuagauacuccauucuguaacucugaacacaauggguuuguuucuccaauuuccuagcuguaaguuacaaacugcauccuaaaaaaaaguuucaggaagaccagauguuauuccaaggggcugaaaguugucuacauaacaggcucaauucauauaaugaaaugaagagcugcuagcaguugccugauuuauuuaguugguaauauuugcaguuacuucacacacacaaacauacacacgcgcacaaauagguauauauaacauguauuaagaacaaaugguaaauaauauauauguauauuuuuuaaaauuuauauuuuugguuuaggaauuaagguuuuaaauugaaugcugguuuuagaaaugcauauccugagcuguguuuuucucuuuccugguuugcuguuuauuuuuuauuuucacauucuauauuuuuguuuagccugugagaggcuaaaguuuucuuugaucauaucacucaauguggccauuaauauuucuggagaagacacaaaccuauuuauaauacuuuuuaaaaauccgaagugauaauaagaauguuuuuacauugaaaguaauacuuaaguguuuacauaacauucuguaugcacucaagaaaauaaaguuuuguuaauacauuuguuguaacucaguacuucauggugggaaaauuguaauguucauuucuuuauauucugcuaagccaacuugugugacuccaaauaccuuuuuuuaauagaaaauacauacaucuuuaguaacggaagauaauuugcuuccccagagaaacuccuugcaaauccuauuuaaguacaaaaugucaaaggaaaaaaguauuaaacuuuuuaaaaaaauuugaaacaucaguuggaaaugagagcauauuaauuacuuuuaaaaaagguuaaugaugcugcuauaugagccagugcaucagauuugcucauaacugagaguugagcaguaucuauuuagcuauguaaaauuuggauuuaaaaugucauucugaauuugucacaugcuuucauuuuuuugcuguaguguggaaauuguuggagguaaaauuaucuugcucuagugaauggcauuuaggacaaacuucuguguauucuuaauauauaauuucaaaaacuaggccaaauuacuuugguguuauauauaauacauaggagauaacauuuugccuccacucccugaaauacauuguucuacucuuuauuccaaaacugcuaggucacaugauuuaacaguauuauuauaagaugagcaagucauuaauuguaugacuauucuuaaagugauaguuaucaaguauaaaguuuaaauaucacuaugauaugaaaguacuuuugugacuucuuaguuucaaauaaaggaaacauuuaaauaugucuccagcuauuuaaucggauaaggauaucuuaaaugcaguuuaguauauuuuuggauuuaauaaaugagagguuuuaaacacuugaguuaaguggaaugccccagucagagccucagugcucuuuaaagaacuacuuuuuacaaugaucaaaaaggucacuaaauaaucacaaaauugagaaaaccuacagaauuuugacauauucuuuuaaauuguucugccccacccagccugugguuucuguagcuuuucauguaauuaggugaugagugacaacauguaagcuacaauaucuuauuguuagagaaguaauuuguuuugaaucgggccacauucauaaggaauuuuuuuacugaagcauguuuuuuauugguggcugaaggagaaaugaagaagguaaugcugcugguaauagcaacgauguaucuugcugucugugaaagcuguauuucuuuaauaaaagcauauagagaauugauuguuuuauuuaaaauuuuuacaaaagaugaauucuuuucucuauacuugguuuuuccuuccuuauaaauaauggguuguguagcauacauuucaguuuuucaaaaugaccuuucuucuuggaaaauggaagugaacucaggaugcaacaugaguguccuaaauugaaauaaacuuuuccacuguugauacuguuuuaauaccuuuacauagcaauuuaaauuacuguauuauaauguuuucuuucuguugagcaaugugauuuuaaaaugcagauacaauuacugcauuauauagauuauggugauuucuauacuucagcuugcagccuuuuuaccaaaaaaaaucuguacucuuuucuuauagaucuacacuuuuccuguuuguaauaaauguugguccaugucugugugauuauucagauuuuuacuuuaaaacucaauaugcuuuuuuaucuaguuucuuagaugcauauauaaauguagaauagagauguauuacaagaaaaaaguacuuguaaacagaacugagugauaaucugaaagugcuuugaauaaaguacuguuugauaagcaaaggaaauauuugcauguugacuauaauaaguaguaaacuauuuuagguuuuauugaauuaucugauuccaucccuuuucccuauccauucuauaacagagauguuuagaugcugucacuucuacuaacauggucuauacauuuuuucccuugggacuuuuuuucucagccaaagcaacuacuuucaaaaggauguagucacuuagauaaugacauuucuuuaaauaaaacuguauguuuucuaaucuuuauaauuucuagauaauucuuuuaugugaaauguagccauuuauuuucaagcaaaaucuugugcuagucaaccugauugccuauguauuucucagcuuuauaaagcaaaacuaaucucugcagucauuaguaaacacauugaaaauauauggucauuuucuuuacccugcaaagacucuuacguuuuaaacucagcuucuuuauauucuauucuuugguguaauaagagucaugauauauucugaaauuguggaaaaagguuuaugauaaaaaaugcauauacauucuaaaauuaauggugaaacaaaaaggacuauuggaucagacaauuugaaguuuuugggggagguaguaauguuuuaccuaaauuuccuagacauucauggaauaacauaauaauauguaauaccuaauacuuaguuguuaaaaauauuggguauuauagucauuaggaucauaggggauaauuuugguucaaaacucuaucccugucccaaaagguauuaaagauacgcugcaacguagcauccaugaaucaacacaaacauguaagccccucauaauaucacagagcuagaaaccuccauauuuggaaauaaaacuaauucuaacacaugagacuuuuuacagugcugagcauuuuugguuauaacuugagcucaggggaaucagguggcaauugacuuuccuuuauaaaacaaaaggaccaguuuaagucaaaagcuuaaauauuuucuaauggauuguuuguauuuucuuuaacgcaucagcuuugaaacagcuauuccuuuggaaugagucugguucaaggcacuuccaggaaaugaagaugucuaaaauauuaccagugacaucuguaaaaaguugcaccucuaaauaaauguggacaaugcauuuauuaguuguaacuuauuacuuucaauuuuauuacuuuaauuuuacugaauuuuuaaacuuuaaauuuuauuauuaaaccgguuugcuccuagcaacuugguagcagaaaacaaauaguugguuuguauaauggcauaauagguugaagucugcaucuagauuuuuuucccccacauaccagaauccacaacaguuugaaaaaaaaauugugaauauuugcuuugaauacaacuucuugagaaacucagcugcuuuucuaagacucaggaaagcauaauguggguaaguuuuaccauuuuguaugcuagaccuccaaagaaaaauuuucuauuugcaaguguuaauuaagcaauaguucuaaagacaaauugacaucagcgauaggauucaaauguaguuuugaaauaguacauugcaccguaguaagggucaaagauaacaagaucccaaagcuguuuuuagucuuucugaaaugaaaucuaaauacuucuauucaugugacagaacauguucaguuacaaccuuuuauuuaaaugcaacauuucagcucuagcauguacuguugacguuuuaagucuuccuuuguccuaagauucauauucugcaacuuuucauacuggauuugaagaaaaaagaagguuggcuauuuugugaugaugguuucccuggaaauuuuuucauucaccagacuaugacuacuguacauuuuacauauaguugaaguggacauaauguuuuaagucagaaauuuuuagagcuggaagaugaauuaguuuagcccccucauuuuauaugugaguaaacuaaaucaagacauuguuaucccuggagccaaaguuuacaaacuucacugcuuuagaaucacuuggaaagcuuuuaaagcauacaagcuucccaguuagcauaccagcacugcugacucaaucucuagaggauggacauaugguauguguuucuggcagcuaguuuugggaauugaggcuuugcagggcaguaauugaaucuuacugcugucaguaaauuuuauaguuugcagaauauuuccuauacuugccuggacaauaaagugauuagucuccuggcuugcuuuuuguauauaaucgagugaucuuugaagcaucuacuaugugcuuaguauauuguaacuguuagauucacagucagggucaggguuaggguuacgcuguuuuaacuguaaccguuuuuuuacuaacugaauuuauuccuggguuugaaaacugauuuucugguugcauaaacuuuuuuaaaaaagacagucacaugagugccaaacuaagaaucagauaaccuuuaaggacacuucaaguguuacgggagaaucaucuaagcugaagaauguggcuuaaaagaauuaacugcagcuaacuuguacccuguguagaguuugaacaagagugccacaucuugguauuuauuuuugguuuauuuagcuaacauccuuuuauuucagugcaacuugaguguugugcugguacuucucauucuucugggugguggggaaugggauguuuucucacaaauaaccaguuauuucuaacuuacuauagucagguucaguccauuucugagcuuuucacuagaaagaucuguaguguuucucaaccauuuuaaacccauauccuuauaaaaaaugaaaacucaaaugcuuccuuaauggcuuuugacaguuuuaaagucaaauuugaugacuaaaaaguccaccagugguaauuuuagaauggucuuuucagcuguaguuaagaauccaaguacuaaugauauuuagaauuacauuagacuaaauuuuauaaaacuuaaauauccaaaaugacaacacuacuaaguauuacagaagugcagugucauuggagggaagauugucagcaaaauaacuuuguuuccuguguuuguacauuucuuuuaguucccucauccaccauuuccuuugguuuuggcuaucguguaugaagagaauuuuugaagguuuugugcuucccguauuugggguaugguauuggguauuaggugaaaaaaugcuuaaaacuuugauuauuuagguuaucagaguugaagauccaaucacggcagaucacaugguuuaaucugcuuuguauugguugaauaacgagcauugcuuuuaggguuuacaaacugacaguuauuuaagcaauuuuuguaaugcauuuguaacuuuauuuugaaauuacuuugaacuuacaaaaaaguugcaagaacaaugcaaagaacucccauauauauuuugcacugcuuuuuaacaucuugacauaagugcuuuacugaaucuuuuuuuuccgaacuauaggagauugcauugaauauauuaugaacuuuaaugcuuugauguguuugcuaauaacaaagauucuuauacauacacacaguugagugaugcaauucaggaaauguaacauuaguagaauaaucugcagucuauguuauacuuuugucaugguaauacucuuaaauuucuucggauucauuaucuaauccaaggccauuauauaauugucauuccucuuagucuccuucaauguggaacagccccucagccuuaauuuguuuuguuuuugagucuugcucugucacccaggcuugagugcaguggcgugaucucggcucacuacaaccucagccuccugaauagcugggacaagugugcuccaccacacccaacuaauauuuguauuuuuaguagagaugggguuucaccauuuuggccaggcuggucucaaauuccugaccucaagccuuccaaagugcuggauuacaggcguaagccacugcacccagcccucggccuuaauuugaauuuguuugaugcuucaucauuagauuuagguuauagguuuuagcugaaaagccaccaaaauggucaugugucuuuaguguauuucauccagaggcguaguaauguucauuugucccauauuggugaugucaguuuucaugaugugguucagguguugaccagcuuguccacuguguaguuaauauuauuccuuugauaauuaauagaaaaaauaauggggagauaauuugagacuaaauauuguauucucuucuaacaacuguccacuccauuuaaacccuauugauucuugguugaaucagugauauuuuuccauggaauuaucugguguuuuucaauauguuuauugaguggaaacagguauucuauucaugacucaaacuuuauuguguuugaaaacuauuggaaaguccuagcuuuccccucccuaccaugauuuuuuucauuuaagaagcuuacuagugaguauaguuaguaaagauaauuuucaggauuuugucaaauauaaaaucauuuacuguaaaugaugccugucaauucugucauaaaucauauggggaagaaaacuuaaaaauuguuacuucaagcauuagguuauauauauuguauguuacauauauauuauauauaaacuguaugauauaggaaauggauaucuauauugauuuacuugaccaaauggcaaauuauuuuaaauaagaauuuagauauuuuaaaaauaaugccaucuuucgcuuuguaaacaaauagucaaaaagaucaucuagacaaauacgugaucauuugcaaaugcuacauuauuuaacucguuaaaaguuuucaguuguuagcaacacaaauaaugaaauucuuagcacuuuaaaggaaauaguuucuauuagcaauuaaagaugucagauugcuuauccaugggaauauuugccaaaaagguuccuuuuuaaauuugaauuuccugaguugacagaauaguuaggagauuagcauuuaaauaacagguauuccaagucaaaauaacuuugaaaaaaaguguuuuaucuggcugggcgcaguuguucaugccuguaguccuagcauuugggaggccaaggugggcagauugccugagccccacgaguuugagaccagccugggcaauguaguaaucaccccaucucuaaaauaccuuuuuuuuuuucuucaacagaaaauuauuauucaaguucaguuuuuuauuaugggggaggggaacuacucuguccugugccucaacugcagggucagaauuuuucuuacuguguuacuguaacaguggucugaucauauuugguaguauggaaaagguauguuuaaaaaugucuucauuuauuuaaagaaaugcagugcaaggaaucugcagguaacucuauaaaggauauaugcagaaauaggaaugaaagaauuugaaaucuggggacccuaggauauucugcuugcagcuuccuuauuacuaggaccuuagccaaacaauguaacguuuuuucuuuccaacuauuuauuauaaaaauuuucaaacaaauuugaaagaauaauauauagucaauaccugugcaccucuacauaggcucaauaaaugcuuuauauuacucugcuuauauaaagaauaguacccuguaaaaccacaaagaauaguacccuguaaaaccacaauaccauuaucacacuuaaaaggaacaauaauguucaaaucuuuguuuuuuugagacggagucucuguagcccaggcuagagugcagugccacgaucucugcucacugcaggcuccaccucccggguucacgccauucuccugccucagccucccgaguagcugggacuacaggcgcccgccaccacucccggcuaauuuuuuuuuuuuguauuuuuaguagagaugggguuucacuguguuagccaggauggucucgaucuccugaccucgugauccgccugccucggccucccaaagugcggggauuacaggcgugagccaccgcacccggccuguucaaaucuaauuuaauauucaguucaugcuuagauuuuuccuccaugugggcuucuagucacuagccauuauacgaacugaccuaagaaaucuaaaauacaguauaauuguggaaauagcuauuaauauauaguagguuuauaacugacucuuucuuugaucaggaguuuuuugcauucuucauuagcugucucaguauuaggucuaucaauauuuuggugggcauuugaaaaaauggauuauguauagcuacucacaaccacauaaaauugcuucagagaauuuaagcaaaccuuuuuagaagauuuuaugguacaauaacuucuguguagccagguuauccuuuguauaaaaucuuaucucuaaaauucuaguugcuauucuccauacuuccauaguuuuuuaauuuuuagcuguagauacuuggacuuaauuucagagaguacaaaggaaugcuguacacaaaaggggcaaaucuuuguaauuuuggauuuuaagaaauuuauaagagcauguauuuucuuaccuuuuugagacagggucucacucuguugcccaggcuggaaugcaguaauguaaucauggccuacugcagccuugaccugcacaggcucaggugauccucccaccucagccuccagaguagcugggaauacaggugcauaccaccacacccggcuaauuuuugugguguuuuggguugguugguuguuguuuuugguagagacaaaaauaacaaaauuuuguauuuuuuuguuuugccauguugcccaggcuggucuugaacuccuggacucaaucaaagaacauauucuuuaccacuuugaauauuuuuuuacauuccacauuauagagagagcaguaauuuuuacaucuguuucuggguuaggaauuaggaguguuauuaaaauggcauuuacuuaaaucaaggccaaaacuaaggauuuagguagaguguauuagccuuucaauaccugcuuauuaaacaguuguuuucauacuuuucaaagguguguagaaguuuuguaaauaaauuuucugauaggauaaacuagauucccuaugaucucuuauuuauuuaucauuguuuugagacagagucucacucuugcccaggcuggaguguaguggcgcaaucuuggcucaccacagccucugccuccugcauucaagcgauucuccuggcucagccucccgaguagcugggauuacaggcgcccaucaccacaccuggcuaauuuuuguaucuuuaguagagacaggcuuucaccacguuggccaggcuggucucgaacuccugaccucuggugauccacccgccuaggccuccgaaaaugcugggauuacaggcaugagccaccaugcccagccugaucuaaaaggaaguuuuuacuaauugagauuaugaaauuuuaugaaaaauaaaaaugaaagaggggcacaauaucuagcucuguauuuaaaaauauuaaaaggaucuugacuuuucuaguuaaugggaaaaucugauuuauuaaaacuaaaucuuuauuuccaguuauuuguaauuuguggugcaucaggcuuagggauucaagauaaacuuuuugagcacaucuccagucuaugccacugaaaacucaaguaucuucauguagcuaccugauauuccucaguugauuguaaguaaaccacuaugauguugcaucagaauuuguauuauuuaccuauaaaacaguuugcaauucuaagcaucccacaauugaaguguuuuggaauuuuacuuuaguguauucaguuaugcuuguaagauacuuuuauggguaagaagaaaaguuuacaagcugcaguuugucauuuuuaggagacugugcaaacuaaaaaugcagaauugcauuguuagcaaaccuuggaaaguaauuuuguauguggaggacuaguccuuaaaaguucccaaaaauuguggccuuuuaguagaaugaaauuuacugaugccuacugacguauuugccuggauuauagucacauaaaauuguccaaaguauuaacaccuuuuuuucaauaguacaguuggcuguugaauuuagagauucucaagaaaagucaucugguaguaacuuuguagacccccccaccaucuguauauuuuuauagguuuuuauguggauauagguaaaaaaaaaaaaaaguaggccgggcuugguggcucaugccuguaaucccagcacuuugggaggcugaggcgggcagaucacucgaggucaggaguuuaagaccagccugcccaaccuggugacacccugucucuacuaaaaauacaaaaauuagccaggugugguggugugcaccuguaaccccaacugcuugggaagcugaggcaggagaauuacuugagcccuggaggcggagguugcagugagccaagaucaugccacugcacugcagccugggcaacagaguuagacuuugaaaaugucuuuuuucagguucuuccauccacguuauuuuuucagggaagaugaggacauuaucuuccuaaauugcuucuaaaauuuauuaacuuuuccaguaucuguuguguaaaugcaugccagacacugcaugggaagaugggggauggugagucaaggaaaucuggaagaacaggacuugugaacugagguuugaaguacauguaugaguuaagcagagaauaccuggcagagacugccagugcagaggccuuaaaggaaagagagaaaacaugcuuuauuugaugaguugaaacaauuuuagcuugaugauuuauaauuuuuuacauuuuagaaauagaugaauggcguguuuuuuuaauuuuuaagcugaauuuugcuucuagucauucccaguauauuaaagcagaugacuuguggcuuacaugaacguuauagaaauaugagaauaauauagaaauauuauagaaauaugagcuuaauggucauuagcucaucuagaauuguaacuaagcagugagggagaauaauuggagaauaagcaugaacaucugaaauaauugcuagguuaauaaguuggcuguaauuuugcucuaggaagagcuuaaguugagauaucauuuauaauucugggcccuuauuuuacucaaaugccuacauaaauuuauaaguuaaaugacuguggaagcuuccuguucaauucucaaaaaaaaaaauuacauguugauuuauaaauucucuuuugguuucuuuuucuuuauuuuuaguuucuauuugaguauugagaaacuaauacaauuaagaagccauaaaauuuucccuuuaauagucuucauagcgauugaggaaaauaugacaguaauuggccagaguuuucacuuuuugagagggggaaaaacauuuccuaagauaaaaaauugguuauuuuccauaguagguaaaaccugagaaguugcaugaguuugauuccuagaaauguuuuuaccaugaguaaaauuuguuuuuacuaaaugggaauccuaagauaccacauugccagcgucuagcuuauccaaugacauacaguuucuaaauugacuuauuuuguacagaaaaaagauugcuuauuuuauaugaauuuuuuaaaugaaaaaauggaaaguuuuccccccuuuuggauaaauauuuaaguuaauuugcauguguuuacuaaaagggauaauuuuaccaaagggacaaauauuuaauaaccaagauuaagagauacuacuuauuuuacugauucuaguaucaaagucugaaacuuaguuuuaaacagaacccuguaaaauguuuugaugucuucuggauacuuuuggaauacccaaagacugguuaaaauugagaaaagcgaaagcacaagaacaguaguuuccaaacaucucucaaaacccaaaaacaucgcgccauugcacucuagccugggcgacagagcaagacucugucucagaaaaagaaaauaaaacucaaaaacguuggcagaucaugucaguuucuaaauuuucuuuucuaauuuuauugauuuguaauauccaaaaauuagggagaauugccuaccuaggugguaugaggagagaaauauaaauaagaauguguugauguaauaguaaugacauuuuuuaaaagacagugguauuacaugaaauaaaauguuuuuauggguguuaagaguaaaugaggauuauaauggaacuuugaucacugaauuagaguucugauacaauuuuuuaaauugaugaauuuuaaaugaauuuauaucuguauucuuaguaauuaugugaaaagccuaacauuuguauguuuaagaaucagguuuuuuuaguacauucagguaggcugauuuaauaauuaguagaaaauuauuaaaugcuaggauacccacaaguauaaaaauuugugcauaaugucugcaugauagauaauccacauauuaauaguaaagucuauucucuagucacacuggccuccuugauguuccuuaaauuuauuccagacauuccucccuuagggcuuuugucuacauuagcucuuuuaucuguucuaaagauauuuuuccagauagcugcuuugcuagcugcuuuacuuucuucagaucuacaaaaauguuaacuucucauugagaucuacugugaccacucuguuuaaaauugccacuucuauccccugcagaacuccuuauccuuuaccaaguucuccuuuuccccuauaauacucaucaccuaauguacugaauaauuuacuuauaguuugucucuuuuguauguugcuauauuccaggaagcuacaauaaugcuuggcauauaauggcacuaugaauacuuguugaauuaaaaauccacagugggaaauaauuguauuuuacaaguugaauuucuaaaaauucaaaggucucaaaaaaaguaaaaugaguuauuucaguuuauaacaagauguauuuucaugaauauaaaauugugauuggcugauaccuuuacugugacagguuaaaaaaaugucuuuauuuuuagaacacuaaaaagaaacuguucuuuugaauugucuaauaccccuaaauauuuaaguauuucagaguaagcugcuuucacauuauuuagaauuauguugauguauaacauaagagaaagauuuauacuuuuuuuuuuuggagucagguucuuacucugucacccaggcuggagugcggucgcuugaacuccgcucacuguaaccuguaaccuccaccgugugggcugaaguguuccucccacuucagccuccugaguagccaagaccacaguugcaggccaccacgccugauuaauuguagagacaaggucuuaaguugcccagccuagucuugaacucgggcucaagcaauccucccgccucagccucccaaaguguugggauuacaggcaugagccacugugccugaccagauuuuuaccagaucuggcuucuuuaauagauuacuuuuggaauuuagugccucagugaacauuggauuuuagaguuuuuaguuacuuuucaagguaguuugcacacauuuuuuuucuaaucuuuuugaaagcuugauauuaauaaaauacuaugaaggagacuagcagguaauauggugaguuagguuacucagauuagcucucucacugaaaacagcuaaggcugcuagguagaauuuuaagaaugucuuauuaacauugaacuuacagcacuaaggaauuaccaggucaaagccuaauggacuggggagggagaaaaaaggaacgcgaggagauaagcagaaugccuaaacuguuuuggcccugaaagcaacugccaaacugggaagacuugagcuucaauuuuaaacgcuucaggaccucaggcagcaaaagucaaaacccaaggccugcccaagguacaguguccaaugggauauccuuuccccuuaaacuaugugcuccaaaagcuacacucaggaugacagugaucuagaaguaaauccaugccaccuuccuaccuguaagggacugagaaaaguugcguccgucugaguagagcagaaugggggaauccugagauguucuuuauguggauuugugugaauaaacaucaccugagaaugauucagaaaaacugaagccauguauguaaaguagacucagccugaauuauaccccuaauaggugguaauagcuuauucauacccuuucuggaggaaugcaccuucuuccuacgccucagagaguuuccacaauaaucuuugaagggaaaggaacagaucaguuguuaaaaauaagcauauaaggaaaccacauacaucagaaacagaccuccaaagacuucagaaacuagaauuuagauaagauuagcuuaauaacacaggugaagagagaauuggagaacugaaggcauccagaauggagcuuaaagagccaauuagauggaaaauaugaaagggauaucugagacacaaauugauagugugaaaaugugucuacuugaaguucuagaaguagaggaacuacauggggcggaagcacaauuugaagagagaaauacugaaauuuccagaaugauugaaggcuucaacagauucaagaugcucauugaaucccaagcaguaauuuuaaaaauucacaacuggacacaugaggaugaaacuauagaaaacuaaaguuuuuuuucuuaaaucacauaaaugguuggaaacaaaaagauaaaugaccuucaaaggaauggcaguaagguugguaacuucacagcagcaagggaagcuagaagacaguggaauugacucuucaguuugcugaaagaaaauagcugucaacuugaaaguucuguacccagagucauguuaauaaaauaccauuguggaaguuacgcaugcauuuuugaacauguccaauuguagguauaacuuaaauacauauauuaaauuacaagcucauuuauuaaguauccagguuucucuucauauuugcuuccuagccuaaagucacucuguuccaaugaaaguuuucauaagugaaaggacucuuacuggaauuugaauugguggucuguuuuuagcuucacuuuuuucagggcaaaaaugauuaugaguuuuauuuuuauguuuauuauaaguagaauuauaaaucucacuugauugguuuagugccacaaguuuacaguuugggcauuaaacaaguaguuucuuaaaugcugaauuucaguuaaauuuuuacccaaguauaucacuucaauuuuauuguuaaauguuuauaauaacccuuugacuugguuggaaauuaguauuuuuaauaaucuugaguuacgccagugucaaauuccauucauuaguauucauuuuuuagguuuggaaauuaacuaaaugaacuaaauuuuuaugguagugccucuggacuuuaccaguuuguguuaagguugauaguuuucuuuuuuaaaugcuuaaauuauacuauguuuagaggcugcaaagguaauccuuuacauuaaaaaauguuaaauaguuuugacaauauuauacaucuaauuucuguaugcauaaugcauauuguguuuuauuuguacauuuuuugcaaauuuuaacauuuuggggguuuuuggaauacgguuuugagaauugaugaaaauauagauauguguuuaaauguaaaaacucaaaaguuauaugucaccuagacauuccauauauauguguauuuauauucauauauguauacacauauguauauguguauauauuaaaauaagguucaaaaaucagaagauaacaaaagaaaccuacagugaaaagucaccuaccccuguucuugaggcaccaguuccccucagagacaauguucagaaucuagagauguuuaaugcacauacauucauguguucuguccuuuacauuaauaaauaucuauuacauuuuguuuugcaccuuuuuuuuauuaagaaaguaacuuuuggaaaucuuuuucuacaaguacauaauauucuauguuucuuuuaacuugucuccuacugaaggacauguaaguuuuuucccugucuuauauauuauuacagacgguacugcaguaauuguguacauaucauuuccauuuguguaaauauucuuguagauuaaauuccuagaaauggaauugcuggaucaaagaguauaugggguuuauuugaauuuucuauuuccuaauguucuuccacagagguugucauaguuuuaaaucccauugauaauccuguaaagggcccauuuuuccaaauccucuuuacacaauguuuuauaaucuuaauuuuugccaguacuuauaaguaaaaaaugguccucucagugugguuuucauuugcauuucccuuaugaaugagauugagcauauuuucauuuuuaagagcccuuuggauuucuuuuucugagaacuaaucucucuaguccauuuuuuuguuuuuuuuuuucaucuuuacaagagcacauuagggaaguuaagggaaacuuuuaauguuagcacaauuucccauuuagaaguugaaauaauuuugauaaaacauuuaaauaauguguuacauuuauugcuuuaccuguuuuucucauugucagaaauggaaggaaugauaaauauguucugagauaaaagaacauacuuuccuuuguuauuuugauguucuuacugaccuguuuuacauacuuuucuuuucuuuuuucuuuucuuuuuuuuuuuuuuuuuuuugagacaggauaucacuguguugccaaggcuggagugcagugugugaucacggcuuagugcagccuccaccuccuaggcuccagcaauccccccacuucagccccucaaguagcugggacuacaggugcaugccaccaugcccagcuaauuuuuguauuuuuuuguagagacagggucuugcucuguugcucaggcuggucuugaacuccaggacucagucuaaccaccagccuuggccucucaaagugcuaggauuacaggcuugagccaccaugcucggccuauauuuucuuucaaauguguguuuugugcuuaaguauuucuucuguuggccaaaucucugauuucccauuuuaauuaagucuuaauguuugcaaauuauuuuuuucaucuuuuuaagcuuuuuauguugcaucucaacauuagacaugaggagacucacauacuguuauauaaugaaaauaguuuuguacauauauauuuuuuuccugaaaacugauuugcuuaugaaauaguuaugaagaaaaaucuugauucacauuacagauuuucaauaaggucauguauauagagaauaauaaggucauguauauagagauaucaaaaucaugaaggcaucuuucaacaaucagauccuuuugaagugaguuuauauauaaggauuauauucuauuaacaguaaacauuucaaaaccaguuuucuuucccauuggugagcuaauuaaauacuuuauagaauuugguuuucaacaugcacacuuugcuauccaacaauguaucucaauuguaguaauuugaaagcuaauccauagauuauuuuauaucuuguuucugugcauuuugcaguaggaugaugggauauggggagaacagaaagugguuuuaugccugcucuccuuuccuuccucagguuuagguauugauugggaaagggcugccaggagcucaguuucuuugagaaacagcauuaggaaacuuguuguuguuguuaauuuaauuuuuuuauuucuuacaugucacagcuuuugauaaucugauaucucuacugaccuguuauaguagucauggacaaaauuagaccuguauaguagaaucaacuaggaagaauggccauauguguuuauuagauuuggggagccuuccacugcagacuucauuugcuggugaaaguaucaccaccuuaacccagagcuugccauucagguuuuuuucccuucaacugucuuuacauuuuaaugacagcaccauaagggucuguucuuagagcaggaauaucaauauaaucuucauuucauucuugccuacuaaagccuucauggcagcuuuccauauagcauuugaacuuaauucuuuaccuuugguggcaucacuuuggaaaauaucacaaauauaauuagaggagguaaaaugaaauacaaacauuucaaacuauaaaauaagauuccagagaaaauaggauauguuuucguuaagccuuuaaauguggccguguuuggagaaaugcacucaggaauucauaaaguuaggaaaaaguuuuaaaaucuaguagauuuuaugaaauaauuuuauaaauauucuggagauaaguacguagacugaagccauuaaaauagagccaaaauuucaauuuuggaacaugcccauuagaaaaaagaaauucacgucuaaaucuucuugauucuccuggaacuuaauauuuaccugaauuuuuucuuuguuuuucuuaauugguuagcuaugucuacuuuucaaaccuccaaaguuccuaauuucccaucuuuuacauggcuauuugaaacagcauuuuugcuucaaauagaaaucauguuuucauucaagaaaaguaauggaaaauggaauugauuugggugugcucacggaaagaucgaaauccugugaaaaaucuaacuuucaaaauccauauuagagcuucaauuauuccuccauuuuagucugaauuuacugauaguauuauacuuagcacccuuucuaaaccuuuuuauugaagugagguuuuaaauuaauauuuuaacaaggauuauaggacucauaaagaccuuucuguaaaaguuauacauuuacauuuuucauuucccuugauauuuaagacaguauaaucuaaaaccuauuuuugaaugaauaugugaauaguaacugguaguuuuauccacauuuauuuagcaauuauuauugaaugucugcuauauguuaggcuuuguucuaggugcugugaaauaaaaaacguuaugccuuuguggaauuuuuuaaauuauguugacucgcuuguuuucugaguaagcagaauaauaccuagauggacuacugagaaaauacacuuaaccuaaauacaugcacaaauaauauuuuuggaauuaagugguugaauuuuaaaaggcaagcauaaugaaguaauaucaagugauugaaaccugagagaugggagggaaaguggaguuugucaagauuguuacaaaaaggaaaacauuuuucuuauuuaaaaggguaauauauguguuuauuauaagaaaaaaacucuaauggagaaaaaaaccauauucccacuaccuuugaacuauaacuuaaucacaguuaacuuuuccagaucugucuauaaaaccuuaacuuuuuguagcuuguuuuuuccacaugguagcauauuuuuguguuauuuagucuauaaaaucgcuuuuaaugguggcacaguaguacauccuagauacaugcuguuuagccaguccuaauuaucauuuacaguguuuccaguuuuuguuuuauaagaaucucuugcaugaauacaauuuuauuucaauauuuuuacauagucauaauuguuucuuuagauugaccuuuuagaauucauauuuuacuaucaaagguugcuguugcuggugugaucuuuugaauugagcuggguaaugauuuuuuaaucuuucagaauuuaaguaaauaugaccaauguguacuuuguucaagaauagagaaacaggguugaauaaauauacaauuuuggggaaaacgaugauuauuugauaagcauuuucuaaaaaggaacuuggaauuaggucacuucaacaacaaaauagaaauaaacuauccauauaggauugagaaggcuagaauugggucauaauacaaauguugauuguauguucuuggaaaaagugauaggguaucaaaaacaguugcagaauagaauuagaauauaauuucugauguaaaguuaaaaguauuggaguagcaguauugauaaaaacuaaaguagucugaggaauauacugugaguuuuauagaaugaggaaaugggcuauuucuaaaauuaugcuucucuacuaauagguaaaaacuagaggagugggcaaguugcuuaaaaaauacagaaaagcaauccauugaauuuguaucuacuucauuguggaaguuuaauccuguuuuuggaaagugauuuuuaagaaagguuaaaugaagcauuacucaugauacuggguaucuacuauaaauguuauacuugauuucauagaauaaauaaauguguacuuagaauuaaauugccaacaagaaaguuacauggaaaaaaaugugaauucauuggaugacacugaaaauuaaguaagagaaauaguauucugauaggaaucucuaucaaaaugggaaagauugucuugauuagugaacuagaauaucucaaguagaggaaaugacuaaaggcuuuuguccagugauaauacaauugcuaauauuuuuaaacagcaguuuucaauuuguauguagugagaaguacaguaagagaugaaugaauuauaaacaguuuuaaguaaaugguuuucugaacaacuuccccucugcacauuaaaaaaaagucaugugacuaauggaagauuaacucagcaaacaaaagugagauuagauauuauaauauuuuauaaagcaauauauaaaguuccuguaguaauacuagagaaguuauauuguuuaauauuuuaaguuugccuggaaggacuuuuauuaagaugauaguucauaaaagcugcaaauuaagguagaaaagacuauaaguugaugugcaauaaacuaauauuagacguuugagggaagcaaaucagcaaucuacuugauuaccauucuggcugugcaguauggaauuaaugucauuuuuuguuuuuuuuuuuuagaucagagguuuaugaacuugauuucuugacuuuccugauagcuggagcgucucaaaugauuguacacauuucuuagucucaauuuuaauuaaccuuuagaaagaucuaugccacucagcaauuuugaggagagacaggggagaugaccuaaugggagguagaguagcaaaaccaauugagccaugaauguuaacuagugauuuugauacuucuggcuaaauuacucacuuuucucaaaaagcaaauacccugcuguauuuuucuuaccccaaaauuacagauuauucuuugaaagguaauguuuggcaugcuguugacaaguuauuuacagaguuuagauguuuauuaaguaaaguaggcugagucuauaaauguuaagugaugguuguugauagaugcccuauauauugggacaaaaucaaaucugagccaagguuuuaccuuugagauucuugacugaaauuaguauugucuaauuuaucuagcauuuauuuaacuuuuuaaauccucauaggccuggcuaagaauuugagaggauuuaaaaguagauuuuaaaguggggauguuuauguucagagaaaaauaccaaugaauuacuccgaagagaaacuuaccguucaaaaucagcuguaauuuucuuucucuuauuaaaaaaaaaaaaaaaucccuaaucugucaugagauuagagauaaaaaagaaaauguugaguuauuuuuuaaaaaucccaacucucuccuuugugaaauugauaugaaaauaaaauguaacugagacagaaaaauugucucaauccuuccagugaaaauaguuuuggucaacaguuauugugugcauuucuuccuacucaguauauauuuuuuggauuucacuucuuaaauguacuauggauauauuuccauucaguauuauacaucauugcuuuuaaaguuccuguggguguguauauaucuauaucucaucccauuguuuagacaaaacaauuacuuagacaaagcacaguuuaaucauucuaccuuuugguaauauagguucucaaauuuucuguguacucuuucaaugaacauccucauauauauauauauugugcugagagcaguauaguauagugguuaagagcucaguugugugaucugggggaaguuauuaaaucuccuugugccucaguuuucucaucuuuaaguagggaauaguacuuuaccugagugcuguuuauggauuaaaugaguuaauacauauaaaaucuuggaguagugcuuacaaacauuaaauauuuaauaaaugcugcuaguauuagcaguauuuagucauuuuaaauuauaagaagcugaauugcuucaacuuuuaaguguguaauaagcaaugaguuucuuauugccagauccuucguauacccuuauuuuugaccuguggcauauuccaccagaucccuuuuucuuauaauguucaucuuugacuucauacauauuauuauauccuguuuuucuuaugucaaguacucugggguucucuuccuuuuuguugccugggaauggauaguuuggagaaaugagucuuugcuugucugaauauucucuacuucagagaauauacuuaaugccuuagguauuguauacccuacauauuuauaagaaaaguuuuuuuuacaaaugacaaauaugcaucuuuaauuccacugucuuauugaugaaaccaacccccaucugcuaacuuuaaucagacaauuuauaccugaguugugucaccucauaauaaaccuaauaaaaaguaaacuuuacagcaacucucauaacacuuuucauucuuguucccauuaaaaaaaaaaaagucuguuguucuucccucuacauuacugguuuucucuccuuguucuaccuucucugagccaaagccaguauuaccccacuuaaggaugacagcaauagcaucuuuccuauuguagcuaguaccugcuugucucaucccauagcacuaaaagccaccucuguauucuccccagccuguauucccuaaccuacuuaugagucaucuuuuuucaacuuuccucauuguuuaccugccaggaaaaccucaguggcauucaguaagguuuucugugugucagauuuaacucugccuuuuuaugcccucuguaauggaccuucaccauaaucagccaacuuauuuuuccuaugcauauucuuuuuuucuugcuuggauguccucauuauuccaccaaaaacuaaagaaacucauguuguuucauugacuuguacagacuccuuuuuuucauuaauggccuggauaccaucugcucagugaagcuuuccuuguuaacucuaguuugcauggaacaccuuuuccucugaaucuuauaggacauagagcauacacaaaauaauuuaaacuuaaauuuaguccuuuauuguuuccaucauuaguuuuauguuuucaacugggucauaaacucuuuaauaguucagguccacauccccacuuccacuugguaaauccuaaggacacaugacaaauacuuuuuaguuggcuugggaaaguggaagacuaauuaauaccuaaugguuaguacaaggaauuaaaaugaaacuaaauuuaaucuagacccaaagauaaucauaguuuuguuuagcacauuucaauuuuaaucauaauuaaacuauacuucacaguggucuauaauuuacacucauuuuugacaaguaguucugugauauauuuaagggccuggauaauugaaaguuuauaggacauguagagguuguggccaaccuguuauaucuaaaucaguauauauuauagguauacauuuguauguacauauuuauauuuuuaauuuuauagacagaaucucaccauguugcccagacuggucucaaauuccuggccucaagugagugacccucucccuucggccucccaaaaugcugagauauaggcaugaacuacuacaccuggcauuuauaucuauauuuaauaugaaaauacaaauugcagaaacaauacaauuuaucauaggaaaauuaggaaguacagauaaagaaaacuauucuuuagguaguggcugccucccaaaauauaaccaaaauauaauuccaugaguuaugacuuaguuuaauccaccacuuuaucuccagugcuagaaaagggccuuaauuauuugucacacauaguaggcacuuaauuauuugucaaauaaaaaugaauuuauuugcagacacuacuuuccugauuucuuuaccuuaaaauugggagugggugguggaaagaagaauauucugcaaccacuccagcagcuaacuuaaaagccuguuuguagaucuuaaaaugucauucuucaauauuuccaaauuccuuaaaacgacuuguauucuguaaucuuccaagauauuuuucagguugcagaggauuagagaauagcugaaaagaguagugaaaaaguaaaugaacaggagaugaauuuauauuuaggauuccauuugcuuucagauuucaggauuuggcuaagcuuuuuggauaauuaauacaaguagaaucagacagcuucucugcaucucaaauucaguuuaagaugauugucuuaaguccuaggaaagucuaugugcuauacuuuagaguagaaaagaugcagggaacaaguuaggaaugcgacugcaauucauuuauucguuuguucacauugugaacaacuaccauaagaacucacuuuagauggauccuagcccugccucugcuaugugcccaguacugucugaaaaccuaaguguugacuugucccaaaugguuauugugugaaaaccuacacaaaguauauagagacuuacuuuuuccuuuagauuauaaagcuucuugguguuccucuauagaguuaugucagguuaauuuauuuaucaauuuuuuuuuuugagacagaguuucgcucuuguccaggcuggagugcaauggugcagucucgauucacugcauccuccaccucccggguucaagcaguucuccugccucagccucccaaguagcugggauuacgggcgcuugccaccaugcccagcuaauuuuuguauuuuuaguagaaaugggguuucaccauguuguccaggcuggucucgaacuccggaccucaggugauccacccgccucggccucccaaagugcugggauuacagguguaagccacugcacccagccucaaauauguuuuuaaaccauuucaaguuaauuguauaaugauucuuauaacuggugauuuuaaaaacagcguacuuuuuaaaacuuuugacuuuaugggauuuuuuuuuccccaagggauaagggaaaaaauugaauuugaggaaaccugucaaaaugcuguugacauagaguuuuauuucucuggucagaaaaaugugaauuuugucggcacuuacaucagcauuuccuaaaacauccaaugaagcaugaaauauguuccuaacauuaggaaaaacucauuuauuuuugaacaagugaauaucaugcuuucuuuagaucucaauauaaauauauuccagggaaaggacauggcuagucuaaacuguuaaaaauagauguuagucaaagggucauuagaccuuuucuggcaaaguuaacacuuuaaaaauuaaguaauuaauuuuguuuuaaccuauuaaguaauaggugaucauuaguuccaauaauuuaucugaggauaguuuuaguuccaaaagauacgugaugaccaauuaaugcuugggaaauaauuguggaaguuaacaaaggccuggaaauaugaaguauucaaaaguauugggaaaagaucuguguuuccucaucauguuauacuuguuuuacucucccuaagauaaccacugauuuuuuuuuuuaaacagagauggggccuugcuauguugcccaggcuggucucaaacuccugggcucaagagauccauucaccucagccuuccaaagugcugggauuauaggcaugagccacugcaccuggccguuaaccacugauuugaauguaauuaaacuuaaagguuaauugaucuugauauugcuauucuaauuaucauacucuucuauuaaaaaaaaggaaguugaagauuuaaaaaauuuauuauuuuuucucaauagacacuuuucauaucuuuguaaaauuuggauaauucauuaaaaagguaauguaauuguaugacaaauuuuuaugauaguauguguaccagauaaguauuuauuuguuuuuuguuuguuuguuuguuuagacagggucuugcugugucacccaggcugaaaauguaauggugugaucauagcacacugcagccuuaaacuucugggcucaagcaauccucccaccucagccucccaagcagccgggauuacaggcauaugccaccacaccuggcuuaaaguuaauucuauuaagagccucugucauugaaaaugaugcacuacuuuuaauagauuaaauauaagcaagucuuaguaaguuuugcaaaauuauuuguaugcauauaauggucuuauucauuuauuuauuuauuuauuuauuuauuuauuuauuuauuuugagacaaagucucacucugcugcccaagcuggaguguguggugcgauuucugcucacugccaccuccaccuccuggguucaaaugauucuccugccucagccucccgaguagcugggacuacaggcaugcgccaccaugcccagcuaauuuuauauuuuuaguagagacgggguuucacuauguuggccaggcuggucuugaauucguggccucaagcaauccacccaccgaggccucccaaagcacugggauuacaggugugagccacauguaaugugguuuauaauggucuuuaaauggagaccuauaauggucuuuaaauggagacauuuucuauugauuaauggcaggaaguucugagaaucccaaaugucaaaacaaaguaaucuuagguaucaagaauuuuuuuuuauuuuuagaauuuaaaccaggcuuugauuaucagguagaauggaauacuuauagcuaagauguuuucauguaaauauuaguaaguaauacauaggauaauaaucuuuuaaagaaggaaaauggugggauggcuaaagacaggguauuggugugcuagucucaccaauaaugccauuugaauauggccugcauuuuuccucugcaucaaaugggccaauuauaguaacaccauugcucuuucuggcuacuugguuuacauaguucuguuuagagaagauauaaugaaaaguuauacuccuuuaguuuauagcuuuguugacuaguaugauuuaugggcaccuggaacaucuagaugcuuuauauucuuuuuaauucuugauaacccuuugaaauggauguuauuaucauucccauuuuauagguggaaaagcugauacuguaagagaggaaguaauuaaugcaaugugaucaaauucuuuucauuuugucacacugcagauuuaaucuccaaagcacauugaugauuuuuuuuuuuuuuccacacagaguuucgcucuugucacccaggcugcagugaaauggcacaaucucagcucacugcaacauccacuuccuggguucaagugauucuccugccucagccuccugaguagcuggaauuacaagugugcgccaccaugcccagcuaauuuuuguauuuuuaguagagacgggguuucaucacguuggccaggcuggucucgaauuccugacuucaggugaucugcccgccuuggccucccaaagugcugggauuacaggcaugagccacugugccuggccaaugauuuuuaaaaguauuuuuuuaaugaaugauguuuuaaaaaauaaugagauuauagcuauugugguaaggccaccaguaccagcucuguagaaggucucucaaauaauauuuacugguugcauuaaugaaugacaaucaguggccacguacuagagaucagagaauuuuucuguauuagucaaaagugucuuucuacauacauuuauugggcuaauaccaauuuaccaauuaaagaaauaauugaugaauccaagauaugggaccacuuuguuggggacggguaugcaaaauuugguuauuucguagauauacauaauagacauaauuuuuacugaaaugcauagaugauaguaaagucuuuuuucuugucucuauuuuugcauccacccguaucacccugccaaccauaauuauguuuaacaaccuuguggguauuccuuauuuuucucuaugcuaauaauacauaaacauauauaggauuuauuuuuauuuauuuuauaaagauagauuauauaaauuuuacuaucuuuucauucaauaagaucuuguggcaauuccucccaauuaccuguuaaagcugaauacauaauauuccaugaugcgaaugcaucauaauuuauuaaacuauuuccccacugguggacauuugauuuuuaaacuguuuuugcuacuacaaaguuuacaguaaguaaucuuguacaauuaccucucuauucuguugcuuuuauuuuuauuuuauuuuuuuagauggagucucuugccugggcuggagugcaguggugugauaucagcucacugcaaccucugccucccggguucaagugauucuccugccucagccucccgaguagcugggauuacaggcgccggccacuauguccagcuaauuuuuuguauuuuuaguagacacgggguuucacucuguuggccaggcuggucucgaacuccugaccuugugacuugcccaccuuggccucccaaagugcugggauuacaggcgugagccaccaugcccggccugcuuuuauuuuuauaggauagauccuaggaguggaauuccugcgucaaaagauacauuuuuuuuuuauuagaauagcuguuacuaauggcuuuucaaaaaugcuguaacaauucauauuuccuccagcuguguaugaagugccuuuucauuacauggcuucaguaguguuaauaccuuuguaaguuuuugccauucuaaugguuuuuaaguaauaucuauuauuuuaauuugucuuucccacauuggaaguuuacacauugucauauagcuuuuaaccauuuaaauuuucuuuucugggaauuaacuauuaauauucuaugccuauuuucucaauggguagcuuugguuuuccugaccaguugugugaacuguauauaaucucaacugcaccuaggaagcuggugauuuaaauucauccuacuuuauucccacucuguuuaccucuacuaagccaagcagccgaaugcaaggaagcuucagguucuaugggaaucucaaagaagaggcccaguagagggccuagggaaaggacuaagaagcugacccauagaaaauuuggaaccccucaaaugucuuuaccccagacgaauguugacaucagccuggccucuuggcugaguccucccuacucuugaguagagauuucuuucugguuucuuggcagagggcuagcagcagcuuguuugcugccuacaccugcuacacagcugucaugguagagaagggucaauuucuacuacuuuaggacugccaacacagcuucagugaauaggcaggaaaaaauaauagcacaucugaaggauccaccaaccagaaaggaauauaaacuaaaacuaucagguccuuaacaaaauagagcugcuagaggagaaauacaacuggaacaaaguaauaugaacacaggauucaaagugcuguauuaaaaacucuggagucuaaaaccguuauguaugaaccaaauacaguaauaggcuaaguggaagagaauauucacauggagcccuaaaugaauugccuggggaaucuacuggacaaacuauuuuaacaccuugagcaaaaauucaaaggaaggguaaagauaacagauuucaaggacagaaccaggagaucuaacuuauauaguucuagaaggagaaaaaaggaacaaauagaagagagacacuuauucuugaccuaaaaaaagcccugaguauauggguucaaagggcaugcugaguuccaagcagauuuugugguaauaaaaguaaaugauaauuacucagugcucaaccugcuaggcaauauucuaaaggcuucacauuuauuaacucauugaguccucagaauagcccugacaaaguagguauuauuaucccccuuaaucagcugagggaaaaagagguuaaguagauagccagauugugaaccuaagaggucugacuccagagccuugauugaacugcuucaaaguacaaagagcuguguuuaagugugugcuaaaauuuaugaacucuaaagaucaagauaaaaaaguccagaagagaacaaguuaucagcaaaagcaaaaaagacugucaucagcauucucaccugcaguaguuuaagccauaaaacugggaauacuacucuauuacuguacuacuugagauaaaaggaccaaaacuucucuaaucagccaaaauauuuauuuaccuaucugggugaaacagauuugcugauuaacacaguugagcaccuaaccccacccacucugugaugaaaauacucaaagaaaagagaaaucuaauaguauuuaaucuuggucuuugcacaugcuauuucuccugccuggaauaacucuucccuuucuucagcaaauagcucagauucuccuagaaaaaguuaucuuuuucccggaaaucuuuugcaauuccccaagucuaagucuuuugcucuuccaaaaugcuguagcacccaguacuuucuucauuuuagcacuuaaccauaauaucuuacaaugaccuuccacuucguugucuuauuuuccccauaagauuguaagcucuaugagggcaggggcagaccugucuugucacagugguagcccccacgccuagcacaauaucugcaauauauuagguugauggugugacugaauguuuauauguaguccaaauuugcauaucuuuuuugccgcucagauuguucugguagcuauacagggaaaggaaagccuuaaguuuuucuucaguggauacauccuauucagguagaccuaucggguauguguauauuucuguauucaucucaugacuuuuacagaauuuuauuaaauucacaaaauuuauauguaaauguaugaaaauccauauagauucaauuuacacagguauauuuacaaugcauuuuauccauguuugcuucacacuucuguuauuuuugaaaguaacagaaaaauuaauaagaaacuauagggaugaauuugcaaaguugguuaaaaauuggucaaaaauucagacugaugcucuaaaaaaauaguauuaauucuauauuuuucuguuucucuucagauuaaagcuaaaaauuaugacaagguugaaaaggugaguccucaaauacuuugaauuuuauauugaaguuuaacuuaaaaccuaguauguauaagacagauguaguaaaauguuaauaauaauugaaucuagauagugauuuuuuacaaguuaauuguacuuauucagcuuuuuuauaugcuugaaaauguucaucauaaaaguuuuggaaaaggaaaagaaaauaauuauacuccccugacaaaucaugagaagcauuuuaauuaucuaaacugaaaauggggaaauuauuugcuuuuuauuuauaagagauaaauucauaaagggagcugaauuuguguuuuuaauguuccauuucaucuauguccaugugaaauuuauuuaacuggauucugauaauauauucuuguauuuaaagcuauuucagagaugccuuaugaagguuuugcacauugauuuauggaaguguuaucuuucauauguccgagaaaccaaggguaaacuaccaaguuacaaguaagugaaaccaggaucuuaagaaugcaagucaucuccaggcacacaguuaaucccacauaaacucacaccuucuguuagccccaagugggaagaauuaucaggauuugaaaagucaggauuuccuaagaauuaguaaccuugaaaaaagugcuucagagaaagucacuggcaugagucuuacucuggagaauugaaucgcccaagcccuuucuauacugaaacacuguauaauugcaacaccaaaccacuuuguugacagacuugucaaauuuuuucaaaaaccaucuucauacuugugcuaguaccacuuuugugaggucacaaugcaaugugcuacuuaagugaucuaaggggucucugacauuuguagugauauaagggaucucugacaauuguauugugaaguugccauccccacuccgaauuauacccaccuccccaucuuugccaaaucuaaauaauggaccuucuucugaggugccauuuuucuauguaacuaacaggcaaguuaugucuguuacuaaaauucugucuuuauugucuuuuccugauuauacuuuuuguuaugauuuuuguguuuugagacagaguuucagcucugucguacaggcuggagugcaguggcacaaucacggguucacuguagccucaaccucuugggcucaagugauccucccaccucagccuuccaaguagaugggacuacaggcaagagccaccacaccuggcugauuuuuuuucuauuuuuuuguagagauggggucuccuuauguuugagacuccaaacguagcagggucucaagcauaaguuaaugucccuaggcuggucucaaacuacugagcucaagcaauucuccugccucagccucccaaaaugcuggaauuacaggcauaaaccaccacaccuggucuguuuauugucuuauauugaaguggaaguucuuuuucccuaauguacccuuuacauuuuaacauaaguugcauuuuaauaaaacuauacuuuccagauuucuacauuuuacuuuagagcuaaagaucuuaaugucucauuaaugagagaaccacaaauuuccacauuugaaucugcuauguauagaauuaugcaacuuaaaugauauaaagauaaguaagacaugagccuuauuuuugauaagcucacaagcaguagauaaaggaaacaauuuaugaucuugacaagcuuaacaucaaagaacgacuuuauauacuuaaaagaugucuuuaauuuauguuuauagagaauguucaaguguuguucugauccugugaucagaagcuacauuuuaguuauauauacauuuauuauuuauuuauuuauagagacgaggucucacugugcugcccaggcuugucuccgacuccuggccucagaugauccuccugccucagccucccaaagcauugggauuccaggaaugaaccaccacgucuaucuucaaauaauaauuuauuuuuaauuuuuuuuagagacagggucuugcucugucacccaggcugaaguguaauggugcauucauaacucacuguaaccuugaaauccugggcuuaagcacuccucccaccucagccuuccgaguagcuaggauuacaggugcacgccaccaugcccagcuaauuuuuuuaauuuuuauuuuuuuagagacuggguuuugcuauguugcacaggcaggucuugaauuccuggucucaagugauccuucugccucggccucccaaagcagugggauuacaggcaugagccaccaugucuggccuaauuguagauaaauuuuaauaacaaaaaaauuuaaaaaccacgucuuucauguucauuucagagaaaaaauggcucaagcauaugacuuugcacuggauaaaauuggaauggaaauuauguccuaucagguagaguuaaaacuuuuuaauguaugcacuuaaauguaagaauaccaagaaagauauuaacauuucauuuuauuucuuagauuuggguggauuacaucaauuuccuaaaaggcguguaaguauuuguauaguuuuuuuuuacaucuacaguugauuuagcuaaaauauaauuuuuaguucuuugagaaaucuccauacuauuuuccauagaguuguucuuuggguagauauccaguagugagauugcuggguugaaugagauuugguuauaauauaauugauggcauuucuuauccaaucucagggaagcuguaggaucuuaugcagaaaaucaaagaauaacagcuguccgaagaguuuaucaacgagguuguguuaauccgaugaucaacauugaacagcucuggagagacuauaacaaguaugaagagguaaauuaggucagaguaguuguuuauuauaaaccaagccauuuuaauuucuaugcauuguggauuuguagauuauagccuuucuguaucaguguuacacuuuuuuuauugauuguaaugaaagcacuauaauguuuuugcaagguuugagagucuccauauaguguuauuuuuuagaggauacucugaagaacaauaguucuuauaaaacuauuuuuauucuuugcuaagccauauccacacauucauacacacacauacacauugucauugaccuauaaaacaguaccuuuugggaauuauguuuccaauaguaccuuuugggaauuauuuuuugguugcugugcaccuuuuucaccugauuacagugaugugaugauugguuugaauuugugaaguguguggcuacaauccaagaucuuuguguuauugguaucuacuuuuaauaacugagcuaaucaaucugaauacauaaauacacaugccaaauaagcucuagcauuaaaaggaaguuccuuggcugggcaugguggcuuacacuuguaaucccagcacuuugggaggccgagauggaaggauugccugagcccaguaguuugagaccagccugggcaagauggugagagcccgucucuaaagagaaaaaaagaaaguuuuucguauguauauugugauuuggaagaacuauauaggguagugaaauuguucccucacaggcaucagcugugguuuucaaacuuuaugguuuuuggauuuuaacaguuauugaagaucacaaagaauuuuuuguuuuuauuuuuuugagacagggucuuacucugucaccgaggcuggaaugcaguggcacaaucacagcucauugcagucucaacuuccugggcucaggugauucucccaccucagccucccagguagcuaagacuacaggcaugccccaccacucucaagcuaauuuuuuguagagaugggguuucuccauguugcucaggcuggccuugaacuccugagcucaagcaauuagcccgccucggccucccaaaauguugggauuacaggcacgagccaccaugccuggccaaaaacuguauuuuccaaaacaaaaaauguaguguguagugagaagaguggcauuguuuuauauuuucacaaaucucuuucauaucuaguguaauagaaaacagcuggauuuucauaucugcuuccauuuaguguguuauaauacuaaaugucacguagccucuguaaaacuccuguauuuuaugagagaggcaaauaaugucuuaguguuauaaugacaacuauuuugaucucauggacucccugaaagggucuuagaauccuuggaguacucacugagugguaauguuuaucuuuccuugcuacuucuguuugucuuuuuaaaaaguguuauacaacagaacuaguuagaaaagggcuauuagccaggugugauggcuaaugccuguaaucccagcacuuugggaggcugaagugggaggauugccugaggccaggaguuugaggccagcccaggcaacauagcaagacuaugucucaacaaaaaaaauuuuuuuaauuagccagaucuggcagggcacaccuguaguccuaugucugaggcaagaggauuacuugagcccaggaguucaagguuccagugaguuaggauggcaccacugcacuguagccugggugacagaggaagacucuguuuauaaaaaagaaaaagaaaagggcuaucaaagucaagccauggcuauucacccagaugaaucuguacauauuuuuuuuuucuuugagacagagucucgcucugucgcccaggcuggagugcaauagcaugaucucagcucacugcaaccucugccucgccauuucaagcaauucuccugccucaagcucccaaguagcugggauuacaggcgcacaccaccacacccagcuaauuuuuuuguauuuuuaguagaaacgggguuucaccauguuggccaggcuggucaugaacuccugaccucaagugauccacccaacucggccucccaaagugcuaagauuacaggcaugagccaugucauuuuuuuuucaguagaaucuuauaugaaauuauugagccuuuucaaaugauucuaucuuuaaaaguuccugauaaauggaaacuuacugccagcucauaagacauaagcacauccuccuugaucuuggaaauguauaaugugauugaaccuuuuuucccugcuuuucaugagcuguaugaaccuuuauuaaacaagaaaucuuuuaaaauaaaaauuuaaaguuauuuaguaaaugaauaaauuaacuguauuguacuaauuuuuaagaaacuauacuuaauuuuaaaauauuuuuguuuuuuucuaggguaucaauauucauuuagcuaaaaaaaugauugaagaucggaguagagauuauaugaaugcuagacguguagcaaagguauggaauuccaucaggcuauuuuaaugauuauuaugagucuguuguuuacagcagagcuuucccugucugguauuacucuugauauuuucagucauuagcaaucuuaacagcaauuaauugcaaagucugaggagaugacauauuugaaaugaaaucucucuuuguaagaacaaaauauaauaaauuggguuuagaagaaauuguuuuuuaaaauauggaaacagaagacauagagagagacaaggcucuacuuagaauugaugaaguaauucuuuucccucuauuauuuggguucaucugaauauuguauuacucuguggucuaauaacauagcucucagggacacauuuugauugugugcauaccuuuccauucauugacacucuuggaaguuaggaaaaauagccuauuaauacaaacuauugaaauuuuaaaagacaguuucuccaaagauggcaauaauaaugccaccagaucuucaauccuauugaucugucaacucuuacauccuggaaaguaaccuccuagaucacuuacagagagggcccauggguguuuuguuuacccacuccugggaaccuguucuugaguggguaauacucuuaucuuucucucuacucuuaaauaguuuuuagauuauauuaacaaagugguauuuggaaaaaguaggcaucuugaacagucuuccaaacugaucuaccccauccgccauauaucucaguuguuccuggcucaccaaagaauucuaaauccuuguugucuaggaauaugagacaguaaugaaaggcuuggaccguaaugcucccucggugccuccucagaauacuccucaagaagcucaacaaguagauauguggaagaaauauauacagugggaaaagagcaacccucuucguacagaggaucagacccuuauaacaaaaagagguaacaugauuaacccucaugggacuucaguuacauguauguuaggccacuugguauccccauagguuacuaaaauuuucuuaccccuaaucuuuuuuucuuuuguucuucagauucaauaauuccuauagaucuaucuccauauucacugaaccuuuguuuucaucauaugcagucugcaauuaagcccauccagugaacgcuuuauuucagauacuauauuuuucaauucuauaaauuuccauuuuagaaauuuuuuauuuuuuauauuucuuuuuuaugguguccauuucuuaguugagauuccuuguguguucauuaccaucuuuuucuuuguuucuuagaacauauuuauaauaguaguuauaaaguccucaucugccaauuccaacaucugggccuucaaccaccauggaguuuauuuucuuugauugcuuuuucucuugacugugguuuacauuucccuauuuccuguuuaaauuuuuucuuuuagauauuguacaaauguacaaaugaaacauuguaaagacuguagauucugucaucuuccucugaagaauguuuuauuuuagcaggaaguuaaauacuacugucagauuacuuggacuuuguggaggcuuaguuuuauacuaugaagacaggucuguuuuaguuuuaccauuaaucucagauuaaauaccuuauucuugggacauagucuuuacuccuaagacaaugaaaagucuaagguguuuaccccaaccaucuaauuggaucggacucaaauucuaaacuucaucucccuuaguugcugagguaucuauuuaacucuuucugccuuccagcuuuguuuucugcuggucuguuuguauucuucccuguguauguacauuuuagggaucagcugaggauuugagaacauuuaugcccagauuuucgggaucuggcuuucuccuuuuggggaugucuccucaauuuccagcugcucucauaggccagaacuccauguuacuucaagacaguaagacugcagcauuugacuugaguucuagcuaucccagaagugcacaacaugggcaugcguuugaagggaaaagccauauuuaaauauggaucucaccuaguguuguucugucuuuuuaagggcucagucuccugauuucugcuucuuuuggucauuuccaguacauuuagauaguugcuuuuguauuuguguuuuguuuauuuauaauuuuuacuugcugaggguuggucugauacaaacuacucugucagugccagacucuuaauuuggagcuuuauugaauuccucaaucuugccuugcuguugccuugcuaucuuacuugcaggucuuugcaaauauuguuuccuuugcccacuccauuuuuguaucuaccccauccuuacuccacuucacuuauuugccucugaccagcuucaucccuucuucagguguugugcuagaugucaguuccuuagugaagccuuucuugagucccuaaacuauguuaaguccugcugcuguaaguuuucagaguauacuguacuuucaucaucauaauccuuuugaucuuugcuuucugucuguccuccccguauacugcagacuucuugaauauaggaagucuuacucacugguauauucaccgugccuuccacauucccuggcauauaguuggugcucaauaaguauuaacuuaggcugggugcaguggcucacaucuguaaucccagcacuuugggaggcugaggcaggaggauugcuugagcccagggguucaagacaagccuuggcaacauggugaaaccccgucucuaaacaagauuuuuuuuuuuuuuuuugagauggagucuugcucuguugcccaggcuggagugcaguggcgugaucuccacucacugcaagcugugccucccggguucaugccauucuccugccucagccuccagaguagcuggggcuacaggcacccaccaccaugccuggcuaauuuuuuguauuucaguagagacaggguuucaccauguuagccaggauggucucgaucuccugaccuuaugauccgccugccuuggccucccagagugcugggauuacagaugugagccaccgcaccuggccacaagauuuuuaaaaauaagccagaugugguggcacacgccuggucucagcuacuugggaggcugaggcaggaaaaccacuugagcccaggaggucgaggcugcagugaaccauauuugugccacugcacuccagccuacgugacagagacccugcuuccaaaaauaaaaaaaauuaauaagugauggauagauggagggaacuuggauggaugauggugccagaaaucacuaaagcuuuuuauuucuaauuaucauuaauuuuugaggagccuaauuugguuaugauauuuacauugauaguuuuacaaauaauaauuauuuuaauugaauauuguuuguuaauuucuucccuuaguuauguuugcuuaugaacagugccugcuugugcugggccaucacccugauauuugguaugaagcugcccaguaucuugagcagucaaguaaacugcucgcagaaaagggaguaaguguuccuucccuauccccacuuugauauuuuugugguuuugauauagcaauuauuuacugaaaaauauaacugaauuuugguaauaaagcauaaguauugaaaauuuaaguuuacguucauaugaaucuuagugacacucauauaauuagaccuccuuagaauuaaaauaaacuggcaguuuuuuaacguaucaaaguaaugaaucauuuagaguacuugcaugguuauuuuguaaguuaaaauaaugaaaggaguuuuuggaauuuuuuuagaauccagaaaugcauauguguuuauguauguguguguguggauacauauauauguguguacauacauguaugcuuucuuagacacauaaauaaaauaaaguagauguaacuuuauuaauuuuauucucucacaacuauauuaaaauuauugaagaugagcuuucuuuuuuuucuaccaggauaugaauaaugccaaauuauuuagugaugaagcugcuaauauauaugaaagagccauaagcacuuuauugaagaagaauaugcuucuuuauuuugcauaugcagauuaugaagagguaaguaaaaauguuuagagccuucuuauaauucaauuuuuuagugcaggacugaacuuuuuuucuggcugcuuguuugccaggcauauugcuuuugguagacagagaugaugccaaaugaacaguuauuaguugucagcuuauacuauauuuaugcucaauggagaugccauugggggugggagguuauagccuuuggauuccuuggagcucaaauccugcuuauuuaugaccauauguugauacucacuucuucuguaccaccuuagagucgcaugaaguaugaaaagguucacaguauauauaacagacuucuggcaauugaggauauugacccuaccuuggugaguaacuuuacaaaucuuuuuuuccaccuuuacagucuuaucuaacaaaaaauaauuuaaauuuauauacaauaaaauucacuguuuuuguuguauaguucuauuaaucuugacaaauaacauugaguaugggauccccaccacaauuaagauagaaaacaccuccaccauccuccaaaaauucccccaugugaccccuuuguagauauaacccuucccucugcccuuaccucugacaauuacugaucuguuuucugcuagaauuuuuucuuuuuaaugcagcaguauaaaauagauacagaggcacuuucucuaacacuuucuuugugaucaugguuugaagucacuuuaugccacagaauuguugcuuaauagauauuucuuuuuaaaugaggcgggagaaaccgacauccugggaagaaauuagacugaaacucacuuuaugcuaaauccugcucuaucauagugguuuucaaagccccaagugcaaaagugcagugaugcucucccauugggagaggaaggggacaggcuugugggugugucucuagaaccucugccucaagucaauuauagcuacacuacuuuuucuuguuaaugauuuauauugggauuccacugcuauaauuccuacauuuauucaucaucuuauaauucauuccacaaacauaucuggcaaauauauugcuagagucuaugcauugugcuagacuccagcaacauuaaugacaaacuagaugaaauuccuuuucuugaggaacucauaguccauccauccauccaucaaaacuggguaauauagcuagacauuaucaauacugggcaaaccaggacccuacuaauuagucauuuguucacuaaacaaaacugcauacucaugauguacuggacacucuguaggugcuagguauaaaauggcucauaguuuauccaugaaguucuauuauauguuguucggaaaauagaguagugggcuuuuaaaaagaaaccaagaaaaugugaaguuaaacauguauugcaggcugggcgcgguagcucacaccuguaaucccagcacuuugggaggucgaggcaggcagaucacgaggucaggagauugagaccagccuggcuaaaauggugaaaccccaucucuacuaaaaaacaaaaauuagccgggugugguggcgugugccuguagucccagcuacuugggagccugaggcaggagaauggcuugaccccaggagacagagguugcagugagccaagaucgcaccacugcacuccagccugggcaacagagcgagacuccgucucaaaaaaaaaaacauguauuguaagacgugcuuguauuaaaccaacccuugaguuuuuuagauauugacauucauuaauggaguauguucuaguagugucacacuuuucacucuuaaacuuuaauuuacauauucuagaauuagauaauggugaugauugcacaaccuugugaauauauuuaaaaccacugaauuguaaagggugaauuuugugcuaugugaauuaugucucaauaaaaaaauaaauuaauuugcaugcaucucuaauaccagaaaaaaauuaguuuguggauuuaaauagaauauuaucuaaauuccuacuuucuaauuuauuggguauugaggauugcuuucuuaugcaggaaacauacugucuaauuuauagaacacaaauacuuucuuuugcauagguauauauccaauauaugaaauuugcacggagagcagaaggcaucaaaucuggaagaaugauauuuaaaaaagcaagagaagauaccagaacccgccaccaugucuauguuacugcagcacucauggaauauuacuguaguaagguaaauacugaaauacaaguguaaagauaaaacaacuuccuucaucugagguucguaaaagaaaggugauuuuagcuucugucauuaagcuuuuauugcuccauuuuguaaaggcagucuaaguguaucuguguaaaauuuuauggagcaucauccaaauccccaacuacuugcuaauuuaugcuucauuaaucacuauauuucuaauuugugcuuuauuaaucacuauauuaaucacuauuucgugauuucuaaucacuaaacuccuuugaauaguuucuagcucagcaauuuuuacuuaacaugauuuuaauuuguuuuaauucuuacauauuuugucauauguagguauaauuuuaauauucuuucaaguguuuuuuaucugacauuucauggaaaucuguacuuuacuuucuuuacuuguaggacaaaucuguugccuuuaagauuuuugagcuggggcuaaaaaaauauggagacauuccagaguauguccuggccuauauugacuaucuuucucaccucaaugguagguugauucuagaaucuauaaugauuacuuaauauuaaaccauguggaauuauguugcuagauuucuuccuucuugaauguauuauaauuuugacauagcagacaggcacuuguuaggcacucaagaaauacuugugguauaucaaccaugaauauauuuacugagcaaugguagauguuuuuugacucugcagaacugucuuuauucaguaaaguaccaucaguagugggauaaagcuucagagucagagucaggagacacagaguuguuuauauucaucucugaugacucugggcagaucaucuccuguuuccuggaaggaaaacaaacaaacaaaaaacccucuagccaccaaaacucaaacucaaaagaugcccaaauaguaaaguaaaacacuuugaggauacuggggaaaagauucaaaaagaaacauuuugguuuuuaguauuuauuuauuuauuuauuuauuuauuuauuuauuugagacagagucucgcugucgcccaggcuggagugcaguggcgcaaucucggcucacugcaggcuccgcccccugggguucacgccauucuccugccucagccuccggaguagcugggacuacaggcgcccgccaccucgcccggcuaauuuuuuguauuuuuaguagagacaggguuucaccguguuagccaggauggucucgaucuccugaccucgugauccgcccgccucggccucccaaagugcugggauuacaggcgugagccaccgcgcccggccgguuuuuaguauuuauuucccuauucuguuguacgaauaacacuggccauccuuuauugaguuccuaccaggcacugugcuagauaauucauauauguauaucauuuagucuaguuaacaacagugcacaauauguaauuucuuaacaaaaaaagauguaguauaaaaguugguuuuuuagcuaggugugguggcguaugccuguagucucagauacuuggaucacuugagcccaggaauuggaggucacagugagcugugaucacgccacuguacuccaucuagccuggaugacagagcaagacccugucucuaaaaaacauuuaaaaauaaaugaauaggccgggcgugguggcuuaugccuguaaucccagcacuuugggaagccgaggcaggcagaucacccaaggccaggaguuugagacuagccuggccaacacggcgaaacccugucucuacuaaaaauauaaaaaauuagcugggcgugguggcaggcgccuguaaucccagcuacuggggaggcugaggcaggagaaucgcuugaacccuggagggggaggcugcggugagccgagauugcgccauuguacuccagccugggcaacaagagcgaaacucugccucaaaaaaauaauaauaauaaaguaaauaaauaaauauaaauaaauacaucacuaaaaguuggcuuaagaaagaaauaugcaauuauaugucauguaaaugauuauagaauuagauaucauagguauaaaucaguaauuuuaauauuucagaaaaauagagcauuccauuuaccuaaauaauauaaaagaguaaaacuuaaauaugauuuuguauuucagcuuaaugauucuacauucugggaaaaagacuuaacuccaaaaaaugagauaguggggcauuuaauauuccucauaaaucuuaaauuguuuugccuaauuuuuuuuuaaaauaguuacuaguauauguauuuuuauuuuuuuaaaaggaggauaucugguguuagcacuauugucuuccaaaaucagugucuuagaugauucuuucauucaucuauccaucuauccauccaugaaacauuuauucauuaccuucugguuacuagagucugggaauacaaagaugaauaggauccagaaaaacguuuuugugggggaauccaauguguaaauauaauugcaucaucauuugauguuucacuguagcauaguucugagguuagguguauaaucuuaaacuucaguuuucucaucugcauaauggucauaauaagaauaccuuucauaggacuguugagaggguaaaugaguuuuugcauguguuucacuuauauauagaauguugugauuauuccauaaauguuaugaugaggguggugaucauuaaaaaugugcuaaauacuguaauagauuccugaaggaaguacuauggaagcacagagaagagaguauaauuuaaguuauagagcuaugcugcacaauuaugguagucacuagacuauuagguauugagcacuugaaauguggauagccugggcugggugugguggcucacaccuguaaucccagcacuuugggaggccgaggcaggcagaucacgaggugagggguuccagaccagccuggccaauauggugaaaccccgucucuacuaaaaauauaaaaacuagccgggcaugguggcgugcaccuguagucccagcuacucaggaggcugaggcggaagaaucgcuugaaccugggagacagacguugcagugagcugauauugcgccacugcacuccagccugggugacagagugugacuccaucucaaaaaagaaaaaagaaaugugacuaggccaaaaugaguugugguguaaguguguaaauacauaccagauuucaaagacuuaguacaaaaaaaaauguaaacuaucuuaacaauuuuucauauugauuacauguggaaauaagauuuggauauauuagguugauuaaauauauuaauuucaccuguuuuuacccauuuuauuaaauuccauauguggcuuguauuauauugcugauggacaguaguguucuagagggugucauagagaagggcacaugaguuggauuuugagagaugagugguaguuagccagguaaagaaagauaaaugcauuauuccaggcagagagcacaacacauaggcaggcagugugaaaguucuguggaaugguaaaaagugugucuggagcaaagcuugggauaaaacagaaaaagauaaaauguaagauuuguuuaacauuuuuuaaaguauaauauguuaaauugaagagagaagccaaaaaaauagcgccaucuucuuuggucuaauauauuuaauuucuugguuuuauuuugcuuauggacauguaauaaacugaauaacuacucucaggcaauaaaaaacaacuccucugcuggguuaauuuuucuuuugaacagcuuuauugaaguauaauuuguauacuauaaguccauccauuagguguacaguucagugguuguuaguaguagauucaaugguuguuguuacuguuagauucuuaaguuuuaaaagauaacuuagaguuuagcaagaagugucauuuucccacuuccagauauagaggaccuccugagacucuuaaaauuuaauacaccucugucaacaauucuuaauucauuuacauuuccauaguuaccugccaaccuagauauuguaccucugcaagaguuaaaguagcuaaauauagcauaguccuggugccucaaaauaagaaacucaauuauuucuaaguuugaguuugccauccuuccauguucaauguauuuaaaaaauagcaguagucugacuaaugucagcagauauguacuugucauuauuuuuaaaaggcaaaugggauaccugguucagacggcacuguuauaaaugguuuugcauuagaacugcaguauaguagaggagggcugaacuagaagggaaaaaaacauggcuugcaguuacugcucugcuacucaaucaccaagagccagaucaaaucucuuaaucuuucugaagcucaaguuuccucaucuauaaaaaucaagugugauaauaguuaaaccuuucugcauaggauuuuuguaaggaugaagugagauaaugcauaugaaaauauuguugcaucguaaaagugaauuaaaaaaauuaaaaucuuuuucaauauccuagaggacaauaauacccgaguuuuguuugaacgaguuuuaacaucuggaagccuuccuccugagaagucuggguaagccauugugaaaaguuguugaucagguucuaaagacagcuuucuuaccugaauuguggucuauggggugaauguuugcuugaguaugaguuucaagagaaauuuccuuuccuucucaaguuuuauuuuaccuaucagcaguacuuuuauaccuguuuaaaauuauuuuuaaauuucugcacagugauuagaauuguuuuuaagagaugccauagcaauuuauuaucaucuuucuuguauacuauauaucccuaaccagaaauuguggcucaugucuguaaucccagcauuuugggaggccaagguggaaagaugacuuuagcccaggaguuugagaccagccugggcaacauagugagacccaaucuauacaaaaaauguuaaaaauuagcugggugugguggugcaugccuguagucccagauacugggaggcggaggugggagcuggaggacugcuugagcccaggagguugaggcuccagugagcugugaucacaccucugcacuccagccugggugacagagugagacucugucucaacaacaacaaaaaagauaccucucucucucucccuagaaauugauauuaacauguuaagagaggcauucugaaauuuucaccucccuuacucaaaagcaaagacucuuguaaauucaaaguuuguuuuacauauuaugucucugacuuacgguuuugucucguguuaguuuuaccauacagaggaacaacacugucaagugguacagcggaaauauuauaguaaggcuuuggagucuuggguucaauauccagcuagauggcaaauuucauagcuauaccaaucuucacuuucuuauuaacaauaauguccaccaguguaggauuuuuugugauagccacauaucugguauauaagaggcacuuaauauauuacuuuaguacaaaggugcauaaugacauuuaaguagucucagagcauuaauuuuagcuguuagaacaacgaugaggcaccaguuuuuccccagugauccacguuaaugggaaacaauagcguaaucauauuagauuuuggaguauauuucuauucauauauuagaugaagaauguauucuacauuauaauuccugccacuuaaaaugaagccacauuauucaggagaaauuagaaaucugucuagguuccuuuuccaacuucuccaccuagaguuuauccucucuaagguaagucucauguugaccacaaagaagcagcagcuauacuaaauaaguaaaaacucaaaaaugggcuuaaauacugaagugauagguuuauaauuuacuuugaaauacuuaagcaaaaauaagaugaagcaaauauggcaaaauauuagcaauauagguagugguauauagguauucauuauacuauucuauuuuucuauagucuaaaaaucuuuauaauaaaaagucacuuuuuauaaguuaagggaaaaagagagagcuuaaggcguuuuuguaaaugaacucccugcccuaaacccagaauaauuaaaguauugauuguauuucuuuucuugcagagaaaucugggcccgauuucuagcauuugaaaguaauauuggugaucuagcuaguauacucaaaguggagaaaagacgguuuacagcauucaaagaagaguaugaagggaaagaaacggcuuuacuaguagauagauacaaguucauggauuuauauccuugcucugcaagugaauuaaaagcacuugguuauaagguauguacuuaggaucaagauguggaguguccucacuuuuccaguguuuuagaagaguucauugauaaccugcacucuaaauucugaaaugugaaucuaguuuuagaauagauuugcaggaagcaagaaaaaaguucaaagauuuuccuuggguuuaggaaauccugagugucaaaguagcugaacaaaaugagaauugaaaugggauuuaauaguuucauucugucccugaaauugucagugccuuauaucuuauaucuggugggcaagauggagggaguguggagggaagaaaaacaaaagaaaaucugaaugucaucuuagguauuacuuuuuuuuccuaauaguucuuaucaaauugauaaauauguuuugacagaucuuaaaccaaauguaguuccuguugcauauuuuguaagauauaaugaagaaauauuacagcuuguuaaauccauaaaguuccuugagggauuuguauucuuaaaacagugcuccuucaguggccuuugggggaauuagcucaucuaugaauagaacucuucuauacagacuacugagucauaagaaaacaaaucuggcaccugaaccuguucaggccacagggagagauuaauauuuacaaagccccaguaacagcccuugcugauaaaaccacuguuauaucaucucuuaaucuuucugugacaugugaacaaagacuaagauggaaauucacagagaaguccuugguugaucucuuuaagccaaccaccauuaggauguuccugaccaucauucuccuuuuccucacugcccucuuuuagccugggucuugcucugucugauccagauaaaauauuuugagaaaaaacuacccauaauugauauucagacauuuuuguuaauggaagcccuauuucugugccagaugcagauuccugguaugaaccauaggauuacugcucagggauaaguaguuucugcuucuaguuuuaacuacuucucaaugaaaagucaaagauaguuuaagacuacaguaaauccucauuuaacaucauugauagguucuuagaaacuuugacuuuaagcuaaaugauacacagcggguccucaaauaacuuuuuuguguuuaacaugguuuuguuauaaccuugauaagaaaaaaauugguuuuccuauacaucguuucugucuuuuuuuuuuuuuuugagauggucucacucuguugcccaggcuggagugcaauggugagaucauggcucacugcagccuugaucucccugggcucaggugaucuccuguucagccucccaaguaguugggauuacaggcaaaugccaccacaucuggcuaauuuguguauuuuuuuguggagaugggguuucaccauguugcccaggcuggccucaaacuccuaggcucaaggaauccacuugccuuggccucccaaagugcugggauuacaggcagcagccaacacgccuagcccaucauuucucuaaaaguugcaguuuccuagaaccuauacaauguuaagugagggacuuacuguacuuugugcaauugcuagaaaaagcuauuucaacuuuuccaagaugaaaaugaaaauuaaggcaguuaauuaaaauaaagaucugccaggcacaguggcucacgccuauaaucccaacacuuugggaggcugaggcaggcgaucacuugagcccaggaguucaagaccagccugggaaacaugaugaaaucccaucucuaccaaaaaaagagagaaaaauacaaaaauuagccaggugugguggcgccugccuguggucccagcuauucgggaggccaaggugagcccaggagggaagcugagccuacuuuagugagccgugaucaagccacugcacuccugacugggugacagagugagacccugucuuaaaaaaauaaaauaaaaaauaaaaauaaacagaaaagaaagaucuuauaguggccaggugugguggcucacaccuguaaucccagcacuuugggaggccaagguggguggaucaccugaggucaggaguuugagaccagccuggccaacauggugaaaccccgucucuacuaaaauacaaaaauuggccgggcuugguggcgggcaucuguaaucccagcuacucaggaggcugaggcaggagaauugcuugaacccaggagguuguagugagccaagauagcaccacuguacuccagccugggugacagagugagacucugucucaaaaaaaaaaaaaaagagaguaaguauucaggaguagaacuacuuccugaauaugauguuuuccaucuuguauuucuauuucuacucuuuuguuuuuuggggaaggauuaaugugcuucuguguuuaacggugggugguaugguauguauguaucugugagaaagauuuuuaaaaagcgauacccaaugugucuaccauuuagauuugcuuauauaauuaauaccagaugucaccaacuccauuucaacaaauuuugagaaaguggaaugcuuuuauaucccuugauggcggcaaaaagggguucuuuuguuucuagacagacagaguaacacuggguugucuggagcagaggagcuccucugagauagggccucuguucauaggugacuguauugcuuccuuuggcauaucuugucucagcccuggcagggcaaugcuaguguacugaaaagaagacuguggauggauuugaggucagagaggccugcccucccaauccuccucucucuacuucuuauuagcugugugaccugggaaauaucaaaaccuuugugagcuucagucccuucuauauaauggagauguuacuauuucccucauuaaaaacagaauggcuaaaauugccugaugaauagugucugcucaguaaauauuccuuguccccuguaauaaauaguacauuggaaauaauuuuucauugcauuagcaaaaucuuaaccggugugaugccuucacaaaacaggaagucacuuaauccagcuucuucauuuaaugaaacugguguucaauucuaauggaagggaggugucagaagaucuaaaaucuugaauuuuccuccaaauuauccuggccucuacuugguucccagucugacuacccaaaaaagcuuguaucuguccuacaaauguccugccuggcaacacuaaguuuaaugacuuguaacuugugugggguaaaguuaugauacacugagucuuagaaccaaauagcuuuccuuguugaguaacaaucuuuaccaucauuagaguccuugcuuauccgucuccauuuucuuucugugguuuugacccagauauucacacuguauccucaagguuauugcaugauuauucucuaguagucccuuuuucagguuuaggauucuucuguucugcauuuucaggaugucucccgugcuaagcuagcagcuauaauuccggacccaguuguagcuccuucuauagugccuguucugaaagaugaaguggauagaaaaccagaauacccuaaaccagacacucagcagaugauuccauuucagccacgacauuuagcacguaagccaugacuuuagauccaguacugagacguugguuuguuuguugauuuaaauccaaagcguggggguaaagugacauggccucucaauuguggguuaauuauuagacuuaggaucacuaugacaagugauuuagcuuuaaucuuugaacuagauuaacuaagaauguccuaaaaacaaaacuucaaugauccagauuccaggaacccauuuuggcaguaauacuugguuuucagaaaugcugcuauggccaggugcagugguuuacacuuauaauccuggcacuuugggaggccaaggcagguggaucaccugaggucaggaguuugagaccagccugacuaacauggugaaacuuugucuuuauuaaaaauacaaaaauuuucugggccugguggcauauacauguaaucccagcuacuugggaggcugaggcaggagaaucacuugaacccgggaggcggagguugcagugagccaagauggugccauugcacuccagccugggcaacaagagcgacacucuguaucaaaaaaaaaaaaggaaugcugcuaugugcagauuaccugaacagcugguggaaacuuucuucacugauagauuugguuucuuuacuuaggaauggguuaguagccucucuagauucuuuuugaacaaggcccuucugauuaaauacacuguugaauaauugacuugaaacaggauugcuaaacaaaugacuuguguaacucagaaacacucuuugacaaaaacugacuuuaguucagucccugguugucuuacacaaagucacuugucuacuucucugccucccaguggccacggcauugagacugcugucucacccacuuugguuugguaaagcccuagaaguauuuucaguguccagaacaaagcagcagacauggaagaucuuuaugugcaagucacuugauuuuagcucuguguagaaauucuuccauuccacuugauucauacuuuucuuuuucucacagcuccagguuuacacccuguaccugguggaguguucccagucccuccugcagcuguuguuuuaaugaaacuucucccuccuccuaucuguuuccagguuuguucacuuauuuucaugguagauacuggcucugugggucauaguaauuguguauaaaguuacuacuacuuuaacuugucagauuacugggauuaaaauuuauucaugucaaaaauaggguccuuuuguacaaguggaugaacugauggaaauuuuccgaagaugcaagauaccaaauaguaaguaacagaagcuccauuucagagugucauuccacguuguugucucauaggcaguagagauuauuauucucugccacugaaguuuucgaaaccagccagccaauuugaagugcagugaaacccaggaguuacccaaacccucuuuggcagagaaaggcuuauucacauugaauuccacuaaguaaaaugucauaaaacuuuaucuuuucuauucaugugaacaugcacuaucaggcuuggcuuaugaaaauuauuaguuuuaacagcagcuuuugucuuuuucuuuaauuauuuaguaucaguaguacuaucccauguuuugcuaaaauaguaggcuaugaaauaaaguauccacaguugaacauacauacccuuucauaguggaauauguuuuuacguuuuguuguuuuguuuuaauagcuguugaggaagcugugaggaucauuacugguggggccccagagcuagcuguagaaggcaacggccccguggaaaguaaugcaguacucaccaaggccgucaaaaggcccaacgaggauucagaugaagaugaagaaaagggagccguuguccccccuguucaugacauuuacagagcacggcagcagaagcggauucgguaggguuuuaaacgccucugcagaaaacuccuguccaggauuccuuuugccucaagugguauguuuaaaagagacaacgcuuuguuacaagguucuuggaaacaaaguuguauugucauuggugccucuaucacaugguucuugagaaaaaacaaaccaaccugugugaauuuuagaauacggaacagaccuaugcucuaagcaaaauuagguuuucaaaaaugugagaacaguacaaaguggcagaaccacauuuuguucccucuucaagggugucuuguaugugccgcuugaagauuugugaguuuuucaacaguuuuauuuuaaaaacuggauggcuuaugauuguaaagcauuuuaucacauuuucugaaaacaauuguucuugguuugcuuauguagaguccugccuuauuguuuguuuuuauuuauggcagaauguaugaaauccguuuuguaguuucaaauuuuaaaaguccuuuaaaaaauaaaaggauucagaaaca

SEQ ID NO: 192923 - RNA, 76908 nt, Homo sapiens
uguuucugaauccuuuuauuuuuuaaaggacuuuuaaaauuugaaacuacaaaacggauuucauacauucugccauaaauaaaaacaaacaauaaggcaggacucuacauaagcaaaccaagaacaauuguuuucagaaaaugugauaaaaugcuuuacaaucauaagccauccaguuuuuaaaauaaaacuguugaaaaacucacaaaucuucaagcggcacauacaagacacccuugaagagggaacaaaaugugguucugccacuuuguacuguucucacauuuuugaaaaccuaauuuugcuuagagcauaggucuguuccguauucuaaaauucacacagguugguuuguuuuuucucaagaaccaugugauagaggcaccaaugacaauacaacuuuguuuccaagaaccuuguaacaaagcguugucucuuuuaaacauaccacuugaggcaaaaggaauccuggacaggaguuuucugcagaggcguuuaaaacccuaccgaauccgcuucugcugccgugcucuguaaaugucaugaacaggggggacaacggcucccuuuucuucaucuucaucugaauccucguugggccuuuugacggccuuggugaguacugcauuacuuuccacggggccguugccuucuacagcuagcucuggggccccaccaguaaugauccucacagcuuccucaacagcuauuaaaacaaaacaacaaaacguaaaaacauauuccacuaugaaaggguauguauguucaacuguggauacuuuauuucauagccuacuauuuuagcaaaacaugggauaguacuacugauacuaaauaauuaaagaaaaagacaaaagcugcuguuaaaacuaauaauuuucauaagccaagccugauagugcauguucacaugaauagaaaagauaaaguuuuaugacauuuuacuuaguggaauucaaugugaauaagccuuucucugccaaagaggguuuggguaacuccuggguuucacugcacuucaaauuggcuggcugguuucgaaaacuucaguggcagagaauaauaaucucuacugccuaugagacaacaacguggaaugacacucugaaauggagcuucuguuacuuacuauuugguaucuugcaucuucggaaaauuuccaucaguucauccacuuguacaaaaggacccuauuuuugacaugaauaaauuuuaaucccaguaaucugacaaguuaaaguaguaguaacuuuauacacaauuacuaugacccacagagccaguaucuaccaugaaaauaagugaacaaaccuggaaacagauaggaggagggagaaguuucauuaaaacaacagcugcaggagggacugggaacacuccaccagguacaggguguaaaccuggagcugugagaaaaagaaaaguaugaaucaaguggaauggaagaauuucuacacagagcuaaaaucaagugacuugcacauaaagaucuuccaugucugcugcuuuguucuggacacugaaaauacuucuagggcuuuaccaaaccaaagugggugagacagcagucucaaugccguggccacugggaggcagagaaguagacaagugacuuuguguaagacaaccagggacugaacuaaagucaguuuuugucaaagaguguuucugaguuacacaagucauuuguuuagcaauccuguuucaagucaauuauucaacaguguauuuaaucagaagggccuuguucaaaaagaaucuagagaggcuacuaacccauuccuaaguaaagaaaccaaaucuaucagugaagaaaguuuccaccagcuguucagguaaucugcacauagcagcauuccuuuuuuuuuuuugauacagagugucgcucuuguugcccaggcuggagugcaauggcaccaucuuggcucacugcaaccuccgccucccggguucaagugauucuccugccucagccucccaaguagcugggauuacauguauaugccaccaggcccagaaaauuuuuguauuuuuaauaaagacaaaguuucaccauguuagucaggcuggucucaaacuccugaccucaggugauccaccugccuuggccucccaaagugccaggauuauaaguguaaaccacugcaccuggccauagcagcauuucugaaaaccaaguauuacugccaaaauggguuccuggaaucuggaucauugaaguuuuguuuuuaggacauucuuaguuaaucuaguucaaagauuaaagcuaaaucacuugucauagugauccuaagucuaauaauuaacccacaauugagaggccaugucacuuuacccccacgcuuuggauuuaaaucaacaaacaaaccaacgucucaguacuggaucuaaagucauggcuuacgugcuaaaugucguggcugaaauggaaucaucugcugagugucugguuuaggguauucugguuuucuauccacuucaucuuucagaacaggcacuauagaaggagcuacaacuggguccggaauuauagcugcuagcuuagcacgggagacauccugaaaaugcagaacagaagaauccuaaaccugaaaaagggacuacuagagaauaaucaugcaauaaccuugaggauacagugugaauaucugggucaaaaccacagaaagaaaauggagacggauaagcaaggacucuaaugaugguaaagauuguuacucaacaaggaaagcuauuugguucuaagacucaguguaucauaacuuuaccccacacaaguuacaagucauuaaacuuaguguugccaggcaggacauuuguaggacagauacaagcuuuuuuggguagucagacugggaaccaaguagaggccaggauaauuuggaggaaaauucaagauuuuagaucuucugacaccucccuuccauuagaauugaacaccaguuucauuaaaugaagaagcuggauuaagugacuuccuguuuugugaaggcaucacaccgguuaagauuuugcuaaugcaaugaaaaauuauuuccaauguacuauuuauuacaggggacaaggaauauuuacugagcagacacuauucaucaggcaauuuuagccauucuguuuuuaaugagggaaauaguaacaucuccauuauauagaagggacugaagcucacaaagguuuugauauuucccaggucacacagcuaauaagaaguagagagaggaggauugggagggcaggccucucugaccucaaauccauccacagucuucuuuucaguacacuagcauugcccugccagggcugagacaagauaugccaaaggaagcaauacagucaccuaugaacagaggcccuaucucagaggagcuccucugcuccagacaacccaguguuacucugucugucuagaaacaaaagaaccccuuuuugccgccaucaagggauauaaaagcauuccacuuucucaaaauuuguugaaauggaguuggugacaucugguauuaauuauauaagcaaaucuaaaugguagacacauuggguaucgcuuuuuaaaaaucuuucucacagauacauacauaccauaccacccaccguuaaacacagaagcacauuaauccuuccccaaaaaacaaaagaguagaaauagaaauacaagauggaaaacaucauauucaggaaguaguucuacuccugaauacuuacucucuuuuuuuuuuuuuuugagacagagucucacucugucacccaggcuggaguacaguggugcuaucuuggcucacuacaaccuccuggguucaagcaauucuccugccucagccuccugaguagcugggauuacagaugcccgccaccaagcccggccaauuuuuguauuuuaguagagacgggguuucaccauguuggccaggcuggucucaaacuccugaccucaggugauccacccaccuuggccucccaaagugcugggauuacaggugugagccaccacaccuggccacuauaagaucuuucuuuucuguuuauuuuuauuuuuuauuuuauuuuuuuaagacagggucucacucugucacccagucaggagugcaguggcuugaucacggcucacuaaaguaggcucagcuucccuccugggcucaccuuggccucccgaauagcugggaccacaggcaggcgccaccacaccuggcuaauuuuuguauuuuucucucuuuuuuugguagagaugggauuucaucauguuucccaggcuggucuugaacuccugggcucaagugaucgccugccucagccucccaaaguguugggauuauaggcgugagccacugugccuggcagaucuuuauuuuaauuaacugccuuaauuuucauuuucaucuuggaaaaguugaaauagcuuuuucuagcaauugcacaaaguacaguaagucccucacuuaacauuguauagguucuaggaaacugcaacuuuuagagaaaugaugggcuaggcguguuggcugcugccuguaaucccagcacuuugggaggccaaggcaaguggauuccuugagccuaggaguuugaggccagccugggcaacauggugaaaccccaucuccacaaaaaaauacacaaauuagccagaugugguggcauuugccuguaaucccaacuacuugggaggcugaacaggagaucaccugagcccagggagaucaaggcugcagugagccaugaucucaccauugcacuccagccugggcaacagagugagaccaucucaaaaaaaaaaaaaaagacagaaacgauguauaggaaaaccaauuuuuuucuuaucaagguuauaacaaaaccauguuaaacacaaaaaaguuauuugaggacccgcuguguaucauuuagcuuaaagucaaaguuucuaagaaccuaucaaugauguuaaaugaggauuuacuguagucuuaaacuaucuuugacuuuucauugagaaguaguuaaaacuagaagcagaaacuacuuaucccugagcaguaauccuaugguucauaccaggaaucugcaucuggcacagaaauagggcuuccauuaacaaaaaugucugaauaucaauuauggguaguuuuuucucaaaauauuuuaucuggaucagacagagcaagacccaggcuaaaagagggcagugaggaaaaggagaaugauggucaggaacauccuaauggugguuggcuuaaagagaucaaccaaggacuucucugugaauuuccaucuuagucuuuguucacaugucacagaaagauuaagagaugauauaacagugguuuuaucagcaagggcuguuacuggggcuuuguaaauauuaaucucucccuguggccugaacagguucaggugccagauuuguuuucuuaugacucaguagucuguauagaagaguucuauucauagaugagcuaauucccccaaaggccacugaaggagcacuguuuuaagaauacaaaucccucaaggaacuuuauggauuuaacaagcuguaauauuucuucauuauaucuuacaaaauaugcaacaggaacuacauuugguuuaagaucugucaaaacauauuuaucaauuugauaagaacuauuaggaaaaaaaaguaauaccuaagaugacauucagauuuucuuuuguuuuucuucccuccacacucccuccaucuugcccaccagauauaagauauaaggcacugacaauuucagggacagaaugaaacuauuaaaucccauuucaauucucauuuuguucagcuacuuugacacucaggauuuccuaaacccaaggaaaaucuuugaacuuuuuucuugcuuccugcaaaucuauucuaaaacuagauucacauuucagaauuuagagugcagguuaucaaugaacucuucuaaaacacuggaaaagugaggacacuccacaucuugauccuaaguacauaccuuauaaccaagugcuuuuaauucacuugcagagcaaggauauaaauccaugaacuuguaucuaucuacuaguaaagccguuucuuucccuucauacucuucuuugaaugcuguaaaccgucuuuucuccacuuugaguauacuagcuagaucaccaauauuacuuucaaaugcuagaaaucgggcccagauuucucugcaagaaaagaaauacaaucaauacuuuaauuauucuggguuuagggcagggaguucauuuacaaaaacgccuuaagcucucucuuuuucccuuaacuuauaaaaagugacuuuuuauuauaaagauuuuuagacuauagaaaaauagaauaguauaaugaauaccuauauaccacuaccuauauugcuaauauuuugccauauuugcuucaucuuauuuuugcuuaaguauuucaaaguaaauuauaaaccuaucacuucaguauuuaagcccauuuuugaguuuuuacuuauuuaguauagcugcugcuucuuuguggucaacaugagacuuaccuuagagaggauaaacucuagguggagaaguuggaaaaggaaccuagacagauuucuaauuucuccugaauaauguggcuucauuuuaaguggcaggaauuauaauguagaauacauucuucaucuaauauaugaauagaaauauacuccaaaaucuaauaugauuacgcuauuguuucccauuaacguggaucacuggggaaaaacuggugccucaucguuguucuaacagcuaaaauuaaugcucugagacuacuuaaaugucauuaugcaccuuuguacuaaaguaauauauuaagugccucuuauauaccagauauguggcuaucacaaaaaauccuacacugguggacauuauuguuaauaagaaagugaagauugguauagcuaugaaauuugccaucuagcuggauauugaacccaagacuccaaagccuuacuauaauauuuccgcuguaccacuugacaguguuguuccucuguaugguaaaacuaacacgagacaaaaccguaagucagagacauaauauguaaaacaaacuuugaauuuacaagagucuuugcuuuugaguaagggaggugaaaauuucagaaugccucucuuaacauguuaauaucaauuucuagggagagagagagagguaucuuuuuuguuguuguugagacagagucucacucugucacccaggcuggagugcagaggugugaucacagcucacuggagccucaaccuccugggcucaagcaguccuccagcucccaccuccgccucccaguaucugggacuacaggcaugcaccaccacacccagcuaauuuuuaacauuuuuuguauagauugggucucacuauguugcccaggcuggucucaaacuccugggcuaaagucaucuuuccaccuuggccucccaaaaugcugggauuacagacaugagccacaauuucugguuagggauauauaguauacaagaaagaugauaauaaauugcuauggcaucucuuaaaaacaauucuaaucacugugcagaaauuuaaaaauaauuuuaaacagguauaaaaguacugcugauagguaaaauaaaacuugagaaggaaaggaaauuucucuugaaacucauacucaagcaaacauucaccccauagaccacaauucagguaagaaagcugucuuuagaaccugaucaacaacuuuucacaauggcuuacccagacuucucaggaggaaggcuuccagauguuaaaacucguucaaacaaaacucggguauuauuguccucuaggauauugaaaaagauuuuaauuuuuuuaauucacuuuuacgaugcaacaauauuuucauaugcauuaucucacuucauccuuacaaaaauccuaugcagaaagguuuaacuauuaucacacuugauuuuuauagaugaggaaacuugagcuucagaaagauuaagagauuugaucuggcucuuggugauugaguagcagagcaguaacugcaagccauguuuuuuucccuucuaguucagcccuccucuacuauacugcaguucuaaugcaaaaccauuuauaacagugccgucugaaccagguaucccauuugccuuuuaaaaauaaugacaaguacauaucugcugacauuagucagacuacugcuauuuuuuaaauacauugaacauggaaggauggcaaacucaaacuuagaaauaauugaguuucuuauuuugaggcaccaggacuaugcuauauuuagcuacuuuaacucuugcagagguacaauaucuagguuggcagguaacuauggaaauguaaaugaauuaagaauuguugacagagguguauuaaauuuuaagagucucaggagguccucuauaucuggaagugggaaaaugacacuucuugcuaaacucuaaguuaucuuuuaaaacuuaagaaucuaacaguaacaacaaccauugaaucuacuacuaacaaccacugaacuguacaccuaauggauggacuuauaguauacaaauuauacuucaauaaagcuguucaaaagaaaaauuaacccagcagaggaguuguuuuuuauugccugagaguaguuauucaguuuauuacauguccauaagcaaaauaaaaccaagaaauuaaauauauuagaccaaagaagauggcgcuauuuuuuuggcuucucucuucaauuuaacauauuauacuuuaaaaaauguuaaacaaaucuuacauuuuaucuuuuucuguuuuaucccaagcuuugcuccagacacacuuuuuaccauuccacagaacuuucacacugccugccuauguguugugcucucugccuggaauaaugcauuuaucuuucuuuaccuggcuaacuaccacucaucucucaaaauccaacucaugugcccuucucuaugacacccucuagaacacuacuguccaucagcaauauaauacaagccacauauggaauuuaauaaaauggguaaaaacaggugaaauuaauauauuuaaucaaccuaauauauccaaaucuuauuuccacauguaaucaauaugaaaaauuguuaagauaguuuacauuuuuuuuuguacuaagucuuugaaaucugguauguauuuacacacuuacaccacaacucauuuuggccuagucacauuucuuuuuucuuuuuugagauggagucacacucugucacccaggcuggagugcaguggcgcaauaucagcucacugcaacgucugucucccagguucaagcgauucuuccgccucagccuccugaguagcugggacuacaggugcacgccaccaugcccggcuaguuuuuauauuuuuaguagagacgggguuucaccauauuggccaggcuggucuggaaccccucaccucgugaucugccugccucggccucccaaagugcugggauuacaggugugagccaccacacccagcccaggcuauccacauuucaagugcucaauaccuaauagucuagugacuaccauaauugugcagcauagcucuauaacuuaaauuauacucucuucucugugcuuccauaguacuuccuucaggaaucuauuacaguauuuagcacauuuuuaaugaucaccacccucaucauaacauuuauggaauaaucacaacauucuauauauaagugaaacacaugcaaaaacucauuuacccucucaacaguccuaugaaagguauucuuauuaugaccauuaugcagaugagaaaacugaaguuuaagauuauacaccuaaccucagaacuaugcuacagugaaacaucaaaugaugaugcaauuauauuuacacauuggauucccccacaaaaacguuuuucuggauccuauucaucuuuguauucccagacucuaguaaccagaagguaaugaauaaauguuucauggauggauagauggauagaugaaugaaagaaucaucuaagacacugauuuuggaagacaauagugcuaacaccagauauccuccuuuuaaaaaaauaaaaauacauauacuaguaacuauuuuaaaaaaaaauuaggcaaaacaauuuaagauuuaugaggaauauuaaaugccccacuaucucauuuuuuggaguuaagucuuuuucccagaauguagaaucauuaagcugaaauacaaaaucauauuuaaguuuuacucuuuuauauuauuuagguaaauggaaugcucuauuuuucugaaauauuaaaauuacugauuuauaccuaugauaucuaauucuauaaucauuuacaugacauauaauugcauauuucuuucuuaagccaacuuuuagugauguauuuauuuauauuuauuuauuuacuuuauuauuauuauuuuuuugaggcagaguuucgcucuuguugcccaggcuggaguacaauggcgcaaucucggcucaccgcagccucccccuccaggguucaagcgauucuccugccucagccuccccaguagcugggauuacaggcgccugccaccacgcccagcuaauuuuuuauauuuuuaguagagacaggguuucgccguguuggccaggcuagucucaaacuccuggccuugggugaucugccugccucggcuucccaaagugcugggauuacaggcauaagccaccacgcccggccuauucauuuauuuuuaaauguuuuuuagagacagggucuugcucugucauccaggcuagauggaguacaguggcgugaucacagcucacugugaccuccaauuccugggcucaagugauccaaguaucugagacuacaggcauacgccaccacaccuagcuaaaaaaccaacuuuuauacuacaucuuuuuuuguuaagaaauuacauauugugcacuguuguuaacuagacuaaaugauauacauauaugaauuaucuagcacagugccugguaggaacucaauaaaggauggccaguguuauucguacaacagaauagggaaauaaauacuaaaaaccggccgggcgcgguggcucacgccuguaaucccagcacuuugggaggccgaggcgggcggaucacgaggucaggagaucgagaccauccuggcuaacacggugaaacccugucucuacuaaaaauacaaaaaauuagccgggcgagguggcgggcgccuguagucccagcuacuccggaggcugaggcaggagaauggcgugaaccccagggggcggagccugcagugagccgagauugcgccacugcacuccagccugggcgacagcgagacucugucucaaauaaauaaauaaauaaauaaauaaauaaauaaauacuaaaaaccaaaauguuucuuuuugaaucuuuuccccaguauccucaaaguguuuuacuuuacuauuugggcaucuuuugaguuugaguuuugguggcuagaggguuuuuuguuuguuuguuuuccuuccaggaaacaggagaugaucugcccagagucaucagagaugaauauaaacaacucugugucuccugacucugacucugaagcuuuaucccacuacugaugguacuuuacugaauaaagacaguucugcagagucaaaaaacaucuaccauugcucaguaaauauauucaugguugauauaccacaaguauuucuugagugccuaacaagugccugucugcuaugucaaaauuauaauacauucaagaaggaagaaaucuagcaacauaauuccacaugguuuaauauuaaguaaucauuauagauucuagaaucaaccuaccauugaggugagaaagauagucaauauaggccaggacauacucuggaaugucuccauauuuuuuuagccccagcucaaaaaucuuaaaggcaacagauuuguccuacaaguaaagaaaguaaaguacagauuuccaugaaaugucagauaaaaaacacuugaaagaauauuaaaauuauaccuacauaugacaaaauauguaagaauuaaaacaaauuaaaaucauguuaaguaaaaauugcugagcuagaaacuauucaaaggaguuuagugauuagaaaucacgaaauagugauuaauauagugauuaauaaagcacaaauuagaaauauagugauuaaugaagcauaaauuagcaaguaguuggggauuuggaugaugcuccauaaaauuuuacacagauacacuuagacugccuuuacaaaauggagcaauaaaagcuuaaugacagaagcuaaaaucaccuuucuuuuacgaaccucagaugaaggaaguuguuuuaucuuuacacuuguauuucaguauuuaccuuacuacaguaauauuccaugagugcugcaguaacauagacaugguggcggguucugguaucuucucuugcuuuuuuaaauaucauucuuccagauuugaugccuucugcucuccgugcaaauuucauauauuggauauauaccuaugcaaaagaaaguauuuguguucuauaaauuagacaguauguuuccugcauaagaaagcaauccucaauacccaauaaauuagaaaguaggaauuuagauaauauucuauuuaaauccacaaacuaauuuuuuucugguauuagagaugcaugcaaauuaauuuauuuuuuuauugagacauaauucacauagcacaaaauucacccuuuacaauucagugguuuuaaauauauucacaagguugugcaaucaucaccauuaucuaauucuagaauauguaaauuaaaguuuaagagugaaaagugugacacuacuagaacauacuccauuaaugaaugucaauaucuaaaaaacucaaggguugguuuaauacaagcacgucuuacaauacauguuuuuuuuuuugagacggagucucgcucuguugcccaggcuggagugcaguggugcgaucuuggcucacugcaaccucugucuccuggggucaagccauucuccugccucaggcucccaaguagcugggacuacaggcacacgccaccacacccggcuaauuuuuguuuuuuaguagagaugggguuucaccauuuuagccaggcuggucucaaucuccugaccucgugaucugccugccucgaccucccaaagugcugggauuacaggugugagcuaccgcgcccagccugcaauacauguuuaacuucacauuuucuugguuucuuuuuaaaagcccacuacucuauuuuccgaacaacauauaauagaacuucauggauaaacuaugagccauuuuauaccuagcaccuacagaguguccaguacaucaugaguaugcaguuuuguuuagugaacaaaugacuaauuaguaggguccugguuugcccaguauugauaaugucuagcuauauuacccaguuuugauggauggauggauggacuaugaguuccucaagaaaaggaauuucaucuaguuugucauuaauguugcuggagucuagcacaaugcauagacucuagcaauauauuugccagauauguuuguggaaugaauuauaagaugaugaauaaauguaggaauuauagcaguggaaucccaauauaaaucauuaacaagaaaaaguaguguagcuauaauugacuugaggcagagguucuagagacacacccacaagccuguccccuuccucucccaaugggagagcaucacugcacuuuugcacuuggggcuuugaaaaccacuaugauagagcaggauuuagcauaaagugaguuucagucuaauuucuucccaggaugucgguuucucccgccucauuuaaaaagaaauaucuauuaagcaacaauucuguggcauaaagugacuucaaaccaugaucacaaagaaaguguuagagaaagugccucuguaucuauuuuauacugcugcauuaaaaagaaaaaauucuagcagaaaacagaucaguaauugucagagguaagggcagagggaaggguuauaucuacaaaggggucacaugggggaauuuuuggaggaugguggagguguuuucuaucuuaauugugguggggaucccauacucaauguuauuugucaagauuaauagaacuauacaacaaaaacagugaauuuuauuguauauaaauuuaaauuauuuuuuguuagauaagacuguaaagguggaaaaaaagauuuguaaaguuacucaccaagguagggucaauauccucaauugccagaagucuguuauauauacugugaaccuuuucauacuucaugcgacucuaaggugguacagaagaagugaguaucaacauauggucauaaauaagcaggauuugagcuccaaggaauccaaaggcuauaaccucccacccccaauggcaucuccauugagcauaaauauaguauaagcugacaacuaauaacuguucauuuggcaucaucucugucuaccaaaagcaauaugccuggcaaacaagcagccagaaaaaaaguucaguccugcacuaaaaaauugaauuauaagaaggcucuaaacauuuuuacuuaccucuucauaaucugcauaugcaaaauaaagaagcauauucuucuucaauaaagugcuuauggcucuuucauauauauuagcagcuucaucacuaaauaauuuggcauuauucauauccugguagaaaaaaaagaaagcucaucuucaauaauuuuaauauaguugugagagaauaaaauuaauaaaguuacaucuacuuuauuuuauuuaugugucuaagaaagcauacauguauguacacacauauauauguauccacacacacacauacauaaacacauaugcauuucuggauucuaaaaaaauuccaaaaacuccuuucauuauuuuaacuuacaaaauaaccaugcaaguacucuaaaugauucauuacuuugauacguuaaaaaacugccaguuuauuuuaauucuaaggaggucuaauuauaugagugucacuaagauucauaugaacguaaacuuaaauuuucaauacuuaugcuuuauuaccaaaauucaguuauauuuuucaguaaauaauugcuauaucaaaaccacaaaaauaucaaaguggggauagggaaggaacacuuacucccuuuucugcgagcaguuuacuugacugcucaagauacugggcagcuucauaccaaauaucagggugauggcccagcacaagcaggcacuguucauaagcaaacauaacuaagggaagaaauuaacaaacaauauucaauuaaaauaauuauuauuuguaaaacuaucaauguaaauaucauaaccaaauuaggcuccucaaaaauuaaugauaauuagaaauaaaaagcuuuagugauuucuggcaccaucauccauccaaguucccuccaucuauccaucacuuauuaauuuuuuuuauuuuuggaagcagggucucugucacguaggcuggagugcaguggcacaaauaugguucacugcagccucgaccuccugggcucaagugguuuuccugccucagccucccaaguagcugagaccaggcgugugccaccacaucuggcuuauuuuuaaaaaucuuguggccaggugcgguggcucacaucuguaaucccagcacucugggaggccaaggcaggcggaucauaaggucaggagaucgagaccauccuggcuaacauggugaaacccugucucuacugaaauacaaaaaauuagccaggcaugguggugggugccuguagccccagcuacucuggaggcugaggcaggagaauggcaugaacccgggaggcacagcuugcagugaguggagaucacgccacugcacuccagccugggcaacagagcaagacuccaucucaaaaaaaaaaaaaaaaaucuuguuuagagacgggguuucaccauguugccaaggcuugucuugaaccccugggcucaagcaauccuccugccucagccucccaaagugcugggauuacagaugugagccacugcacccagccuaaguuaauacuuauugagcaccaacuauaugccagggaauguggaaggcacggugaauauaccagugaguaagacuuccuauauucaagaagucugcaguauacggggaggacagacagaaagcaaagaucaaaaggauuaugaugaugaaaguacaguauacucugaaaacuuacagcagcaggacuuaacauaguuuagggacucaagaaaggcuucacuaaggaacugacaucuagcacaacaccugaagaagggaugaagcuggucagaggcaaauaagugaaguggaguaaggaugggguagauacaaaaauggagugggcaaaggaaacaauauuugcaaagaccugcaaguaagauagcaaggcaacagcaaggcaagauugaggaauucaauaaagcuccaaauuaagagucuggcacugacagaguaguuuguaucagaccaacccucagcaaguaaaaauuauaaauaaacaaaacacaaauacaaaagcaacuaucuaaauguacuggaaaugaccaaaagaagcagaaaucaggagacugagcccuuaaaaagacagaacaacacuaggugagauccauauuuaaauauggcuuuucccuucaaacgcaugcccauguugugcacuucugggauagcuagaacucaagucaaaugcugcagucuuacugucuugaaguaacauggaguucuggccuaugagagcagcuggaaauugaggagacauccccaaaaggagaaagccagaucccgaaaaucugggcauaaauguucucaaauccucagcugaucccuaaaauguacauacacagggaagaauacaaacagaccagcagaaaacaaagcuggaaggcagaaagaguuaaauagauaccucagcaacuaagggagaugaaguuuagaauuugaguccgauccaauuagaugguugggguaaacaccuuagacuuuucauugucuuaggaguaaagacuaugucccaagaauaagguauuuaaucugagauuaaugguaaaacuaaaacagaccugucuucauaguauaaaacuaagccuccacaaaguccaaguaaucugacaguaguauuuaacuuccugcuaaaauaaaacauucuucagaggaagaugacagaaucuacagucuuuacaauguuucauuuguacauuuguacaauaucuaaaagaaaaaauuuaaacaggaaauagggaaauguaaaccacagucaagagaaaaagcaaucaaagaaaauaaacuccauggugguugaaggcccagauguuggaauuggcagaugaggacuuuauaacuacuauuauaaauauguucuaagaaacaaagaaaaagaugguaaugaacacacaaggaaucucaacuaagaaauggacaccauaaaaaagaaauauaaaaaauaaaaaauuucuaaaauggaaauuuauagaauugaaaaauauaguaucugaaauaaagcguucacuggaugggcuuaauugcagacugcauaugaugaaaacaaagguucagugaauauggagauagaucuauaggaauuauugaaucugaagaacaaaagaaaaaaagauuagggguaagaaaauuuuaguaaccuauggggauaccaaguggccuaacauacauguaacugaagucccaugaggguuaaucauguuaccucuuuuuguuauaagggucugauccucuguacgaagaggguugcucuuuucccacuguauauauuucuuccacauaucuacuuguugagcuucuugaggaguauucugaggaggcaccgagggagcauuacgguccaagccuuucauuacugucucauauuccuagacaacaaggauuuagaauucuuuggugagccaggaacaacugagauauauggcggaugggguagaucaguuuggaagacuguucaagaugccuacuuuuuccaaauaccacuuuguuaauauaaucuaaaaacuauuuaagaguagagagaaagauaagaguauuacccacucaagaacagguucccaggaguggguaaacaaaacacccaugggcccucucuguaagugaucuaggagguuacuuuccaggauguaagaguugacagaucaauaggauugaagaucugguggcauuauuauugccaucuuuggagaaacugucuuuuaaaauuucaauaguuuguauuaauaggcuauuuuuccuaacuuccaagagugucaaugaauggaaagguaugcacacaaucaaaaugugucccugagagcuauguuauuagaccacagaguaauacaauauucagaugaacccaaauaauagagggaaaagaauuacuucaucaauucuaaguagagccuugucucucucuaugucuucuguuuccauauuuuaaaaaacaauuucuucuaaacccaauuuauuauauuuuguucuuacaaagagagauuucauuucaaauaugucaucuccucagacuuugcaauuaauugcuguuaagauugcuaaugacugaaaauaucaagaguaauaccagacagggaaagcucugcuguaaacaacagacucauaauaaucauuaaaauagccugauggaauuccauaccuuugcuacacgucuagcauucauauaaucucuacuccgaucuucaaucauuuuuuuagcuaaaugaauauugauacccuagaaaaaaacaaaaauauuuuaaaauuaaguauaguuucuuaaaaauuaguacaauacaguuaauuuauucauuuacuaaauaacuuuaaauuuuuauuuuaaaagauuucuuguuuaauaaagguucauacagcucaugaaaagcagggaaaaaagguucaaucacauuauacauuuccaagaucaaggaggaugugcuuaugucuuaugagcuggcaguaaguuuccauuuaucaggaacuuuuaaagauagaaucauuugaaaaggcucaauaauuucauauaagauucuacugaaaaaaaaaugacauggcucaugccuguaaucuuagcacuuugggaggccgaguuggguggaucacuugaggucaggaguucaugaccagccuggccaacauggugaaaccccguuucuacuaaaaauacaaaaaaauuagcugggugugguggugugcgccuguaaucccagcuacuugggagcuugaggcaggagaauugcuugaaauggcgaggcagagguugcagugagcugagaucaugcuauugcacuccagccugggcgacagagcgagacucugucucaaagaaaaaaaaaauauguacagauucaucugggugaauagccauggcuugacuuugauagcccuuuucuuuuucuuuuuuauaaacagagucuuccucugucacccaggcuacagugcaguggugccauccuaacucacuggaaccuugaacuccugggcucaaguaauccucuugccucagacauaggacuacaggugugcccugccagaucuggcuaauuaaaaaaauuuuuuuuguugagacauagucuugcuauguugccugggcuggccucaaacuccuggccucaggcaauccucccacuucagccucccaaagugcugggauuacaggcauuagccaucacaccuggcuaauagcccuuuucuaacuaguucuguuguauaacacuuuuuaaaaagacaaacagaaguagcaaggaaagauaaacauuaccacucagugaguacuccaaggauucuaagacccuuucagggaguccaugagaucaaaauaguugucauuauaacacuaagacauuauuugccucucucauaaaauacaggaguuuuacagaggcuacgugacauuuaguauuauaacacacuaaauggaagcagauaugaaaauccagcuguuuucuauuacacuagauaugaaagagauuugugaaaauauaaaacaaugccacucuucucacuacacacuacauuuuuuguuuuggaaaauacaguuuuuggccaggcaugguggcucgugccuguaaucccaacauuuugggaggccgaggcgggcuaauugcuugagcucaggaguucaaggccagccugagcaacauggagaaaccccaucucuacaaaaaauuagcuugagagugguggggcaugccuguagucuuagcuaccugggaggcugaggugggagaaucaccugagcccaggaaguugagacugcaaugagcugugauugugccacugcauuccagccucggugacagaguaagacccugucucaaaaaaauaaaaacaaaaaauucuuugugaucuucaauaacuguuaaaauccaaaaaccauaaaguuugaaaaccacagcugaugccugugagggaacaauuucacuacccuauauaguucuuccaaaucacaauauacauacgaaaaacuuucuuuuuuucucuuuagagacgggcucucaccaucuugcccaggcuggucucaaacuacugggcucaggcaauccuuccaucucggccucccaaagugcugggauuacaaguguaagccaccaugcccagccaaggaacuuccuuuuaaugcuagagcuuauuuggcauguguauuuauguauucagauugauuagcucaguuauuaaaaguagauaccaauaacacaaagaucuuggauuguagccacacacuucacaaauucaaaccaaucaucacaucacuguaaucaggugaaaaaggugcacagcaaccaaaaaauaauucccaaaagguacuauuggaaacauaauucccaaaagguacuguuuuauaggucaaugacaauguguauguguguguaugaauguguggauauggcuuagcaaagaauaaaaauaguuuuauaagaacuauuguucuucagaguauccucuaaaaaauaacacuauauggagacucucaaaccuugcaaaaacauuauagugcuuucauuacaaucaauaaaaaaaguguaacacugauacagaaaggcuauaaucuacaaauccacaaugcauagaaauuaaaauggcuugguuuauaauaaacaacuacucugaccuaauuuaccucuucauacuuguuauagucucuccagagcuguucaauguugaucaucggauuaacacaaccucguugauaaacucuucggacagcuguuauucuuugauuuucugcauaagauccuacagcuucccugagauuggauaagaaaugccaucaauuauauuauaaccaaaucucauucaacccagcaaucucacuacuggauaucuacccaaagaacaacucuauggaaaauaguauggagauuucucaaagaacuaaaaauuauauuuuagcuaaaucaacuguagauguaaaaaaaaacuauacaaauacuuacacgccuuuuaggaaauugauguaauccacccaaaucuaagaaauaaaaugaaauguuaauaucuuucuugguauucuuacauuuaagugcauacauuaaaaaguuuuaacucuaccugauaggacauaauuuccauuccaauuuuauccagugcaaagucauaugcuugagccauuuuuucucugaaaugaacaugaaagacgugguuuuuaaauuuuuuuguuauuaaaauuuaucuacaauuaggccagacaugguggcucaugccuguaaucccacugcuuugggaggccgaggcagaaggaucacuugagaccaggaauucaagaccugccugugcaacauagcaaaacccagucucuaaaaaaauaaaaauuaaaaaaauuagcugggcaugguggcgugcaccuguaauccuagcuacucggaaggcugaggugggaggagugcuuaagcccaggauuucaagguuacagugaguuaugaaugcaccauuacacuucagccugggugacagagcaagacccugucucuaaaaaaaauuaaaaauaaauuauuauuugaagauagacguggugguucauuccuggaaucccaaugcuuugggaggcugaggcaggaggaucaucugaggccaggagucggagacaagccugggcagcacagugagaccucgucucuauaaauaaauaaauaauaaauguauauauaacuaaaauguagcuucugaucacaggaucagaacaacacuugaacauucucuauaaacauaaauuaaagacaucuuuuaaguauauaaagucguucuuugauguuaagcuugucaagaucauaaauuguuuccuuuaucuacugcuugugagcuuaucaaaaauaaggcucaugucuuacuuaucuuuauaucauuuaaguugcauaauucuauacauagcagauucaaauguggaaauuugugguucucucauuaaugagacauuaagaucuuuagcucuaaaguaaaauguagaaaucuggaaaguauaguuuuauuaaaaugcaacuuauguuaaaauguaaaggguacauuagggaaaaagaacuuccacuucaauauaagacaauaaacagaccagguguggugguuuaugccuguaauuccagcauuuugggaggcugaggcaggagaauugcuugagcucaguaguuugagaccagccuagggacauuaacuuaugcuugagacccugcuacguuuggagucucaaacauaaggagaccccaucucuacaaaaaaauagaaaaaaaaucagccaggugugguggcucuugccuguagucccaucuacuuggaaggcugaggugggaggaucacuugagcccaagagguugaggcuacagugaacccgugauugugccacugcacuccagccuguacgacagagcugaaacucugucucaaaacacaaaaaucauaacaaaaaguauaaucaggaaaagacaauaaagacagaauuuuaguaacagacauaacuugccuguuaguuacauagaaaaauggcaccucagaagaagguccauuauuuagauuuggcaaagauggggagguggguauaauucggaguggggauggcaacuucacaauacaauugucagagaucccuuauaucacuacaaaugucagagaccccuuagaucacuuaaguagcacauugcauugugaccucacaaaagugguacuagcacaaguaugaagaugguuuuugaaaaaauuugacaagucugucaacaaagugguuugguguugcaauuauacaguguuucaguauagaaagggcuugggcgauucaauucuccagaguaagacucaugccagugacuuucucugaagcacuuuuuucaagguuacuaauucuuaggaaauccugacuuuucaaauccugauaauucuucccacuuggggcuaacagaaggugugaguuuaugugggauuaacugugugccuggagaugacuugcauucuuaagauccugguuucacuuacuuguaacuugguaguuuacccuugguuucucggacauaugaaagauaacacuuccauaaaucaaugugcaaaaccuucauaaggcaucucugaaauagcuuuaaauacaagaauauauuaucagaauccaguuaaauaaauuucacauggacauagaugaaauggaacauuaaaaacacaaauucagcucccuuuaugaauuuaucucuuauaaauaaaaagcaaauaauuuccccauuuucaguuuagauaauuaaaaugcuucucaugauuugucaggggaguauaauuauuuucuuuuccuuuuccaaaacuuuuaugaugaacauuuucaagcauauaaaaaagcugaauaaguacaauuaacuuguaaaaaaucacuaucuagauucaauuauuauuaacauuuuacuacaucugucuuauacauacuagguuuuaaguuaaacuucaauauaaaauucaaaguauuugaggacucaccuuuucaaccuugucauaauuuuuagcuuuaaucugaagagaaacagaaaaauauagaauuaauacuauuuuuuuagagcaucagucugaauuuuugaccaauuuuuaaccaacuuugcaaauucaucccuauaguuucuuauuaauuuuucuguuacuuucaaaaauaacagaagugugaagcaaacauggauaaaaugcauuguaaauauaccuguguaaauugaaucuauauggauuuucauacauuuacauauaaauuuugugaauuuaauaaaauucuguaaaagucaugagaugaauacagaaauauacacauacccgauaggucuaccugaauaggauguauccacugaagaaaaacuuaaggcuuuccuuucccuguauagcuaccagaacaaucugagcggcaaaaaagauaugcaaauuuggacuacauauaaacauucagucacaccaucaaccuaauauauugcagauauugugcuaggcgugggggcuaccacugugacaagacaggucugccccugcccucauagagcuuacaaucuuauggggaaaauaagacaacgaaguggaaggucauuguaagauauuaugguuaagugcuaaaaugaagaaaguacugggugcuacagcauuuuggaagagcaaaagacuuagacuuggggaauugcaaaagauuuccgggaaaaagauaacuuuuucuaggagaaucugagcuauuugcugaagaaagggaagaguuauuccaggcaggagaaauagcaugugcaaagaccaagauuaaauacuauuagauuucucuuuucuuugaguauuuucaucacagagugggugggguuaggugcucaacuguguuaaucagcaaaucuguuucacccagauagguaaauaaauauuuuggcugauuagagaaguuuugguccuuuuaucucaaguaguacaguaauagaguaguauucccaguuuuauggcuuaaacuacugcaggugagaaugcugaugacagucuuuuuugcuuuugcugauaacuuguucucuucuggacuuuuuuaucuugaucuuuagaguucauaaauuuuagcacacacuuaaacacagcucuuuguacuuugaagcaguucaaucaaggcucuggagucagaccucuuagguucacaaucuggcuaucuacuuaaccucuuuuucccucagcugauuaagggggauaauaauaccuacuuugucagggcuauucugaggacucaaugaguuaauaaaugugaagccuuuagaauauugccuagcagguugagcacugaguaauuaucauuuacuuuuauuaccacaaaaucugcuuggaacucagcaugcccuuugaacccauauacucagggcuuuuuuuaggucaagaauaagugucucucuucuauuuguuccuuuuuucuccuucuagaacuauauaaguuagaucuccugguucuguccuugaaaucuguuaucuuuacccuuccuuugaauuuuugcucaagguguuaaaauaguuuguccaguagauuccccaggcaauucauuuagggcuccaugugaauauucucuuccacuuagccuauuacuguauuugguucauacauaacgguuuuagacuccagaguuuuuaauacagcacuuugaauccuguguucauauuacuuuguuccaguuguauuucuccucuagcagcucuauuuuguuaaggaccugauaguuuuaguuuauauuccuuucugguugguggauccuucagaugugcuauuauuuuuuccugccuauucacugaagcuguguuggcaguccuaaaguaguagaaauugacccuucucuaccaugacagcuguguagcagguguaggcagcaaacaagcugcugcuagcccucugccaagaaaccagaaagaaaucucuacucaagaguagggaggacucagccaagaggccaggcugaugucaacauucgucugggguaaagacauuugagggguuccaaauuuucuaugggucagcuucuuaguccuuucccuaggcccucuacugggccucuucuuugagauucccauagaaccugaagcuuccuugcauucggcugcuuggcuuaguagagguaaacagagugggaauaaaguaggaugaauuuaaaucaccagcuuccuaggugcaguugagauuauauacaguucacacaacuggucaggaaaaccaaagcuacccauugagaaaauaggcauagaauauuaauaguuaauucccagaaaagaaaauuuaaaugguuaaaagcuauaugacaauguguaaacuuccaaugugggaaagacaaauuaaaauaauagauauuacuuaaaaaccauuagaauggcaaaaacuuacaaagguauuaacacuacugaagccauguaaugaaaaggcacuucauacacagcuggaggaaauaugaauuguuacagcauuuuugaaaagccauuaguaacagcuauucuaauaaaaaaaaaauguaucuuuugacgcaggaauuccacuccuaggaucuauccuauaaaaauaaaagcaggccgggcaugguggcucacgccuguaaucccagcacuuugggaggccaaggugggcaagucacaaggucaggaguucgagaccagccuggccaacagagugaaaccccgugucuacuaaaaauacaaaaaauuagcuggacauaguggccggcgccuguaaucccagcuacucgggaggcugaggcaggagaaucacuugaacccgggaggcagagguugcagugagcugauaucacaccacugcacuccagcccaggcaagagacuccaucuaaaaaaauaaaauaaaaauaaaagcaacagaauagagagguaauuguacaagauuacuuacuguaaacuuuguaguagcaaaaacaguuuaaaaaucaaauguccaccaguggggaaauaguuuaauaaauuaugaugcauucgcaucauggaauauuauguauucagcuuuaacagguaauugggaggaauugccacaagaucuuauugaaugaaaagauaguaaaauuuauauaaucuaucuuuauaaaauaaauaaaaauaaauccuauauauguuuauguauuauuagcauagagaaaaauaaggaauacccacaagguuguuaaacauaauuaugguuggcagggugauacggguggaugcaaaaauagagacaagaaaaaagacuuuacuaucaucuaugcauuucaguaaaaauuaugucuauuauguauaucuacgaaauaaccaaauuuugcauacccguccccaacaaaguggucccauaucuuggauucaucaauuauuucuuuaauugguaaauugguauuagcccaauaaauguauguagaaagacacuuuugacuaauacagaaaaauucucugaucucuaguacguggccacugauugucauucauuaaugcaaccaguaaauauuauuugagagaccuucuacagagcugguacugguggccuuaccacaauagcuauaaucucauuauuuuuuaaaacaucauucauuaaaaaaauacuuuuaaaaaucauuggccaggcacaguggcucaugccuguaaucccagcacuuugggaggccaaggcgggcagaucaccugaagucaggaauucgagaccagccuggccaacgugaugaaaccccgucucuacuaaaaauacaaaaauuagcugggcaugguggcgcacacuuguaauuccagcuacucaggaggcugaggcaggagaaucacuugaacccaggaaguggauguugcagugagcugagauugugccauuucacugcagccugggugacaagagcgaaacucuguguggaaaaaaaaaaaaaaucaucaaugugcuuuggagauuaaaucugcagugugacaaaaugaaaagaauuugaucacauugcauuaauuacuuccucucuuacaguaucagcuuuuccaccuauaaaaugggaaugauaauaacauccauuucaaaggguuaucaagaauuaaaaagaauauaaagcaucuagauguuccaggugcccauaaaucauacuagucaacaaagcuauaaacuaaaggaguauaacuuuucauuauaucuucucuaaacagaacuauguaaaccaaguagccagaaagagcaaugguguuacuauaauuggcccauuugaugcagaggaaaaaugcaggccauauucaaauggcauuauuggugagacuagcacaccaauacccugucuuuagccaucccaccauuuuccuucuuuaaaagauuauuauccuauguauuacuuacuaauauuuacaugaaaacaucuuagcuauaaguauuccauucuaccugauaaucaaagccugguuuaaauucuaaaaauaaaaaaaaauucuugauaccuaagauuacuuuguuuugacauuugggauucucagaacuuccugccauuaaucaauagaaaaugucuccauuuaaagaccauuauaggucuccauuuaaagaccauuauaaaccacauuacauguggcucacaccuguaaucccagugcuuugggaggccucgguggguggauugcuugaggccacgaauucaagaccagccuggccaacauagugaaaccccgucucuacuaaaaauauaaaauuagcugggcaugguggcgcaugccuguagucccagcuacucgggaggcugaggcaggagaaucauuugaacccaggagguggagguggcagugagcagaaaucgcaccacacacuccagcuugggcagcagagugagacuuugucucaaaauaaauaaauaaauaaauaaauaaauaaauaaauaaaugaauaagaccauuauaugcauacaaauaauuuugcaaaacuuacuaagacuugcuuauauuuaaucuauuaaaaguagugcaucauuuucaaugacagaggcucuuaauagaauuaacuuuaagccaggugugguggcauaugccuguaaucccggcugcuugggaggcugaggugggaggauugcuugagcccagaaguuuaaggcugcagugugcuaugaucacaccauuacauuuucagccugggugacacagcaagacccugucuaaacaaacaaacaaacaaaaaacaaauaaauacuuaucugguacacauacuaucauaaaaauuugucauacaauuacauuaccuuuuuaaugaauuauccaaauuuuacaaagauaugaaaagugucuauugagaaaaaauaauaaauuuuuuaaaucuucaacuuccuuuuuuuuaauagaagaguaugauaauuagaauagcaauaucaagaucaauuaaccuuuaaguuuaauuacauucaaaucagugguuaacggccaggugcaguggcucaugccuauaaucccagcacuuuggaaggcugaggugaauggaucucuugagcccaggaguuugagaccagccugggcaacauagcaaggccccaucucuguuuaaaaaaaaaaaucagugguuaucuuagggagaguaaaacaaguauaacaugaugaggaaacacagaucuuuucccaauacuuuugaauacuucauauuuccaggccuuuguuaacuuccacaauuauuucccaagcauuaauuggucaucacguaucuuuuggaacuaaaacuauccucagauaaauuauuggaacuaaugaucaccuauuacuuaauagguuaaaacaaaauuaauuacuuaauuuuuaaaguguuaacuuugccagaaaaggucuaaugacccuuugacuaacaucuauuuuuaacaguuuagacuagccauguccuuucccuggaauauauuuauauugagaucuaaagaaagcaugauauucacuuguucaaaaauaaaugaguuuuuccuaauguuaggaacauauuucaugcuucauuggauguuuuaggaaaugcugauguaagugccgacaaaauucacauuuuucugaccagagaaauaaaacucuaugucaacagcauuuugacagguuuccucaaauucaauuuuuucccuuaucccuuggggaaaaaaaaaucccauaaagucaaaaguuuuaaaaaguacgcuguuuuuaaaaucaccaguuauaagaaucauuauacaauuaacuugaaaugguuuaaaaacauauuugaggcugggugcaguggcuuacaccuguaaucccagcacuuugggaggccgaggcggguggaucaccugagguccggaguucgagaccagccuggacaacauggugaaaccccauuucuacuaaaaauacaaaaauuagcugggcaugguggcaagcgcccguaaucccagcuacuugggaggcugaggcaggagaacugcuugaacccgggagguggaggaugcagugaaucgagacugcaccauugcacuccagccuggacaagagcgaaacucugucucaaaaaaaaaaauugauaaauaaauuaaccugacauaacucuauagaggaacaccaagaagcuuuauaaucuaaaggaaaaaguaagucucuauauacuuuguguagguuuucacacaauaaccauuugggacaagucaacacuuagguuuucagacaguacugggcacauagcagaggcagggcuaggauccaucuaaagugaguucuuaugguaguuguucacaaugugaacaaacgaauaaaugaauugcagucgcauuccuaacuuguucccugcaucuuuucuacucuaaaguauagcacauagacuuuccuaggacuuaagacaaucaucuuaaacugaauuugagaugcagagaagcugucugauucuacuuguauuaauuauccaaaaagcuuagccaaauccugaaaucugaaagcaaauggaauccuaaauauaaauucaucuccuguucauuuacuuuuucacuacucuuuucagcuauucucuaauccucugcaaccugaaaaauaucuuggaagauuacagaauacaagucguuuuaaggaauuuggaaauauugaagaaugacauuuuaagaucuacaaacaggcuuuuaaguuagcugcuggagugguugcagaauauucuucuuuccaccacccacucccaauuuuaagguaaagaaaucaggaaaguagugucugcaaauaaauucauuuuuauuugacaaauaauuaagugccuacuaugugugacaaauaauuaaggcccuuuucuagcacuggagauaaagugguggauuaaacuaagucauaacucauggaauuauauuuugguuauauuuugggaggcagccacuaccuaaagaauaguuuucuuuaucuguacuuccuaauuuuccuaugauaaauuguauuguuucugcaauuuguauuuucauauuaaauauagauauaaaugccagguguaguaguucaugccuauaucucagcauuuugggaggccgaagggagagggucacucacuugaggccaggaauuugagaccagucugggcaacauggugagauucugucuauaaaauuaaaaauauaaauauguacauacaaauguauaccuauaauauauacugauuuagauauaacagguuggccacaaccucuacauguccuauaaacuuucaauuauccaggcccuuaaauauaucacagaacuacuugucaaaaaugaguguaaauuauagaccacugugaaguauaguuuaauuaugauuaaaauugaaaugugcuaaacaaaacuaugauuaucuuugggucuagauuaaauuuaguuucauuuuaauuccuuguacuaaccauuagguauuaauuagucuuccacuuucccaagccaacuaaaaaguauuugucauguguccuuaggauuuaccaaguggaaguggggauguggaccugaacuauuaaagaguuuaugacccaguugaaaacauaaaacuaaugauggaaacaauaaaggacuaaauuuaaguuuaaauuauuuuguguaugcucuauguccuauaagauucagaggaaaagguguuccaugcaaacuagaguuaacaaggaaagcuucacugagcagaugguauccaggccauuaaugaaaaaaaggagucuguacaagucaaugaaacaacaugaguuucuuuaguuuuugguggaauaaugaggacauccaagcaagaaaaaaagaauaugcauaggaaaaauaaguuggcugauuauggugaagguccauuacagagggcauaaaaaggcagaguuaaaucugacacacagaaaaccuuacugaaugccacugagguuuuccuggcagguaaacaaugaggaaaguugaaaaaagaugacucauaaguagguuagggaauacaggcuggggagaauacagagguggcuuuuagugcuaugggaugagacaagcagguacuagcuacaauaggaaagaugcuauugcugucauccuuaagugggguaauacuggcuuuggcucagagaagguagaacaaggagagaaaaccaguaauguagagggaagaacaacagacuuuuuuuuuuuuaaugggaacaagaaugaaaaguguuaugagaguugcuguaaaguuuacuuuuuauuagguuuauuaugaggugacacaacucagguauaaauugucugauuaaaguuagcagauggggguugguuucaucaauaagacaguggaauuaaagaugcauauuugucauuuguaaaaaaaacuuuucuuauaaauauguaggguauacaauaccuaaggcauuaaguauauucucugaaguagagaauauucagacaagcaaagacucauuucuccaaacuauccauucccaggcaacaaaaaggaagagaaccccagaguacuugacauaagaaaaacaggauauaauaauauguaugaagucaaagaugaacauuauaagaaaaagggaucugguggaauaugccacaggucaaaaauaaggguauacgaaggaucuggcaauaagaaacucauugcuuauuacacacuuaaaaguugaagcaauucagcuucuuauaauuuaaaaugacuaaauacugcuaauacuagcagcauuuauuaaauauuuaauguuuguaagcacuacuccaagauuuuauauguauuaacucauuuaauccauaaacagcacucagguaaaguacuauucccuacuuaaagaugagaaaacugaggcacaaggagauuuaauaacuucccccagaucacacaacugagcucuuaaccacuauacuauacugcucucagcacaauauauauauauaugaggauguucauugaaagaguacacagaaaauuugagaaccuauauuaccaaaagguagaaugauuaaacugugcuuugucuaaguaauuguuuugucuaaacaaugggaugagauauagauauauacacacccacaggaacuuuaaaagcaaugauguauaauacugaauggaaauauauccauaguacauuuaagaagugaaauccaaaaaauauauacugaguaggaagaaaugcacacaauaacuguugaccaaaacuauuuucacuggaaggauugagacaauuuuucugucucaguuacauuuuauuuucauaucaauuucacaaaggagagaguugggauuuuuaaaaaauaacucaacauuuucuuuuuuaucucuaaucucaugacagauuagggauuuuuuuuuuuuuuuaauaagagaaagaaaauuacagcugauuuugaacgguaaguuucucuucggaguaauucauugguauuuuucucugaacauaaacauccccacuuuaaaaucuacuuuuaaauccucucaaauucuuagccaggccuaugaggauuuaaaaaguuaaauaaaugcuagauaaauuagacaauacuaauuucagucaagaaucucaaagguaaaaccuuggcucagauuugauuuugucccaauauauagggcaucuaucaacaaccaucacuuaacauuuauagacucagccuacuuuacuuaauaaacaucuaaacucuguaaauaacuugucaacagcaugccaaacauuaccuuucaaagaauaaucuguaauuuugggguaagaaaaauacagcaggguauuugcuuuuugagaaaagugaguaauuuagccagaaguaucaaaaucacuaguuaacauucauggcucaauugguuuugcuacucuaccucccauuaggucaucuccccugucucuccucaaaauugcugaguggcauagaucuuucuaaagguuaauuaaaauugagacuaagaaauguguacaaucauuugagacgcuccagcuaucaggaaagucaagaaaucaaguucauaaaccucugaucuaaaaaaaaaaaacaaaaaaugacauuaauuccauacugcacagccagaaugguaaucaaguagauugcugauuugcuucccucaaacgucuaauauuaguuuauugcacaucaacuuauagucuuuucuaccuuaauuugcagcuuuuaugaacuaucaucuuaauaaaaguccuuccaggcaaacuuaaaauauuaaacaauauaacuucucuaguauuacuacaggaacuuuauauauugcuuuauaaaauauuauaauaucuaaucucacuuuuguuugcugaguuaaucuuccauuagucacaugacuuuuuuuuaaugugcagaggggaaguuguucagaaaaccauuuacuuaaaacuguuuauaauucauucaucucuuacuguacuucucacuacauacaaauugaaaacugcuguuuaaaaauauuagcaauuguauuaucacuggacaaaagccuuuagucauuuccucuacuugagauauucuaguucacuaaucaagacaaucuuucccauuuugauagagauuccuaucagaauacuauuucucuuacuuaauuuucagugucauccaaugaauucacauuuuuuuccauguaacuuucuuguuggcaauuuaauucuaaguacacauuuauuuauucuaugaaaucaaguauaacauuuauaguagauacccaguaucaugaguaaugcuucauuuaaccuuucuuaaaaaucacuuuccaaaaacaggauuaaacuuccacaaugaaguagauacaaauucaauggauugcuuuucuguauuuuuuaagcaacuugcccacuccucuaguuuuuaccuauuaguagagaagcauaauuuuagaaauagcccauuuccucauucuauaaaacucacaguauauuccucagacuacuuuaguuuuuaucaauacugcuacuccaauacuuuuaacuuuacaucagaaauuauauucuaauucuauucugcaacuguuuuugauacccuaucacuuuuuccaagaacauacaaucaacauuuguauuaugacccaauucuagccuucucaauccuauauggauaguuuauuucuauuuuguuguugaagugaccuaauuccaaguuccuuuuuagaaaaugcuuaucaaauaaucaucguuuuccccaaaauuguauauuuauucaacccuguuucucuauucuugaacaaaguacacauuggucauauuuacuuaaauucugaaagauuaaaaaaucauuacccagcucaauucaaaagaucacaccagcaacagcaaccuuugauaguaaaauaugaauucuaaaaggucaaucuaaagaaacaauuaugacuauguaaaaauauugaaauaaaauuguauucaugcaagagauucuuauaaaacaaaaacuggaaacacuguaaaugauaauuaggacuggcuaaacagcauguaucuaggauguacuacugugccaccauuaaaagcgauuuuauagacuaaauaacacaaaaauaugcuaccauguggaaaaaacaagcuacaaaaaguuaagguuuuauagacagaucuggaaaaguuaacugugauuaaguuauaguucaaagguagugggaauaugguuuuuuucuccauuagaguuuuuuucuuauaauaaacacauauauuacccuuuuaaauaagaaaaauguuuuccuuuuuguaacaaucuugacaaacuccacuuucccucccaucucucagguuucaaucacuugauauuacuucauuaugcuugccuuuuaaaauucaaccacuuaauuccaaaaauauuauuugugcauguauuuagguuaaguguauuuucucaguaguccaucuagguauuauucugcuuacucagaaaacaagcgagucaacauaauuuaaaaaauuccacaaaggcauaacguuuuuuauuucacagcaccuagaacaaagccuaacauauagcagacauucaauaauaauugcuaaauaaauguggauaaaacuaccaguuacuauucacauauucauucaaaaauagguuuuagauuauacugucuuaaauaucaagggaaaugaaaaauguaaauguauaacuuuuacagaaaggucuuuaugaguccuauaauccuuguuaaaauauuaauuuaaaaccucacuucaauaaaaagguuuagaaagggugcuaaguauaauacuaucaguaaauucagacuaaaauggaggaauaauugaagcucuaauauggauuuugaaaguuagauuuuucacaggauuucgaucuuuccgugagcacacccaaaucaauuccauuuuccauuacuuuucuugaaugaaaacaugauuucuauuugaagcaaaaaugcuguuucaaauagccauguaaaagaugggaaauuaggaacuuuggagguuugaaaaguagacauagcuaaccaauuaagaaaaacaaagaaaaaauucagguaaauauuaaguuccaggagaaucaagaagauuuagacgugaauuucuuuuuucuaaugggcauguuccaaaauugaaauuuuggcucuauuuuaauggcuucagucuacguacuuaucuccagaauauuuauaaaauuauuucauaaaaucuacuagauuuuaaaacuuuuuccuaacuuuaugaauuccugagugcauuucuccaaacacggccacauuuaaaggcuuaacgaaaacauauccuauuuucucuggaaucuuauuuuauaguuugaaauguuuguauuucauuuuaccuccucuaauuauauuugugauauuuuccaaagugaugccaccaaagguaaagaauuaaguucaaaugcuauauggaaagcugccaugaaggcuuuaguaggcaagaaugaaaugaagauuauauugauauuccugcucuaagaacagacccuuauggugcugucauuaaaauguaaagacaguugaagggaaaaaaaccugaauggcaagcucuggguuaagguggugauacuuucaccagcaaaugaagucugcaguggaaggcuccccaaaucuaauaaacacauauggccauucuuccuaguugauucuacuauacaggucuaauuuuguccaugacuacuauaacaggucaguagagauaucagauuaucaaaagcugugacauguaagaaauaaaaaaauuaaauuaacaacaacaacaaguuuccuaaugcuguuucucaaagaaacugagcuccuggcagcccuuucccaaucaauaccuaaaccugaggaaggaaaggagagcaggcauaaaaccacuuucuguucuccccauaucccaucauccuacugcaaaaugcacagaaacaagauauaaaauaaucuauggauuagcuuucaaauuacuacaauugagauacauuguuggauagcaaagugugcauguugaaaaccaaauucuauaaaguauuuaauuagcucaccaaugggaaagaaaacugguuuugaaauguuuacuguuaauagaauauaauccuuauauauaaacucacuucaaaaggaucugauuguugaaagaugccuucaugauuuugauaucucuauauacaugaccuuauuauucucuauauacaugaccuuauugaaaaucuguaaugugaaucaagauuuuucuucauaacuauuucauaagcaaaucaguuuucaggaaaaaaauauauauguacaaaacuauuuucauuauauaacaguaugugagucuccucaugucuaauguugagaugcaacauaaaaagcuuaaaaagaugaaaaaaauaauuugcaaacauuaagacuuaauuaaaaugggaaaucagagauuuggccaacagaagaaauacuuaagcacaaaacacacauuugaaagaaaauauaggccgagcaugguggcucaagccuguaauccuagcacuuugagaggccaaggcuggugguuagacugaguccuggaguucaagaccagccugagcaacagagcaagacccugucucuacaaaaaaauacaaaaauuagcugggcaugguggcaugcaccuguagucccagcuacuugaggggcugaaguggggggauugcuggagccuaggagguggaggcugcacuaagccgugaucacacacugcacuccagccuuggcaacacagugauauccugucucaaaaaaaaaaaaaaaaaaaagaaaagaaaaaagaaaagaaaaguauguaaaacaggucaguaagaacaucaaaauaacaaaggaaaguauguucuuuuaucucagaacauauuuaucauuccuuccauuucugacaaugagaaaaacagguaaagcaauaaauguaacacauuauuuaaauguuuuaucaaaauuauuucaacuucuaaaugggaaauugugcuaacauuaaaaguuucccuuaacuucccuaaugugcucuuguaaagaugaaaaaaaaaaacaaaaaaauggacuagagagauuaguucucagaaaaagaaauccaaagggcucuuaaaaaugaaaauaugcucaaucucauucauaagggaaaugcaaaugaaaaccacacugagaggaccauuuuuuacuuauaaguacuggcaaaaauuaagauuauaaaacauuguguaaagaggauuuggaaaaaugggcccuuuacaggauuaucaaugggauuuaaaacuaugacaaccucuguggaagaacauuaggaaauagaaaauucaaauaaaccccauauacucuuugauccagcaauuccauuucuaggaauuuaaucuacaagaauauuuacacaaauggaaaugauauguacacaauuacugcaguaccgucuguaauaauauauaagacagggaaaaaacuuacauguccuucaguaggagacaaguuaaaagaaacauagaauauuauguacuuguagaaaaagauuuccaaaaguuacuuucuuaauaaaaaaaaggugcaaaacaaaauguaauagauauuuauuaauguaaaggacagaacacaugaauguaugugcauuaaacaucucuagauucugaacauugucucugaggggaacuggugccucaagaacagggguaggugacuuuucacuguagguuucuuuuguuaucuucugauuuuugaaccuuauuuuaauauauacacauauacauauguguauacauauaugaauauaaauacacauauauauggaaugucuaggugacauauaacuuuugaguuuuuacauuuaaacacauaucuauauuuucaucaauucucaaaaccguauuccaaaaacccccaaaauguuaaaauuugcaaaaaauguacaaauaaaacacaauaugcauuaugcauacagaaauuagauguauaauauugucaaaacuauuuaacauuuuuuaauguaaaggauuaccuuugcagccucuaaacauaguauaauuuaagcauuuaaaaaagaaaacuaucaaccuuaacacaaacugguaaaguccagaggcacuaccauaaaaauuuaguucauuuaguuaauuuccaaaccuaaaaaaugaauacuaaugaauggaauuugacacuggcguaacucaagauuauuaaaaauacuaauuuccaaccaagucaaaggguuauuauaaacauuuaacaauaaaauugaagugauauacuuggguaaaaauuuaacugaaauucagcauuuaagaaacuacuuguuuaaugcccaaacuguaaacuuguggcacuaaaccaaucaagugagauuuauaauucuacuuauaauaaacauaaaaauaaaacucauaaucauuuuugcccugaaaaaagugaagcuaaaaacagaccaccaauucaaauuccaguaagaguccuuucacuuaugaaaacuuucauuggaacagagugacuuuaggcuaggaagcaaauaugaagagaaaccuggauacuuaauaaaugagcuuguaauuuaauauauguauuuaaguuauaccuacaauuggacauguucaaaaaugcaugcguaacuuccacaaugguauuuuauuaacaugacucuggguacagaacuuucaaguugacagcuauuuucuuucagcaaacugaagagucaauuccacugucuucuagcuucccuugcugcugugaaguuaccaaccuuacugccauuccuuugaaggucauuuaucuuuuuguuuccaaccauuuaugugauuuaagaaaaaaaacuuuaguuuucuauaguuucauccucauguguccaguugugaauuuuuaaaauuacugcuugggauucaaugagcaucuugaaucuguugaagccuucaaucauucuggaaauuucaguauuucucucuucaaauugugcuuccgccccauguaguuccucuacuucuagaacuucaaguagacacauuuucacacuaucaauuugugucucagauaucccuuucauauuuuccaucuaauuggcucuuuaagcuccauucuggaugccuucaguucuccaauucucucuucaccuguguuauuaagcuaaucuuaucuaaauucuaguuucugaagucuuuggaggucuguuucugauguaugugguuuccuuauaugcuuauuuuuaacaacugaucuguuccuuucccuucaaagauuauuguggaaacucucugaggcguaggaagaaggugcauuccuccagaaaggguaugaauaagcuauuaccaccuauuagggguauaauucaggcugagucuacuuuacauacauggcuucaguuuuucugaaucauucucaggugauguuuauucacacaaauccacauaaagaacaucucaggauucccccauucugcucuacucagacggacgcaacuuuucucagucccuuacagguaggaagguggcauggauuuacuucuagaucacugucauccugaguguagcuuuuggagcacauaguuuaaggggaaaggauaucccauuggacacuguaccuugggcaggccuuggguuuugacuuuugcugccugagguccugaagcguuuaaaauugaagcucaagucuucccaguuuggcaguugcuuucagggccaaaacaguuuaggcauucugcuuaucuccucgcguuccuuuuuucucccuccccaguccauuaggcuuugaccugguaauuccuuagugcuguaaguucaauguuaauaagacauucuuaaaauucuaccuagcagccuuagcuguuuucagugagagagcuaaucugaguaaccuaacucaccauauuaccugcuagucuccuucauaguauuuuauuaauaucaagcuuucaaaaagauuagaaaaaaaaugugugcaaacuaccuugaaaaguaacuaaaaacucuaaaauccaauguucacugaggcacuaaauuccaaaaguaaucuauuaaagaagccagaucugguaaaaaucuggucaggcacaguggcucaugccuguaaucccaacacuuugggaggcugaggcgggaggauugcuugagcccgaguucaagacuaggcugggcaacuuaagaccuugucucuacaauuaaucaggcgugguggccugcaacuguggucuuggcuacucaggaggcugaagugggaggaacacuucagcccacacgguggagguuacagguuacagugagcggaguucaagcgaccgcacuccagccugggugacagaguaagaaccugacuccaaaaaaaaaaaguauaaaucuuucucuuauguuauacaucaacauaauucuaaauaaugugaaagcagcuuacucugaaauacuuaaauauuuagggguauuagacaauucaaaagaacaguuucuuuuuaguguucuaaaaauaaagacauuuuuuuaaccugucacaguaaagguaucagccaaucacaauuuuauauucaugaaaauacaucuuguuauaaacugaaauaacucauuuuacuuuuuuugagaccuuugaauuuuuagaaauucaacuuguaaaauacaauuauuucccacuguggauuuuuaauucaacaaguauucauagugccauuauaugccaagcauuauuguagcuuccuggaauauagcaacauacaaaagagacaaacuauaaguaaauuauucaguacauuaggugaugaguauuauaggggaaaaggagaacuugguaaaggauaaggaguucugcaggggauagaaguggcaauuuuaaacagaguggucacaguagaucucaaugagaaguuaacauuuuuguagaucugaagaaaguaaagcagcuagcaaagcagcuaucuggaaaaauaucuuuagaacagauaaaagagcuaauguagacaaaagcccuaagggaggaaugucuggaauaaauuuaaggaacaucaaggaggccagugugacuagagaauagacuuuacuauuaauauguggauuaucuaucaugcagacauuaugcacaaauuuuuauacuuguggguauccuagcauuuaauaauuuucuacuaauuauuaaaucagccuaccugaauguacuaaaaaaaccugauucuuaaacauacaaauguuaggcuuuucacauaauuacuaagaauacagauauaaauucauuuaaaauucaucaauuuaaaaaauuguaucagaacucuaauucagugaucaaaguuccauuauaauccucauuuacucuuaacacccauaaaaacauuuuauuucauguaauaccacugucuuuuaaaaaaugucauuacuauuacaucaacacauucuuauuuauauuucucuccucauaccaccuagguaggcaauucucccuaauuuuuggauauuacaaaucaauaaaauuagaaaagaaaauuuagaaacugacaugaucugccaacguuuuugaguuuuauuuucuuuuucugagacagagucuugcucugucgcccaggcuagagugcaauggcgcgauguuuuuggguuuugagagauguuuggaaacuacuguucuugugcuuucgcuuuucucaauuuuaaccagucuuuggguauuccaaaaguauccagaagacaucaaaacauuuuacaggguucuguuuaaaacuaaguuucagacuuugauacuagaaucaguaaaauaaguaguaucucuuaaucuugguuauuaaauauuugucccuuugguaaaauuaucccuuuuaguaaacacaugcaaauuaacuuaaauauuuauccaaaaggggggaaaacuuuccauuuuuucauuuaaaaaauucauauaaaauaagcaaucuuuuuucuguacaaaauaagucaauuuagaaacuguaugucauuggauaagcuagacgcuggcaaugugguaucuuaggauucccauuuaguaaaaacaaauuuuacucaugguaaaaacauuucuaggaaucaaacucaugcaacuucucagguuuuaccuacuauggaaaauaaccaauuuuuuaucuuaggaaauguuuuucccccucucaaaaagugaaaacucuggccaauuacugucauauuuuccucaaucgcuaugaagacuauuaaagggaaaauuuuauggcuucuuaauuguauuaguuucucaauacucaaauagaaacuaaaaauaaagaaaaagaaaccaaaagagaauuuauaaaucaacauguaauuuuuuuuuuugagaauugaacaggaagcuuccacagucauuuaacuuauaaauuuauguaggcauuugaguaaaauaagggcccagaauuauaaaugauaucucaacuuaagcucuuccuagagcaaaauuacagccaacuuauuaaccuagcaauuauuucagauguucaugcuuauucuccaauuauucucccucacugcuuaguuacaauucuagaugagcuaaugaccauuaagcucauauuucuauaauauuucuauauuauucucauauuucuauaacguucauguaagccacaagucaucugcuuuaauauacugggaaugacuagaagcaaaauucagcuuaaaaauuaaaaaaacacgccauucaucuauuucuaaaauguaaaaaauuauaaaucaucaagcuaaaauuguuucaacucaucaaauaaagcauguuuucucucuuuccuuuaaggccucugcacuggcagucucugccagguauucucugcuuaacucauacauguacuucaaaccucaguucacaaguccuguucuuccagauuuccuugacucaccaucccccaucuucccaugcagugucuggcaugcauuuacacaacagauacuggaaaaguuaauaaauuuuagaagcaauuuaggaagauaauguccucaucuucccugaaaaaauaacguggauggaagaaccugaaaaaagacauuuucaaagucuaacucuguugcccaggcugcagugcaguggcaugaucuuggcucacugcaaccuccgccuccagggcucaaguaauucuccugccucagcuucccaagcaguugggguuacaggugcacaccaccacaccuggcuaauuuuuguauuuuuaguagagacagggugucaccagguugggcaggcuggucuuaaacuccugaccucgagugaucugcccgccucagccucccaaagugcugggauuacaggcaugagccaccaagcccggccuacuuuuuuuuuuuuuuaccuauauccacauaaaaaccuauaaaaauauacagauggugggggggucuacaaaguuacuaccagaugacuuuucuugagaaucucuaaauucaacagccaacuguacuauugaaaaaaagguguuaauacuuuggacaauuuuaugugacuauaauccaggcaaauacgucaguaggcaucaguaaauuucauucuacuaaaaggccacaauuuuugggaacuuuuaaggacuaguccuccacauacaaaauuacuuuccaagguuugcuaacaaugcaauucugcauuuuuaguuugcacagucuccuaaaaaugacaaacugcagcuuguaaacuuuucuucuuacccauaaaaguaucuuacaagcauaacugaauacacuaaaguaaaauuccaaaacacuucaauugugggaugcuuagaauugcaaacuguuuuauagguaaauaauacaaauucugaugcaacaucauagugguuuacuuacaaucaacugaggaauaucagguagcuacaugaagauacuugaguuuucaguggcauagacuggagaugugcucaaaaaguuuaucuugaaucccuaagccugaugcaccacaaauuacaaauaacuggaaauaaagauuuaguuuuaauaaaucagauuuucccauuaacuagaaaagucaagauccuuuuaauauuuuuaaauacagagcuagauauugugccccucuuucauuuuuauuuuucauaaaauuucauaaucucaauuaguaaaaacuuccuuuuagaucaggcugggcaugguggcucaugccuguaaucccagcauuuucggaggccuaggcggguggaucaccagaggucaggaguucgagaccagccuggccaacguggugaaagccugucucuacuaaagauacaaaaauuagccagguguggugaugggcgccuguaaucccagcuacucgggaggcugagccaggagaaucgcuugaaugcaggaggcagaggcuguggugagccaagauugcgccacuacacuccagccugggcaagagugagacucugucucaaaacaaugauaaauaaauaagagaucauagggaaucuaguuuauccuaucagaaaauuuauuuacaaaacuucuacacaccuuugaaaaguaugaaaacaacuguuuaauaagcagguauugaaaggcuaauacacucuaccuaaauccuuaguuuuggccuugauuuaaguaaaugccauuuuaauaacacuccuaauuccuaacccagaaacagauguaaaaauuacugcucucucuauaauguggaauguaaaaaaauauucaaagugguaaagaauauguucuuugauugaguccaggaguucaagaccagccugggcaacauggcaaaacaaaaaaauacaaaauuuuguuauuuuugucucuaccaaaaacaacaaccaaccaacccaaaacaccacaaaaauuagccggguguggugguaugcaccuguauucccagcuacucuggaggcugaggugggaggaucaccugagccugugcaggucaaggcugcaguaggccaugauuacauuacugcauuccagccugggcaacagagugagacccugucucaaaaagguaagaaaauacaugcucuuauaaauuucuuaaaauccaaaauuacaaagauuugccccuuuuguguacagcauuccuuuguacucucugaaauuaaguccaaguaucuacagcuaaaaauuaaaaaacuauggaaguauggagaauagcaacuagaauuuuagagauaagauuuuauacaaaggauaaccuggcuacacagaaguuauuguaccauaaaaucuucuaaaaagguuugcuuaaauucucugaagcaauuuuaugugguugugaguagcuauacauaauccauuuuuucaaaugcccaccaaaauauugauagaccuaauacugagacagcuaaugaagaaugcaaaaaacuccugaucaaagaaagagucaguuauaaaccuacuauauauuaauagcuauuuccacaauuauacuguauuuuagauuucuuaggucaguucguauaauggcuagugacuagaagcccacauggaggaaaaaucuaagcaugaacugaauauuaaauuagauuugaacaggccgggugcgguggcucacgccuguaauccccgcacuuugggaggccgaggcaggcggaucacgaggucaggagaucgagaccauccuggcuaacacagugaaaccccaucucuacuaaaaauacaaaaaaaaaaaauuagccgggagugguggcgggcgccuguagucccagcuacucgggaggcugaggcaggagaauggcgugaacccgggagguggagccugcagugagcagagaucguggcacugcacucuagccugggcuacagagacuccgucucaaaaaaacaaagauuugaacauuauuguuccuuuuaagugugauaaugguauugugguuuuacaggguacuauucuuugugguuuuacaggguacuauucuuuauauaagcagaguaauauaaagcauuuauugagccuauguagaggugcacagguauugacuauauauuauucuuucaaauuuguuugaaaauuuuuauaauaaauaguuggaaagaaaaaacguuacauuguuuggcuaagguccuaguaauaaggaagcugcaagcagaauauccuaggguccccagauuucaaauucuuucauuccuauuucugcauauauccuuuauagaguuaccugcagauuccuugcacugcauuucuuuaaauaaaugaagacauuuuuaaacauaccuuuuccauacuaccaaauaugaucagaccacuguuacaguaacacaguaagaaaaauucugacccugcaguugaggcacaggacagaguaguuccccucccccauaauaaaaaacugaacuugaauaauaauuuucuguugaagaaaaaaaaaaagguauuuuagagauggggugauuacuacauugcccaggcuggucucaaacucguggggcucaggcaaucugcccaccuuggccucccaaaugcuaggacuacaggcaugaacaacugcgcccagccagauaaaacacuuuuuuucaaaguuauuuugacuuggaauaccuguuauuuaaaugcuaaucuccuaacuauucugucaacucaggaaauucaaauuuaaaaaggaaccuuuuuggcaaauauucccauggauaagcaaucugacaucuuuaauugcuaauagaaacuauuuccuuuaaagugcuaagaauuucauuauuuguguugcuaacaacugaaaacuuuuaacgaguuaaauaauguagcauuugcaaaugaucacguauuugucuagaugaucuuuuugacuauuuguuuacaaagcgaaagauggcauuauuuuuaaaauaucuaaauucuuauuuaaaauaauuugccauuuggucaaguaaaucaauauagauauccauuuccuauaucauacaguuuauauauaauauauauguaacauacaauauauauaaccuaaugcuugaaguaacaauuuuuaaguuuucuuccccauaugauuuaugacagaauugacaggcaucauuuacaguaaaugauuuuauauuugacaaaauccugaaaauuaucuuuacuaacuauacucacuaguaagcuucuuaaaugaaaaaaaucaugguagggaggggaaagcuaggacuuuccaauaguuuucaaacacaauaaaguuugagucaugaauagaauaccuguuuccacucaauaaacauauugaaaaacaccagauaauuccauggaaaaauaucacugauucaaccaagaaucaauaggguuuaaauggaguggacaguuguuagaagagaauacaauauuuagucucaaauuaucuccccauuauuuuuucuauuaauuaucaaaggaauaauauuaacuacacaguggacaagcuggucaacaccugaaccacaucaugaaaacugacaucaccaauaugggacaaaugaacauuacuacgccucuggaugaaauacacuaaagacacaugaccauuuugguggcuuuucagcuaaaaccuauaaccuaaaucuaaugaugaagcaucaaacaaauucaaauuaaggccgagggcugggugcaguggcuuacgccuguaauccagcacuuuggaaggcuugaggucaggaauuugagaccagccuggccaaaauggugaaaccccaucucuacuaaaaauacaaauauuaguugggugugguggagcacacuugucccagcuauucaggaggcugagguuguagugagccgagaucacgccacugcacucaagccugggugacagagcaagacucaaaaacaaaacaaauuaaggcugaggggcuguuccacauugaaggagacuaagaggaaugacaauuauauaauggccuuggauuagauaaugaauccgaagaaauuuaagaguauuaccaugacaaaaguauaacauagacugcagauuauucuacuaauguuacauuuccugaauugcaucacucaacuguguguauguauaagaaucuuuguuauuagcaaacacaucaaagcauuaaaguucauaauauauucaaugcaaucuccuauaguucggaaaaaaaagauucaguaaagcacuuaugucaagauguuaaaaagcagugcaaaauauauaugggaguucuuugcauuguucuugcaacuuuuuuguaaguucaaaguaauuucaaaauaaaguuacaaaugcauuacaaaaauugcuuaaauaacugucaguuuguaaacccuaaaagcaaugcucguuauucaaccaauacaaagcagauuaaaccaugugaucugccgugauuggaucuucaacucugauaaccuaaauaaucaaaguuuuaagcauuuuuucaccuaauacccaauaccauaccccaaauacgggaagcacaaaaccuucaaaaauucucuucauacacgauagccaaaaccaaaggaaaugguggaugagggaacuaaaagaaauguacaaacacaggaaacaaaguuauuuugcugacaaucuucccuccaaugacacugcacuucuguaauacuuaguaguguugucauuuuggauauuuaaguuuuauaaaauuuagucuaauguaauucuaaauaucauuaguacuuggauucuuaacuacagcugaaaagaccauucuaaaauuaccacugguggacuuuuuagucaucaaauuugacuuuaaaacugucaaaagccauuaaggaagcauuugaguuuucauuuuuuauaaggauauggguuuaaaaugguugagaaacacuacagaucuuucuagugaaaagcucagaaauggacugaaccugacuauaguaaguuagaaauaacugguuauuugugagaaaacaucccauuccccaccacccagaagaaugagaaguaccagcacaacacucaaguugcacugaaauaaaaggauguuagcuaaauaaaccaaaaauaaauaccaagauguggcacucuuguucaaacucuacacaggguacaaguuagcugcaguuaauucuuuuaagccacauucuucagcuuagaugauucucccguaacacuugaaguguccuuaaagguuaucugauucuuaguuuggcacucaugugacugucuuuuuuaaaaaaguuuaugcaaccagaaaaucaguuuucaaacccaggaauaaauucaguuaguaaaaaaacgguuacaguuaaaacagcguaacccuaacccugacccugacugugaaucuaacaguuacaauauacuaagcacauaguagaugcuucaaagaucacucgauuauauacaaaaagcaagccaggagacuaaucacuuuauuguccaggcaaguauaggaaauauucugcaaacuauaaaauuuacugacagcaguaagauucaauuacugcccugcaaagccucaauucccaaaacuagcugccagaaacacauaccauauguccauccucuagagauugagucagcagugcugguaugcuaacugggaagcuuguaugcuuuaaaagcuuuccaagugauucuaaagcagugaaguuuguaaacuuuggcuccagggauaacaaugucuugauuuaguuuacucacauauaaaaugagggggcuaaacuaauucaucuuccagcucuaaaaauuucugacuuaaaacauuauguccacuucaacuauauguaaaauguacaguagucauagucuggugaaugaaaaaauuuccagggaaaccaucaucacaaaauagccaaccuucuuuuuucuucaaauccaguaugaaaaguugcagaauaugaaucuuaggacaaaggaagacuuaaaacgucaacaguacaugcuagagcugaaauguugcauuuaaauaaaagguuguaacugaacauguucugucacaugaauagaaguauuuagauuucauuucagaaagacuaaaaacagcuuugggaucuuguuaucuuugacccuuacuacggugcaauguacuauuucaaaacuacauuugaauccuaucgcugaugucaauuugucuuuagaacuauugcuuaauuaacacuugcaaauagaaaauuuuucuuuggaggucuagcauacaaaaugguaaaacuuacccacauuaugcuuuccugagucuuagaaaagcagcugaguuucucaagaaguuguauucaaagcaaauauucacaauuuuuuuuucaaacuguuguggauucugguaugugggggaaaaaaaucuagaugcagacuucaaccuauuaugccauuauacaaaccaacuauuuguuuucugcuaccaaguugcuaggagcaaaccgguuuaauaauaaaauuuaaaguuuaaaaauucaguaaaauuaaaguaauaaaauugaaaguaauaaguuacaacuaauaaaugcauuguccacauuuauuuagaggugcaacuuuuuacagaugucacugguaauauuuuagacaucuucauuuccuggaagugccuugaaccagacucauuccaaaggaauagcuguuucaaagcugaugcguuaaagaaaauacaaacaauccauuagaaaauauuuaagcuuuugacuuaaacugguccuuuuguuuuauaaaggaaagucaauugccaccugauuccccugagcucaaguuauaaccaaaaaugcucagcacuguaaaaagucucauguguuagaauuaguuuuauuuccaaauauggagguuucuagcucugugauauuaugaggggcuuacauguuuguguugauucauggaugcuacguugcagcguaucuuuaauaccuuuugggacagggauagaguuuugaaccaaaauuauccccuaugauccuaaugacuauaauacccaauauuuuuaacaacuaaguauuagguauuacauauuauuauguuauuccaugaaugucuaggaaauuuagguaaaacauuacuaccucccccaaaaacuucaaauugucugauccaauaguccuuuuuguuucaccauuaauuuuagaauguauaugcauuuuuuaucauaaaccuuuuuccacaauuucagaauauaucaugacucuuauuacaccaaagaauagaauauaaagaagcugaguuuaaaacguaagagucuuugcaggguaaagaaaaugaccauauauuuucaauguguuuacuaaugacugcagagauuaguuuugcuuuauaaagcugagaaauacauaggcaaucagguugacuagcacaagauuuugcuugaaaauaaauggcuacauuucacauaaaagaauuaucuagaaauuauaaagauuagaaaacauacaguuuuauuuaaagaaaugucauuaucuaagugacuacauccuuuugaaaguaguugcuuuggcugagaaaaaaagucccaagggaaaaaauguauagaccauguuaguagaagugacagcaucuaaacaucucuguuauagaauggauagggaaaagggauggaaucagauaauucaauaaaaccuaaaauaguuuacuacuuauuauagucaacaugcaaauauuuccuuugcuuaucaaacaguacuuuauucaaagcacuuucagauuaucacucaguucuguuuacaaguacuuuuuucuuguaauacaucucuauucuacauuuauauaugcaucuaagaaacuagauaaaaaagcauauugaguuuuaaaguaaaaaucugaauaaucacacagacauggaccaacauuuauuacaaacaggaaaaguguagaucuauaagaaaagaguacagauuuuuuuugguaaaaaggcugcaagcugaaguauagaaaucaccauaaucuauauaaugcaguaauuguaucugcauuuuaaaaucacauugcucaacagaaagaaaacauuauaauacaguaauuuaaauugcuauguaaagguauuaaaacaguaucaacaguggaaaaguuuauuucaauuuaggacacucauguugcauccugaguucacuuccauuuuccaagaagaaaggucauuuugaaaaacugaaauguaugcuacacaacccauuauuuauaaggaaggaaaaaccaaguauagagaaaagaauucaucuuuuguaaaaauuuuaaauaaaacaaucaauucucuauaugcuuuuauuaaagaaauacagcuuucacagacagcaagauacaucguugcuauuaccagcagcauuaccuucuucauuucuccuucagccaccaauaaaaaacaugcuucaguaaaaaaauuccuuaugaauguggcccgauucaaaacaaauuacuucucuaacaauaagauauuguagcuuacauguugucacucaucaccuaauuacaugaaaagcuacagaaaccacaggcuggguggggcagaacaauuuaaaagaauaugucaaaauucuguagguuuucucaauuuugugauuauuuagugaccuuuuugaucauuguaaaaaguaguucuuuaaagagcacugaggcucugacuggggcauuccacuuaacucaaguguuuaaaaccucucauuuauuaaauccaaaaauauacuaaacugcauuuaagauauccuuauccgauuaaauagcuggagacauauuuaaauguuuccuuuauuugaaacuaagaagucacaaaaguacuuucauaucauagugauauuuaaacuuuauacuugauaacuaucacuuuaagaauagucauacaauuaaugacuugcucaucuuauaauaauacuguuaaaucaugugaccuagcaguuuuggaauaaagaguagaacaauguauuucagggaguggaggcaaaauguuaucuccuauguauuauauauaacaccaaaguaauuuggccuaguuuuugaaauuauauauuaagaauacacagaaguuuguccuaaaugccauucacuagagcaagauaauuuuaccuccaacaauuuccacacuacagcaaaaaaaugaaagcaugugacaaauucagaaugacauuuuaaauccaaauuuuacauagcuaaauagauacugcucaacucucaguuaugagcaaaucugaugcacuggcucauauagcagcaucauuaaccuuuuuuaaaaguaauuaauaugcucucauuuccaacugauguuucaaauuuuuuuaaaaaguuuaauacuuuuuuccuuugacauuuuguacuuaaauaggauuugcaaggaguuucucuggggaagcaaauuaucuuccguuacuaaagauguauguauuuucuauuaaaaaaagguauuuggagucacacaaguuggcuuagcagaauauaaagaaaugaacauuacaauuuucccaccaugaaguacugaguuacaacaaauguauuaacaaaacuuuauuuucuugagugcauacagaauguuauguaaacacuuaaguauuacuuucaauguaaaaacauucuuauuaucacuucggauuuuuaaaaaguauuauaaauagguuugugucuucuccagaaauauuaauggccacauugagugauaugaucaaagaaaacuuuagccucucacaggcuaaacaaaaauauagaaugugaaaauaaaaaauaaacagcaaaccaggaaagagaaaaacacagcucaggauaugcauuucuaaaaccagcauucaauuuaaaaccuuaauuccuaaaccaaaaauauaaauuuuaaaaaauauacauauauauuauuuaccauuuguucuuaauacauguuauauauaccuauuugugcgcguguguauguuugugugugugaaguaacugcaaauauuaccaacuaaauaaaucaggcaacugcuagcagcucuucauuucauuauaugaauugagccuguuauguagacaacuuucagccccuuggaauaacaucuggucuuccugaaacuuuuuuuuaggaugcaguuuguaacuuacagcuaggaaauuggagaaacaaacccauuguguucagaguuacagaauggaguaucuaacugccuauuucaguuuaacuuacgcuauaauaaaaugcaugaauaaugccugaauaauugagaaacaaggaaauuucaaaaacucagaaaguucuacuucacuauacaaaaacaauuauauaucaauuauuuucauuucuggugcguuugaauuuaagucuaauguguuucuaaagccagacuagaaugcagaucaggugcaggugauccagguuccuuguuuuaaugaguuaauacaaagcagcacgggcuucagcauauuucagacaggccucaccuguuuugugccaagcuacuuuggugauuuaaauauauuaaggaaagaaauggucccagaggauaggugaugaaacuuuaagguauggucaugggccaaaacuaccagacuccacauaaggcacaaucucucucauacauacaaacacacaaacauacauaccacauacacaaccacacacacaaaaauaaaacacacacaauguuccugcuauuauccaguaauuucccuccccaccaaguaauacaaucuaaacuauagcacaaauacaaugaguacacuguagccucuauuuaaaucugcuauugguuggguccauucugaggacauaucacagaugacacuguguugugcugaaguauauucaguacugcugaugaccaaagcccuuugaauagguccaaaacagaccuaaauauuaucaaauuucagguacagcagaaaauguuauguugaggcugcaguguacuugauuaugcugaaaaucuauaucacaaaauuaauauuaaaaauaagaguacugcauaaguuacaaaaagaaaugcguauaauuuucagcuuaauguggauaucaguuauuuacaucuuaccccuuccauaucauuaauuuauauuaauaaccugaaaaugacuacuuggugccaauuguuauugacacauuaaaacuuuuauuaucauuuuuacuaauuccagucuucaaaaauuaacauuuuccuccuaaccauaaucaugaaugggguccuuacucuuuaaaauauacaugccuggguucaaauuucaagauauaaaaagcaagaaaaaaauaucaaaguaucauuggguaaaauuaugauuaaauaggauuaaauagguuugaaucacauuagcuuauucuugcauaauauaaacuaucuuacagaaaaaucguuaaauuauugaagugcuuacauugauaaaccaugcauuuucacaaaauuaaaaugugaaguaauucuucucuuaaaauguuucauuucaccagacacucaaaauacucuaugaaaaacuaaguuaacauuucuguauuuucauauacucccauucauauuaguuuguaaguaggaauaaaaagaaaaaugaguucuaaauaaaugacacaggaggcaauaaauugacacaugacaaguaaauaaaaggcuaaagcacuccaauaccauugaaacuguuuuaauguuguugcaacuccaaaaugcaacaaucaucagcuuguaaaagacccaaauuucaaaaauucauuuuaauuacuccuuuauaccuauuuuacaaaauaaagguaagacacauuuaaauccuccuuguccuaauuggcuauguuccuaacuuguuuucuaucacuacagugaaugcugcaauacugauauaagaaaaaauaaaauaaaauaguaaccucugcuucaauguacaguuuccagaaucugccagaacuggggaacugggcaacaaggcguucauaagucuuccgugcuuugucuauagguugauucuaaaauugaaaaccaauaaacagcauuuacaauguuaggauuaugaaaauauuauucacugcagaaccaaguagugugauuggacccauagagaaggaaauguaauccuauaucacuaaaccugugccucucgaaugagaaugcuccaagcaucaaggucauauggauucucuucuaauuucuuuuccgcuuucuucaccuucucugggacauacucagcugccuggggaaaaaaaacaacagugaacuaaaguuacuguuuuaaaaaucucaugccuaacuuaauucaugaacaauaaaguccucagaugcaaugucacauuacaaagcauaaaaauauccucuuauaaaagagaaguguguuuccuagaaccgauguguacaaucguccuuccuuaucugugggcuccgcauccuuauacucaaccaaggguggauugaaaauacucagagagaaaaaaaaaagacagcacuaaacacguacagccuuuuuauuuaucauuauuuccuaaacaacacaguauaacaacuauuuacauggcaucuguauuauaugacguuauuauaaucuagauaugaguuaaguauuugggaggacauauguaagcuauaugcaaauacauuauuuuuauauaagagacacgagcacacauggacucugguaucuaaggggguguccuggcaacaaucccccacagauacugagggacgauuguauuuguaaucagaaguaacuugcauaaagauaauaaaaccaagugaucaaguauuuuuuauucaaauaaacuuacuuuuguauuaaauacuauaaaacagcagcucucaaacuuuauggucucaggaccccucuacgcucuuaaaauuuaagaaccacaaagagcuuuuauguggguuuuaucaauauuuaccauauuagaaauuaaaacaaauuuaaauauugauugauuuacaaauaaaacuuuuuacauguuuuuucuuuauaaaaaauaacuuaaaauucaguaauaagaaugucgcuuuuuacguauuuauaaauccauucaauguuugacuuuuuaaaaggcagcugaauuuucacaucugcuucuguauucaaucugcugcccuaucagaucauacagaugcugaaaaauuccacuguaugcccgugagagauuaggagugaaaaagggcaaauaaugucuuagauuuauuaugagagagguugaagucacagauccucugaaaguccuuaggaacccuugggguuccuggaccaacuuugagaaacacugcuguuaaagcauucauccugcgccacaaagaaaaugcaugaaaugacauggaaaucuuauuucgauguaaagaaauuuuaaaaacacaauucacaauuguauguacaauacaaugaaaacuauaaaagaaaucugcaauuaaagagauuuuuaaaauauauucaaaugcuuagacuggucauccuuggaagauaagcaguagaauuagaggcugauuuuuuuuccccuuuucuuucaauauuccccaaauccuuugguaagguaguuuuacuuuuauuauagaaauuuaauuuuugaaaaaaaugccuaaaauaguagccagcacuugaagcaaaaauaaaaguauuaauucucaaauuguuguucagaauacuacuguguaccacaaaaagggauggucaaauaagccagauaaauguuaauuuauacaggccaggugugguggcucacaucuacaaucccagcacuuugggaggccgaggcaggcagauuacuugcggccaggaguucaagaccagccaggcuaacauguugaaacccagucucuacuaaaaacagaaaaauuagcugggcgugguggugugugccuguaaucccugcuaccuggaaggcugaggcacaagaauugcuugaauccaggaggcagagguuacugugagugagauugcgccacugcacuccagccugggugacaaagccacacagcacuuugggaggcugagacaggcagauuacaaggucaggagauugggaccauccuggcuaacauggugaaaccccaucucuacuaaaaacacaaaaaauuagccgggcaugguggugggcgccuguagucccagcuacucgggaggcuaaagcaggagaauggcgugaacccaggaggcggagcuuacaguuagccgagauagcaccacugcacuccagccugggugacagagacuacgucucaaaaaaaaaaguuaauuuauaugaaguuuuguuuugccuuuuuucuaggacauccugacaucuauaaauggcaauauauauugauaauauccgagcauaaagagggaagcacugccccuaucacuuuucucccccaccacucccccuuuuuuuuaguggaauuaguauuucauggaacaauucagucaaaacaccaguuuggaaaaguuuaaaaaaaguaucuguucagauuuuuuuaauuaccuaggagaaauaaacucuuuucuuuggaauaaauuagcuugcaccacugguaagcauuuacuuauuuagaaaaaaagacauguugacuacuguaauucaaaauuaaaauuaggaugcuuuccuaacauauaagaacuuuaugaauagcuugcucaaggaacuaaagcuguaaaguuuauaagggacuauuggcucuucccauauaugaaacuacaggcucagaaagaacagcaaauggaaaaucagcaaauaauaaagguggcauguucaaaucagaauggugaauuuuucaauaaaugguuucagaauaacuauauaaucaucuguuagaauaacugugaagucaauuuuaucaaaauaaaguugaauuccuacuuuacucuuucugcccaaauaaacuuaagagagaucaaagauuuaaauguuaaaaacaaaacacaagacagaacuagagcagaauacgguuaaauguauuucugcauuggaaaagcucuucagaagccuuuugggaggccgagacgggaggauuccuugagcucaggcguucuucuggaccagccugggcaacacggcagaaucccgucucuacccaaauacaaaaauuagccaggugugugccacacaccuguagucucacguacuugggaagcugcggugggaucgcuugagcccgggagggagaaguugcagggaacugagauugccgccacugcacucgggccugggugacagagccagacccugucuuuaaaaaaaaaaaagccuuuaaagaguaaacuuacaugguaaguuaaaauuugcgcaugagaaaaguaccaaaauaaaaaaagacaaacguaaaaaaaaccuccaacacaugacaaaaauacuaaauuuauuaaaguacaaucaauaaaccaccagugguucaaaaagaaaaugcagccggaugcagaggcucaaccugcaaucucagcacuuugggguuggugggugggcaggaggauugcuugagcccaggagucugagacuaaccucagcaauauggcgaaaccccgucucuacaaaaaauacaaagaauuaguggggcaugguggcaugcaccuauggucccaccuacuugggaagcugagguggcaggaucaccugagcccaggagguugagccaugaucgcaccacugcacuccaaacugggugacagggcaagacucugugucaaaaaaacauuuuuuaauaaaaauuuaaaaauaaaaaaaagggcaaagcauaugaacaguuuauaauuaacuuuuuaaagacucaaaagaaaugcaaauauuggccgggcacgguggcucaugccuguaauaaucccagcacuuugggaggccaaagcaggcagcucacuaggucaggagaacagaaaccauccuggcuaacagggugaaaccccaucuccacuaaaaaacacaaaaaauuagcugggcgugguggugggcaccuguagucccagcuacucaggaggcugaggcaagagaauagcgugaaccugggaggcagagcuugcagugagcagagauggcgccacugcacuccagccugcaugacagagcaagacuccgucucaaaaacaaacaaaaaaaagaaaugcaaauauaaaccagaaaacaaagauccaacauuuuauaauuaaauugcacuggugaggguaagcagaaaaagauauucucauauuguuagcaagggcaaguagaaacugaucaauguggccaggggcgauggcucaggccuguaaucccagcacuuugggaggcugaggcgaguggaucaccugaggucaggaguucgagaccagcccaaccaauauggugaaacccccgucucuacuaaaaauacaaaaauuagcugggagugguggugcacaccuguagucccagcuacucgggaggcugagacaggagaacugcuugaacccaggcagcagagguugcaguaagccaagaucacaccacugcacuccacuccagccuggguaauagagcaagacuccgucucaaaaaaaaagaaaaaaagaaacugaucaacguuuaauauaaauguccgauucugaauuccacuucuauuaacacccuacugcacauguacacaaagauauauaaugagucagcuacuagacuauaguuacauaagacugaaaauaaauuaaauaacuauguauagccagaugugguggugcaugccuauagucccagcuacucaagaggcuaagguggaaagaucgcuugaccccaggaguucaaggaugcggugagcuauaaucacaccacugcacucuaccccgaguaagagaacaaaacccugucucuauuuguuaaaauuaaauaaauacauauaaaaaaggaccaauuaaauaaauuauggaauuuguagucacuuaaaaaaaaaaaaaggcauggcagguagccacauggaaaauaaaaagugauggugagcagggagacaugcaaacaacacauacacuuacucugccauauacccuucugguuuguuugaauuuuucuuauucgucugagaaauauucacucagugccuaguaugugucagacauuguaguggcccuugggauacauaacaaaauaaagaauucuuucaauggguuuacuucuugaaaaaaaaaaaaauuaaaagaaauuuuaggccaggcaugguagcucaugccuguaaucccagcacuuugagaggccaaggcaugaggaccgcuugaggccagaaguucaagagcagcugagcaacauagugagacacuggucucuacaaaaaauauaaaaauuagccaggcaugguggugugugccugcagcccuagcuacuaggcaggcggacugcuugaggccagaaguucaagaccagccugggcaacacagugagacucugucucuaccaaaacaaaacaaaaacaacuuagccaggcgugguggcaggcaccugcaguccuagcuaccugggacacugaggcaggaagaucucuugagcccaggaguucaagguugcagugagcuaaggcugcgccacugcacuccagccugggugacagugagacacugucucuaaaaaaaaagaaagaaagaggccaggcuugguggcucacaccuguaaucccagcacuuugggagcccgaggugggcagaucacgaggucaggaguucgagaccagccuggccaacauaguaaaaccccaucucuauuaaaaauacaaaaauuagccaggcaugguggugcgugccuguagucacagauacuugggaggcugaggcaagagaaucgcuugagaccaggaggcagaggcugcagugagccuccagccugggcaacagagugagacuuagucucaaaaaaaaaaaagaaauuuuacguaaacuagaauuucagucuugagauaccgacuauaaaaugauaacgauuaacuaagaaauaaaacugauaugggaaccaaaaaacaguucaucuauacuugaacugcuuuagguaaucagugauaacaaacacccaaaaccacucugaaucauggauuugcuuuggaaaaaugccaggggaugggauagacaaagaauccuacaagguaugaguugucgauuucuuuuagccuuucaguaucacugaagaauaaaccugauauaaucucaaauuuguuacuaaaacauauggucguuuuucucuugguauuaagauuugugauuuuugcccucugaaagagggaaaggauuguagacaagcagaaucacugccaagguuuacugcuauaauuguuuuuacucuugauacaaggucaauuuugcauuuagagagcuauuuaaauuacuuuaguguucauagauauucuggagcucaagacccacuugcucaaauuaaccuaccaaaucagguaagguauaccauauaaucuguaaaagagaccaacugaagagcauagaaucugauauccaaccaagcauaaucacaauaagacguauacaugucuccuuaauacaucaaaugagccagcccuuuagugauucucaauccuggcucugcauuagaaucaccuaagggaaggagauuuuaaaagauguccaagccucgcccucaaucaacuaaaccugaaucucuaggaauguacauacuaucaauauuuuuuaaaaacuuuucaaguaauucuaacguauagcaguccuaguugaaaaccauggcucaucgggugcaguggcucacgccuguaaucccagcauuuugggaggccaaggcagguggaucacuucaggucaggaguucaagaccagccugaccaacacagugacaccccgucucuacuaaaaauacaaaaauuagcaggcguggugguaugugccuguagucucacacacucaggaggcugaggugggagaaacgcuugaaccugggaagcagagguugcagugagccgagauuacgccacagcacuccaaccugggugacagaggagacuccaucucaaaaaaaaaaaaaacuaugcucucuaguugguugcuccuuuggugccacagaaucuuucugcagucuagugaaaccuaugagccuuuucucagaauaauauucuuaaauacauaaauucugagggauuuccaaggaaaaagcauguguguguguacuguugcuguguuuuuuuuuuuuuuuuuuaaagagacaggcucucucuacauugcugaucuagagauccugggcuccagugauccuccugucucagccucccacguagcugggacuacaggcguguaccaccgcuccuugcuccagagguuuuuuauaguaauauauacuuaauacaucaaauaacaagcuuuaggggccaauucacuacaugagugaugagugcugcugcuaacacuauuaccucuguaaauucuggccuacauuaauaauaaaagggaaugcucaauuucaguuagcgauuagugaaagucuuuucccccauccaauuucacagaaucccuaaaaugcuauccagauaccuggggaauuagcagaaguaucaguugcaucacuaaauguuuuuuucuggccuagcuccucaguagucaaauguucguaacacaaucuauacauguaauucucaaucaaccgcauuaauuaacaauggaaguuaaccagaaugcucaagagcauauccugcugguuauggucacauuuaauucucacaauaaaaagccuuuuaacauaacagcuaugaaccacuuggguagccaacgcugagagugaagcauuuuuguuuucuggccugguuaccauaaugcuacugggcaaagaaaaacugaacaguuuuguaguacccaaaagagagacugggccuccauaaggaaugaaguuguauuauuaccugaaucuguugccagaacaggucauuuuaagaaaacaggcugggcagaguggcucccaguacuuuggaaggccgagacgggcagaucacucgaggucaggaguucaagaccagucuggccaaaauggugaaaccccaucucuacuaaaaauacaaaaauuggccaggcaugguggcuuacgccuguaaucacagcacuuugggaggccgaggcagguggaucaccugaggucaggaguucaagaccagccuggccaacaugguaaaacccugucucuacuaaaaauacaaaaauuagcugggcauggugguacacgccuguaaucccagcuacgugggaggcugaggcaggagaauugcuugaauccaggaggcaaagguugcagugagccgagaucaugccauugcacugcagccugggcgacagagccagacuccgucuugaaaacaaaacaaacaaacaacaacaacaacaacaacaaaacaaaaauuagcggggcgugguggcaggccccuguaaucccagcuacuugggaggcugagaccggagaauugcuugaacccgggaggcggagguugcagugagccaagaucauaccacugcaguccagccugggcaacagauggagacucugucucaaacuaaaaaaaaaaaaaaaaaaaagaaaagaaaagaaaagaaaacagggcaaguuuccaaugcccuucuguaacaaacugcuuaguguagcaagaacagcugucccaugcuuaugcaucccaaaaacuuauuacuaucaaaaacuaucaaaauccaguuuugcuucugaaauaauaaucuauaauccuaauaucauuuuucaggcgauguuaauggggaacaggcagggaccccaaaucaaaggaguagagcaaaaacuggacuaguuaucaagacauacauauuaccaaugacuuaauuuuaucuucucugugaauaacacaaccauguacaacuggcuaaaagaaagaagguaggggggccaggcacaguggcucacgccuauaaucccagcacuuugggaggcugaggcagguggaucacuugagcucaggaguuggagaccagccuggcaacauugcgaaaccccaucucuacaaaaaacgcaaaaauuagcugggugugguggcagguaucuguaaucccagcuacuugggaggaugaggugggaggauggcuugagcccaggagguguugguugcagugaaccaagaucacaccacugcauuccagccugggcaacagggccagacccugucucaaaaaaaaaaaaaagguuugaaaguagaauaagcauauuauguauuuaagcuuuuauaauuucuuuuuuaguacuggcuugagacaugauucacauacauacaauucacccaucugaaguguauaacucaauaguuuuuauuuaugaauauauucaaguuuacagaaccaucacacauuuaaaacauuuuaucaccccaaagagaaaucuguaccuguuagcagucacucccauuucccuccaaucccuaagcccugggcaacuacuaaucuauuuugucucuagggaugugcccauauuuaauguaaucauacaauauguguucuuuuuguuucuaguuuucuuuuuucuuugagacaggaucucacucugucacccaggcucgaaugcaguggcacaaucauggcccacugcagccucaaccuccugggcucaaucaauccucccaccuagaccucccgauaauggacuacaggcaugugccaccaugcccagcuaaauuuuauaauuuauagagaugggguuuugccauauuguccaggcuggucuugaacuccugggcucaagcaauccaccugccucggccucucaaaguguugggauuaccaccgugagccaccaugacuggcguuguuuuggcuuucaguuagcguguuuucaaaguucauguuuuugcauauacuaaguacuuuacuuuugacaauauuccauuaugugcauauccuacauuuguuuauguaucagccgauggacuuuggauuguuuccaguuuuggcuauuaugaauaauguuacuaugaacauuaguguguaagauuucuuuguggaguucauuuuguguguuuuccuuuuucuuggauauauaccuagaaauggaauggcuaaguaaugugguaacucuuauguuuuaccuucugaaaaacuaccagacuuuaaaggggcuguacuauuuuacauuuccaguauaagggguucuaauuucuccauauccuuaccaacauuugauauuaucuuuuuuauuacagccauccuugugggucugaagugauaucucauugugguuuugauuuacauuucucugauggcuaucaaaguagagcgucuuuucauuuucuuauuggccauuuguacaucuucuuuggagaaaugucuguucaaauauuuugcccauuuaaaaacuggacuuaucaggaguuugagaccagccuggccaacauggugaaaccuugucucuacuaaaaauacaaaaaauuagccaggcauggugacaggcaccuguaaucccaccuacucaggaggcuaaggugggaggaucccuugagccggcggggaggggcagagguuccacugagccaagauugugccgcugcacuccagccugggcgacagagcgagacuaugucuugaaaaaauagaaauaaauaaaauaaaaacuggacguauuauuauuacuuuuuagagguauaguuuugcuauguugcucagguuggacuugaacuccuggguucgaucaauccuccugccucagccucccaaauagcugggacuacaggcgugcaccaccgcaccuggcuggguuuuuucauuaaugaauuuuuacauguuggaguuacaaaucccuuaucagacaugauuuacaaaaacuguauccuauucugugggaugccuugccacuuuccauguuuaaccgucuguuaugugaagcuaacuaacucagagaaauagaacuuacaaucuuggcuucacagacaugauguacuauuccaacuauucucaaacauuuuguaaaggauugcuucacauucuuaaaaacugaggagcuugggccgggcgcggugacucacgccuguaaucucagcacuuugggaggccgaggugggcggaucacaaggucaggaguucgagaccagccuggccaauuuggugaaacccugucucuacuaaaaauacaaaaaauuagcugggugugggcacaugccuguaguccuagcuacuugggaaggugaggcaggagaaucgcuugaacccgggagguggagguugcagugagcugggaucgcaccacugcacuccagccugagcaagagugagacuccgccuccaaaaaaaaaaauaacaauaauaauugaggagcccagagggauucuaucauuacucacauaagaaauuaaaacaaaaaauuaaaguauuuaauucacuuaaaaauaauaaauuccuuaaauaugaauauaaauauuuuacugaaggaaauuuuccaaaauaaaaaaaaaagucaaaagaauggcaccauuuuacauuuucaugaucuuuuaaaugucuggcugaauagaagacauuaucugcuucuuucaaucuguuacaauauauuguuuuagaugaaaaauaugaaaaaauuuuagccucacaguuacguaguuggaaaagggaggaaagaccauuuuuaacagccuuuacauacaauuguggauaggugauguagccucuggaaagcccuaugaguuaugcuuuauugaaacuccuaaccacuuucuuucuauaugagcucauaacuuuuauuaggagguuguuaaugggaaggugggaugugaagaggugacagacacuaucauguuaaugacugaaauaauauaauuuaaggcugggcacagugggucacaacuguaaucucagcacuuugggaggcugaggugggaggaguccuugaggccaggacguugaggcuguggugagcuaugaccacgccaaugcacugcagccugggcaacagagcaagaucucaucucuaaaaaaaauaguaauaauaacaauaauaauaauaaucuaauuucuuccauuucgaccaugcagguaaaacagacaaaaaaaaaaaaaaagauaauucucuuucuccaaauagcuacuuucaugauaaauuagaaggguguuauauuaggagccauacugaaauuaaguuaaaguagggaucaguuaaagugauaacacaaaaguaugaauagagggggagaaagaugguagacugaaagauuuaagacgauguaagcuuuuuacuaugaccaacagaaaaagcagaguugagccucaacccugguuuuauaaugaguauuucucgcuauucaggguaauaacuaaauauauggggguggggagcaggugggcaggaaaaaucaguaaaauaccauccucaaauaucugccauuuuuucauccacuuauuuaucaagaauauauuuuaaaacaaccagcuaucaucuaacucuguggucugcaagcuuuuauugacauaaaaaccacugugguaccuguuucaaacgaagauucucagccccacugaacaguuagguuugaaaucagagucuacguaucuauacuuuuauaacgcaccuaauuaugacauaaaugggccaugggcuccacuuuaagaaauauguaccaccucaucuaucuguuccacaaauguuuuccaaaugucacguuucauuaaaaauaagguggcaacaaaccugucauuccaagugaauuuuuugcuaaaauauuaagaaaacugaauauacuauauauuugaagucuuaagucucucucugugguuaacuuuuuuucaaaauuaaaaguagaccggaguagcacuccguaagacuuucuuuuuuuuuuuuuuuuuuuuuuugagaugaagucucacucugucaccuaggcuggagugcaguggcuguaccuuggcucacugcaaccuccgacucccggguucaagugauuauccugccucagccucccaaguagcugggauuacagguaugcaccaccacacucagcuaauuuuuguauuuuuaguagagacggaguuucaccauacuagccaggcuggucucaaacuccugaccaagugauccgccagccucagccucccgaagugcugggauuacagacaggcgugagccacggugccgugcugagacuuucauagaggaguaaccuaacugauuccauucauaugcccagauaauaaagaacuauaugugacaggugucacaaugagaccggauauuaggaccagaugucagcuuaguucuguguuccuuuaccaaugcaaccaaacccuacuucauguuuguugugaaugaaacugaacauguauccuacaauacaaaacuaaucccuccaaaucauccauagauuaaaaaucuaaacauacaaacaacucaaaaacuuaaaaaaaaaaagaucuugggccgggcaugguggcucacaccuguaaucccagcgcuuuggaaggccaaggcgggcggaucaugaggucaggagaucaagaccauccuggcuaacacagugaaaccccaucucuauuaaaaauauaaaaaauuagcugggcgugagggcgugguggcgggcaccuauaguccccgcuacuagggaggcugagguaggagaauagcgugaacccaggaagcggagcuugcagcgagccgugauugcgccacugugcuccagccugggcgaaagugcaagacucugucucgaaaaaauaaaaauaaaaaaauuaaaaaaaaaaaaaagaucuuggcuuaacauauuaguucaaauaauuauauuuaccauuaucugcuuaguaaacuugcauauucauccccuaggaaacaaauagcuacaaaauauaaauuaaaaucuuaaccguuuggaacuuaaaagaugagacuucuuucaaauaugaauaauccagauuuaauacacuaaauaaacuaagucaaacauuagaaaaacauuaauuaggacacacagaagcuuugcccuucugauuuuauucaauauuuacuauguauccuaaguuguccauuaaucuaaagauaguuuaaacaacugccaacucaaaucccuuuuuuagcccaauucucacaccauuaccaacuguccaacaaaacaaaacaaaaagacucaaauucacagguagguccuaucuaaagagaaagauucagagacaugguagaaaagcuuaaaaucaccgucaccaaaucgaagauuuaaaaaaaaaagcuuaaaaucaugaauugguauggguaauuguccaauagguaaaaacacccaaauacagauuuugcccuucugaaggucuaucugggauguaaaugccuacauucccugaaauaauguugaaggaaugcaguaucaccuaacacaguaccuuucugcuguaucucuaagaaaaacccaauucucauucuuuaagcacagagcaacuucucuuaggaacaacuguccccaaacagaauauuugauaaugcuccaguuuccuaagaaauaucaacaauaaagaucaaaucaauuugccugcccaaaacuguuacaccaaacaagcaucacuaaaaauaggaggcagaaaacuaggaagggcuguuacagaaagauuuuggaaaaaauaaauccaaaaaaacacauuguccaacacacauaguuggcucuuucucugccucuucuaaccccuacacauauaugcaccuugacuaaaauuggcgauacuguuacuucuaaacagcuuaaguacuaauguuuaccuaacgaaauaaaccagguuucagguuucaaugcuguggguguuucaacuuuuucuuuccuuauuaauaauaaguauauaauaggacacauacucuucauuauuuucuaaaucuucccaaaauuauuuuucacuaaaaacacguauuuaugagccuaaaugcuccuuuguuaagaacuaccagcaauuaauuugcgcuucuuagaaucauguagcuuuuccaagcugaggaucauuuggcuuguauuuuaggccuuccaaauucuaggauaaguuauacauuauuuaaaaggugaaauauggcuggacucacaccuguaauccaacaguuuggaaggcugaggcaggaggaucacuuaaguccaggaguucaagaccagccugggaaacacagugagaccucgucucuaccuaaauaguaaauaaauaauuuuuuuuaaaagaugcaaacuuaauccauucauuuacugaauaccuuuaagcaucaaaauauuauuucuuaggucuuuaagacauaaagaugaauaacaucaucucuucaacuaaagaaguucaaaacccaauggaaaaugucuaaauaacagcauauuaaaugccuuaagaguagugcacaagguuaaauagaccuaagaaugagaucaaaaguugaaucaggcauuaaaaaaaacaaacaccacaggcugggcgcaguggcucacgccuguaaucccagcacuuugggaggcugaggcaggcagaucacuugaggucaggaguucaagaccagccuggucaacauggugaaacaccauuucuacuaaaaauacaaaaaaauuagccgggcauuguggcgugugcuuguaaucccagcuacucaagaggcugaggcaggagaauugcuugaaccugggaggcggagguugcagugagccgagaccgugccacugcacuccagccugggcaacagagcaagacuccaucucaaaaaaacaaaaaacaaacacaaaaaaacaaaaccaugaaauaaauaauacagccauaauuccacacagaaaucauauguuuguuagggggguaaaccuauaugcaaauaguuuuuucaccauuaaacuggcaaaaacaauaagcaaggagcuucagaagagauccuugaacacuauaagguaauuccaauagcucucuacaugcaaaauugaacuucccuacuagaguugaaaaaaaaaucacagcaauaaaccuuuagcagugauuuugcuugucugcaauaauuucccucuguuagggggcacaaaucacaaaucuuagcaccaagagaaaaaugacuauccauauauuuuaguaauaaauuuaagauaguaucagguuuauucuacaaacuugaacuucaaugcuacuaaaaggcuaaaucuacaccugcaucuuguaggacucuuuguccaccccaucccuuggcauuuuuccaaagcaaauccaugauucaaugguuuuaauuuuuuucuuauuauucuuuagucucauugaguuuauuuuucucauccaugauuucagguuauuuuggauacucucuuuuccuccagauuuucaauauugucuuaaauaucaagcaagguacagcucauucauauuuuccauccuuaagguguuauuuaaugguuauuuuaguugaagcugaauacaguaucuaggauuugcuucgaaguaaugggggugagagaagcaaaugaagucauggaggaaacaagauuagccauaaauugaagcucuaugacagguacuucauauauuauacuguuuuucuuacauguuugaaauguauuauuaaaaaguuaaagaaaaggcuauaugaagaugacuuccuuguugauaaucagaugucuaaauugccuuucagacuuaaggaaaagauauaagaaccaccaaaaagguuuggacaaguugagugugcaaaagaaaaauggcuaucacugauacuaacacacuaagagaaauccaugaauccauagcgauacuuaaucuuuaggaagaaaaaaagucuuuuuugcagaaaguaugagccaguaaacagacacagaccaacagaauuguggguuuuaaaaacaaaacaaaaccaccauuugcuacuuccaauguaagagcugauuuagucaagauuuaucaauugauaacuagguauaaggugauuuuaaagaaaacgguuaucaacucacagauuauuaacugcaaaggggaacaugacccuuaacaaugagaucacccuaaaccaagugaucaaacuuaaccauccuaacagaacccagcagaaguaccugcuaauguaaugauauaauguuaaguauucuauccaaaaauacuuaacccaaauaucaaggcugaguauagaccuaacuguaaaguuuucaggaaauacagaugaagggacaaguuaaaugacaucaucaacccccaaaccaaaagcaagcaagcaaacaaacaacaaaaaacaaauacacccagaaaagcaguguuaaguguccuugacacuucgaauagacaacagccccaggggagaagaauggugagacuacuuaagagacagaaguaaaugauucaauauguaaaucuagauugauucugguuaaaaaaaaaaucacauucuugggacaaauggggaaauuuaaagaacuagauuuuagaaauacuauuuucuuggguggggaaaugguauggugguuauguaacaacauuuugcucuuauuuauaagagaaugcugaaauacuuggggcugcaaugugucaaaauacuuucaaauaaacaugcguggaccaggcgugguggcucgugccugucuguaaucccaacacuuggggacacugaggugggugaaucgcuugagcccaggaguuccagaccaggcugggcaacauggugaauuccugucucuacaaaaaaaauacaaaaauuaggccagguacgguggcucacgccuguaaauccagcacuuuggaaggcagagguaggcggaucacuugaggucaggaguucgagaccagccugggcaacguggcaaaauccccgucucuacuuaaaauacaaaaauuagcggggcaugguggugggcgccuguaaucccagcuacugggguggcugaggcaggagaaucgcuugaaccgggaggcggaggcugcaguaaggcgaaaucgcgccacugcacuccagucugggcgacagagcaaggcuccaucucaaaaaaaaaaaaaaaaaaaaaaaaaaaauuagcugggcaugguggcgcgcgccuguacucccagcuacggaggaggcugagguggcaggaucacagagcgcagggaggucgaagcuauggugagcugugauggcgucacagcacucuagugugagugacaaagacucuguucucaaucuaucagcauggggagauaaagcaaauauggcaaggcuuucagcuguugauuccaggcgaagaguuguccuacagguguucacugcacuuuucuuucaacuuuucucuauguucuaaacuuugcacaauaaaaccuuugggagaaauuauuuuucuauaaauuuucaccaccaucugucccacugaaacaccacaguucuaaaacauucaagaggucaugguaacauuuccgugucuuuguaauuuuagauaaauucuaagaauuaacaaugaauuucgaaaacuuucaaugaaaccucaguucauuaguccuucacuuucagauaacaaauacuagaucagaaaagggguaaacaguuuugauacaguaauuuuaagacuuugcaugcuugggcaugcuaacacuauguaaaauguaaauagugcgaagauuucuggacugaaaccaguccucgggcaaacacaaaacaauuuaaucaaacugccgacauaaugaaaucuacagucuuacagacuaugcaauagaacgcuccuauuuugccucaucucugccaaccuccaauaacaucuuccacguuauaagcuagggaaccugaaaaacgaaaaccuaagugcaugucguugcuauggcaaugggaaauuucaggaaauugagacugcaggcuaccuagccuccauuuuagaaacuguauuuaucuaaacacaccaggacuuagaucgaaaaacacauuuaauggcauuuuucauaacuauuuagcuuccucuuucacacuaaaagguaaauacuauccuacaaaauucugaauacaaagagcaaaagaaacaaaucacacugaucuaaccuaaaagugugaauuuuaaaauauuuaguugucacucauauuuacuauuaaaacagaugcuuuuauuuacaguggccaaaacagacuucucauuuucaacuuauaccugcaauguuuauguagcuggaaaaaugaaaacgaaauguggcuaaaagaaaagaaaacgaaagaaagccacaaaauucccaaaaccucagcauaacuugcuucuuucuucacucgcucucauuaagucuuaauucuccagauuagcuuugucucaaauauuucucaaacuaguaaccuauuucuggguacaguauauuuggcgggguaaaagaaacacugucaaguuuuucuaaaacgucgggugcacguuaaaauaauuccuauccacucuaauaccaaaacgauaucaaaggaaagcaucccaucuggaguagucccaugaaucuaaauaggacgaagcagccuaccgcuauugucuaaaucaaguauuuacucguauucaugccuaagagagagaaguaaaaaaaaaaaaauuaaaucuuagaucuugcuccccauucccaccacucuucuauauacccugucccccggguucacuagacccaauuccuuccucagccgaacaugucuggagcagucggaggaacagacguggagaagaggucgccacgaggccccaccacucuccuuccucaccugcuccguggcuccgucuccugacauggccucagcugauuacaacgugcgcacugaccgucgaugggaagcuagaaaagaaaaauuaaacuaaaaaccacccccaaaucaguaaaguuacccccugcccagcugagccagaccgccaacaccaaucgccaccgcccacucaaauaugaauuaaaauggcugc

SEQ ID NO: 192924 - RNA, 27366 nt, Homo sapiens
ugaaucagcaaugcaguuuuauuuaaggcagaauuagggaaaggcuaugccccuccacucccccuccuccuaccacucaguccuaucccaagucaggcacuggaaccugcugaaaaggcugaugaggggcugacaggaguggggcaggguucauggaccuuuaccucagagcagcuuacccugagcuauacccacaucucaaggauuugggggcgucuagaucucaucuaagggagacacaacuuuucugguccucagauggaaagcugggggaagguaccaguauuuacccuuccauaaaaacuuuggaggucuuuaggaggauaccccucaggagggcuaggagaggaaugacaaauacagaggauagaaggucccguggccugguugugcccucacacaggguauggguuguccaggacugccacucccgcugccacaccaccaucugcaugcucgauggcuuugguucgaaguagaugccccacgugcuuguucaucacgagugucuuuuccugccuauagaaauggaggcaggggacacacaucaccuggacucagccccaaacccaggaccuucccuggacccagcugagcaguaccuggguaacugucuauaccaagaaagugcuaggauuuuagagucucuaugccucucuggagucuccuucuaguccuagguugucaaaccauguguucugaguccucuuggugcuauuuggaguuuccuucacgguugcaaaggacuucucaucagggcuucaucugauacccugguaaggugggcaggucuuggguccuuggccucauuuaauagauaaagaaacagguaauaaagcuagugauuggcagagcuggcaccgaagcccaggauuccugacucuuuccaguguuccccucuaggcuggcucacuuggcuggcacucuugcaagcagguaguggaaagagcuucuccugauuggcucaccugacauagaccccaaagaugcccagcucugaaaugcacuggaccacucgggcagggcugccaggccguagcaggcaauucucaaaaggcucagguucgaucuucuccaugaggauguaggaggcccucuccucacuguccuucagcuguuucagggccuguaccauuuccuccccauauagguuguuaccugcaaugaaacuggccagucacccuggacccucugccuaccuccuccaucccaugcccucacuuuuggggccacaugggcaagucagcagccucaguuccuggcacccgcucagugaagccagggcauaucuggcuucucaggagggaagcucacuuugacaggagagcccuuacucaugcagugaacacaucuuccacuacacuguucugcccugguucuccuccuaccuacagcuguuccuucucaagcuccauugcuggcuccuucucuuaaaugcuggggucccaggggaauugguccuccacgcuugcucucucccccauguacauuuucccaaggagaucucuccuauuccugagucuccaucuauacccuaaaaauuguuaacuuccggccgggcaugguggcucacgccuguaaucccagcacuuugggaggccgaggcaggcagaucaugaggucaagagauugagaccauccuggccaauaugaugaaaccccaucucuacuaaaaauacaaaaauuagcugggugugguggcgcacaccuguagucccagcuacucaggaggcugaggcaggagaaucgcuugaaccugggaggcagugguugcagugagccaagaucaugccacugcacuccagccuggugacagagcgagaauccgucucaaaaaaaaaaaaaaaauuguuaacuuccaaauauuuaaugcaggcucccugcuuagacaucauaugacuggcccccaaacaaacucaacuuguccaagcagaacuuauuacuucugccugaaccugccccuccuggaccuuccuacucccaaucaggcaaaagguaccccugagucauauuuaacuccucccuuccacuacccucucacuaucuaggacaugucucuccaguuggccccauagucauagcccuagcccaggccucuacguugcucuucugaacaacuguaucagccucuuccacggucuuucugcuuccagugucuccccucauuccaggacaucuucuacaaugcagaaacuguaaguuuugcaaguucccaccacugcuaaccacuugaguccuggaucaaugugucccuuccuggcuuaaaacucccuaauggcuucccacugcccuuaagauaaaauccaauuucucaguauauauucaaggcccuuuauaaucaggaugcaaaccauuuuuccagccuaaaucccuguccccucccagcucccccuccagccucaccaguuucucauuaaccuccaaacaucucacacuuucauggcccggugccuuggcuugagguugucccuuuuguauggaacacucuuccuccuuuccaccugggaaauuccuacccaccucuuaagacaaagauuaaaaaaauccucuccucuggagaggcagacaugaccccugaccucaaggaguuucaaacuagaaaggaaaacagacauguauucucuccagucuccuaauaugacccuacucuacuucccaacaaucuacccacaggcaccucagguaaaacuuguccaaacccuucaaugcugguuaaucagauuccccugugcucccggacuuggucacagggucuuaggggacacuguccaacauguggccugugucaguuccaauaguuucccccaugcccgggacugugcccagaguaagugccaaugagcacuggccacagccugcuagucccucucauugaggagcccugcaaagggagauccaccuaccuccacccucucucuggggcuuuagcacaaaccggcuaggggcagcaagggccucggcgauggccugguccccuucuucacccuggcaggaggcagaaagcaguuaucaaaaguuuaaaggcuaaagaggcaagaagcuuagguccagcugguuaugcagagcagcaucagaggaagagcaggagggagaacagccacaaauuccuucaggcaggaugcuacuaucuggaugacacucccaacaaacccccugcagcagccgaugcaaugagaacaggccuuucuuuagcaacagcucagggcucugcagcaggcagccugauacacuucucaauucuugccaccugccuuagucccuucccucugguugccauccucaucucuaccuuugcugagggagcuuacaauggauuccagcccccauccuuccauuaugaggcugcccuucugcucagaguucuagggguucuccagagcaucaccaaccuugccagcuccaccuuccccuugucacaaugccagcuccacccuccccaacacauugggcuguaggucucugccaccuaggaggccugugguaggagaaacaggcugcccacguaccacauccagugaguagaggccagcaaagguggcgcggaggcgggccacagccucaggcuggccagggagcaacaucuccagcaugcccggccugcuuagcuccugcugcaccuucuuagucccagccagcuggguggcaaugucugggcacuuggcagcaugugaccucuccagcaguagacgugcuucccaauucugcagagggaagaagacaaaaggaauucgacuuuauuuuacuucagcugacguuuacugaacauccauccauuaggugccagguaucaugauuuguaucuucacccucauuaucacccaggaucauucuaacauccuugugagccaggugugauauguuguaguuauguaucauugugccagacugugagccccugcaaaggcaagaaucccccaaucugugggaaacaauagaagguguaaggguagaacauuugucuacgugcucagcuucccacuguguuccauacucccuaccauggccuucaagauccuucaggagcuggcuccugucuacuuuuucaaccuuguaccaucccugacuccuagucucugccauucuacucacacaggccugucauuccucaaaucacaaagcucuuucccuccucagggccugcacugcuuuucccucaaccugaaacccccuuccuuucggcuuuucccaugcauagcuggauccuuaccauccuuacaucucagcucaaugucaccuuuucagagaaggcuucccuguccacucuauuuaauguggauuucccauaauucucuuuuuacccaguuguuucauugaaagcaguuaccugagacuaaaacacacacaugcacacauacacgcacacgcacacaaacauacacacacaaaucccaauuuuuuuuuccuauuuuuguuuacuuuuuuuuucuuuugagacgugggucuugcucugucacccagacuggagugcaacagcgcaaucuuggcucacugcaacuucuaccuccugggcucaagugauccucccuccucagccucccaaguagcugggacuacaggugcacgccaccacacccagcuaauuuuuguauuauuuguagagaugggguuuugccauguugcccaggcuggucuugaacuccugagcucaugcaauccaccuaccuaggccucccaaagugcugggauuacagguacgagccacaguaaauggccauauuuuuguuuacuuucugaugcccauuucucugaccagacugugagcuccauagcacagggcucuuaucauuuuccucauuuucuguuguaucuccagugucuaacacaguuccuggcacuuuguaguugcucaauaaauauuuguuguuguugcugaauaaguugaaauuugagugggguucugaaggacagguagagccugacaagugagacucaauagggaagggauacucaggcuaagagaauaauaugaacacaggucucaaguggaugaucacaggaugaaugguuuauuaccacaagagcugaggguauaaaaggcaaggaaacagcaggggaucaugccucccaacucugguucccauucucaugcaauggggagacagucuguccuuggcuccagaccacugcaaacugcacacagcaggaucaggucucuccugugacccccacccaaugcuguccuuccuuugauacuacugguccaccuguagcaccuugaccugaucuucaucaauaaccccaggaacccaacuacuagucuggcauuccacgcagaaucacacgugaccagaacaucagaaauaaacccagagaaauaccccauuaugguagaagcaggaaagcaaaaccaaagauaagcaaggacuugcccagggucaucuaguaagucacuaagccuucuagaucucucuccaugucuaaaccugcucugagcugcucaguucccuaaaaaugucuaccucuuggccaggugugguggcuaacaccuguaaucccagcacuuugggaggccaagguggguggaucguaaggucaggaguucgagaccagccuggccaacauggugaaacccugucucuauuaaaaauacaaaaauuagcugggugugguggugggugccuguaaucccagcuacucaggaggccgaggcaggagaaucgcuugaaacuggaagucaaagguugcagugagccgagaucgcaccacuguacuccagccuggucaacaagagcaaaacucugucucaaaaaaaaaaaaaagucuaccucuuuaaacacuacuuuccuuccuuguuaucucaaacucuucuaaguuuucuuugucguguuuugaaaucuagacccauuucuuuuuuuuuuuuuugagacagagucucgcucugucagccaggcuggagugcaguggcaugaucucaacuuacugcaaccucugccucccgggcucaagcaauucuccugccucagcguccugaguagcugggauuacagggguaugccaccacgcccggcuaauuuuuguauuuuuaguagagacgggguuucaccauguuggccaggcuggucuugaacuccugaccucagguaauccaccugccuuggccucccaaagugcugggauuauaggcgugaaccaccgugcccggccuagaccuauuuuucuaauagacaguuuaucucuccuguagucagcaaguugccaccacugcuaaccaccuaucuaaagaaaaggauguucuaucgagauaccaccucuauagagccuccucauguggagcucaacccucggggggaguccuagaugaauuacagaccuagaaggagcccccucaguuuucuaguguagcuccccccgcucauagaaacagaccuagaaagggucaggaacuugcccaucaucacacagaggcagucaagcucaugaccuccagcucacugcccaugguauuucuaaacuuauuuccuccuuuaucaucucccagcugagagcagagcuucuuagccucuccaugauguggauguuaggagcagaggagaagaaugggaauaccaucggccugaaagucagaaaaccugggaacuuccuguagggccuuagagaagccucuccaucucucuaaacguuaguuucuccaucuguauaauggggauaauuauaugccucaccgagugguugugaggguuaaaugaaauaauggauguggaaacuaaugaaacuacaugguaggauagcaaaaugaggugauauaacugucauuaacaugaaugaggagaugauaaaacuuucugauucagauaaaggaaagguaagaguuggcaggaaaaaaaauggucagcaguaugcuggaacuggcuuauaucaaccagugagagcugauuguuguuaaacauuugccagcacaucucuggaaacaguguaaauggcugaagcucuguggauuccugaggauucaaauucuagaagacuguguagagugauagguagcaaaaggcuugagggaggauaggagguucuagcagcaagcucccugagaaagaagugaagugaggacucggaaaacccagguuguuauaagccugaauugggucucuguggagcucuugugggucccaggaggcaaagaauggucucacagaaaauaccaaccuguagacuguacugacgaggcauguagccaucccggaaguaaaccacagcaauuuccuggccaucccuggaacacaggauggagaaggcugcuguguuaaauuauaacugauuuguucagugguucaaucuauuucagggugcaucaagaugaauuuggcuuuuucaaaauucagcccacagugggagccuggucagggguucacuggaaccagugaaaguagauauccacacuaccagggcuuccacugaaaacagggaggugugccauacagaauacuuuagaauaugccagauuuagagucauucuaagaaggccagaaggaacaagaaggucacuagaaucaaauuugguaaaugcauacaaauguuggcucgaaauuaccgagcagcagaaucauacugccauguguaguaaaacacacuuuauauuuccacugcuuaaagcagcugaaaccagaaugaaaaaauuuuuaauggcaggggugaaggugaaaacgcaaacauguaaaaugaugagucugauuaagacacaggcuuuuuaaaugucuuuuccuuuucuuugaccuauuugauauugucuaguuuaucugaaaaguaaauuaacuacuuuguuuaguuaugauaaaagcacauuuugaaaaacagugagugguauugugaaauuccauggacaguuuuaauuuuaacaaucacaaaggucuaggucuaaauauaugugcugcaaugcuacccaaauauguagcaccaaaucuaccuggugguggccccuagagaaaaggauaaggcuuggcuuggaacacaaauccaggcucgagcucagacaguggcauccagaccaaucacagcaugagccagcugcuccucuuccucccugacugcccagcucagcuucucaggccugaccucaccuuacuaggagaggcaagaaaacuuuugggaacuuagggcauaugaaaacuaagaugaucucuaaggagacccugauccagaaugucaacagcucugauagaagcacagcguggcuggcuuucuccaaaauuuccugggaggaugagauauuucaggaauuaugagagaaggaagcaagccaucacaucucccagaagaaagaaucauuuuggggaagaggguggcaggaugaguuucauaaaccagccuuccacuggauucuugggaaugcuuacacaaacagccuucggucuugguccagagaccccuuuucagagauaucuucaaauguucgucggaucacauggauguuccugggaaaaaugggcaagagccagagggaauggaugcuauguucugagugccccaccccuaauccuggagccacaccuagaagucccccuuccuuuacuuaccuggccaguagcucauucucuauggcacgcuggucaaauauguuucuuuccuucucuugagcaaucaguagcaccagagcacuggggaaagagcacagguggcccgaggcuacuauagaacuuguucuucuuuuguuucuccccucaacccccauaccgccccaccuccuggaauaagaauaagaacaccgcuucccugaaagaacagauguucccucucucaggaaccuugagauuaccucaggcauagacaccugaugcuaucacauaugauuuccugaaaauagaaaacuucaaaaaugaagaugccucugacccuucuccagugggcagaugaaauauuguaaugaugucauggguugaugaauuucugugcaaauuaaaauuuagauuuaaaaccaucucaaaaacccaagaggacuuuuucuuagaacuuaacauaauucuaaaaucuuucuggaagaauaaacaagugggaguauugaggaacauuuuguaaaagaacaaugcaggggguccggggcuaauggcucuauuacuagauuguaaaggauacaauaaaggaaugugguucuuacacaagauggaacccuacagaaacccacagggccaacuacaaacaacgacauuaucuccugggcccucccaagauuccuauaauguacacagggccacauuugaucucauaguauuaaugagaucacuagggcuuauguggcuucuuccucucugauuauucauguauuucuuaaagaggcaggggcuugagggcucagggaaaagcuuaugccagggaacuaucuguuuggcugccagcuaacauauuuccguugucaaagauagguccaguccccuaagagauuccuagggcuaaugcucagcaguaccaaacugcauuuuuuuucuuuuacauuuuauuuuauuuauuuuuuugagacggagucucccccuguugcccaggcuggagugcaguggcacaaucuaggcucacugcaaccuccacccccuggguuccagcgauucuccugcuucagccucccggguagcugggauuucaggugugcaccacccccgccggcuaauuuuuguaguuugaguagagaugggguuucaccauguuggccaggcugggcucgaacuccugaccucaggugaucugcccgccucggccucccaaaguguuagcauuacaggugugagccacugcgcucagccuccaaacuccauuuuugcugugacuguacugcuuugugucuguggcuucuuccugagacccauggaacccuaggcuuuggcuuaggauucuaaguguguauucccugaccuccucugcuuagccucucuugucuaucucugcuucuccugaccuuggcugaaccucuuagucuaaacucuguuugccugacuccuuucugcuuagccaaaauauaggucuuaguaaguccccucuccugguuugccugaaaucucaugaggucagaugugauguuaagcugagucuuggcuuugaguugggugccugagagacaaacuaaaaguggugcucucacaagucaucuugcccugagagaguccuaagggccaauggcuuugcucuucacuuugcagccuaaacugucccgcucaugggugagggugugugugggagggaggcaguuggcccaggcuggcccaccuccaaaaagaggcggaggaggaaggcuggcagcuggagguuaaagaggaacugcacgccccagcuaauuaagucagccugccaacugcuaaacaaucagagcugggcucagaaaacauauuugaccucuccugccuucaguucugagcaguucucagcagucuguuuccuaguaggaaaguugucagcuaaggacgcaugcgggcugggggugaggaccccugagucguagguaguccaggcucugccagugacuuguagugugucuugguaauugacuuggguaaggcaauuucguuccuugggcccugguuuucccaucuauaaaauaagaguguuauggcugggcaugguagcucacgccuauagucccagcacuuuaagaggccgaggcgggcggauugccugaggucgggaguuugagaccagccugaccaacauggagaaaccccguuucuacuaaaaauacaaaauuagccaggcgugguggugggcaccuguaaucccaguuacuugggaggcuaaggcaggaaaaucccuugaaccuggaagguggaggauguagugagccgagaucgugccauugcacuccagccugggcaacaaaaacgaaacucugucucaaaaaaaaagaaaaaaauugguguuaaaaagaucacaguucccaaacuuuuaucaccaguaguccccuuuucuuauucuacucauucuaaccacaggcccuaugcuuugagaguuugucuaaauugaaauuguaagucauuuugcaggcuuccauuuuuaagaaauuuuaaaaaucaugagauaauugacgaaaauuaaucugcucuaccaaugcaguuuuucagucaauacuguggaaccauaucucuuaaaggcagaauagggaaguagagagaacauaggcuuuagaggcagaugaauucuauacuuaccgguuguguaacuuugggcaaguuauucaaacucucuuagccucaguuugcuguuguaugaauuaaaacuaauacuugucaaaugauagcuauuauuauuauuauuuggguuuguuuuuuguuuuuuuuuuuuuugagauggagucucgcucugucgcccaggcuggagugcaguggggugaucuuggccacugcaacuuccaccucccggguucaagugauucuccugccucagcaucccaaguagcugggacuacaggugccugccaccaugccuggcuaauuuuuguauuuuuuaguagagacaagguuucaccauguuggccaggcuggccuugaacuccugaccucugaugauccacccgccucggucucccaaagugcugggauuagaggugugagccacugcacccggccuauuauuauuauugaaaguaccacauaaugauccacacagauuuuuaaaaacauuuuucagauccaugaucucauuuaauucucacuaacaccccuuuagguauuauuauuacuccuauuuuacaaaugaggaaacugaagcucagagaagaacuaacuugccaaggucaugugcuaugucagcagaagaaccuaucucacucucacaaugggggaagccaguucuggcucaggugccacauaacuccuaccuaccagugccuaauuuuggacacacaaguauuuucuguccacguuacugacaggcuggcaggcaaaacccucugcagcauuugucugucagcaguuccccagcugacccauccccuggcuucacucucuuaaaauacaaccuagccaauauacuugaaagaauauuugucugaugacuucuaaaugcuuacagucugagguuucuuugggcuuagugaggcuuagcaaggacagagaggcucccuuggagguaagagcaugauuaagaguggagguuuuagagggagguagacuuugggaucugccaccaacucaucacuuagccuuaacaauucacuucguuucucagaaccucaguuuccucaucuguaaaaugagggaguugaacaguauugaccucagagagcuuauuaugagaauucaaugagauccuguauguacagagcuuagcacaagguguagcacuaguaaguguacauuaaggacuauuaaugcuauauuaacauugcaauaacuguuaguauagcggccccucgaugaucugaaaaucacuuaccuaacaucuucacuugagaaauaggaagaaagcaaaaaaugccucuaagcaguuaaaaaggauaccauaaaauuucguagucaaagcuuaugcauuuacucauccaagaggcccucacacucuucagacccaaucauaacaaucuggaucauuuguuuucccaaaccacagcaaaucagaagggaggcaugggcaugggggguggaggauuccaaauucaagcauaccaacagcagucaaaaguaagagcugagaauugggaaacagacaagaaaacuaugaagaaaaugaaugagaggccgggugcaguggcucaugccuguaaucccagcacuuugggaggccaaggugggcggaucacgaggucaggaguucgagaccagcaugaccaacauggugaaaccccgucucuacuaaaaauacaaaaauuagccagguguggcagcaugcgccugaaaucccagcuacucaggaggcugaggcagaagaauugcuugaacccgggagguggagguugaaguaagccaagauuguaccacugcacuccagccugggugagagagugagacucugucucaaaaaaaaaaaaaaaaggaaaugacuaagaacuuaaagccuagcagucagagcuauuagcgcaggcaaacagccuugcgugccucucuaacccuagguagcacuacuguauuacagcaagcugcaauuguugacagucauaaugaugaccuccacucaauaagaaaaaguuaaaucauagucagcaucuguuauuuaagaaggaaaccuuaaaauaauuuuggcauguaaagguauaaguuucuauuccuagaaaaauccccuuauucucuaaugauggcuggcaagaaaagaaguugcuaaacccaugaaugcugaaacuaaagcaggauccuccugcuaccuuuucacacccuuacuugggugagccguagagcucccaggcuuuggcaauucccagggccagucccuugcugggauuauuagagaggaucuugccagcuucuuuggucuuacucaggacacugagaacaugucuguuggaagagagauggcuguucaguaauuggauggaccuggaagaccccucugcccaugaccucauauauacagcaacaugacucugagaaucagcugagcacuaaaaagcauccucccaucacauuccuguaagauccacuucagguuggaauaugcugggcugcccuaaccuuggccccugguguauaugccuggaggagaccugagagccucuguccccaccccaaccuacccuagugucccagugagcuggagccccuuacucugggccuccaggugcugucuggaauccugcugcagaccaucuaaaaucauugcaaccuggagcaucacugcuggcuagaaauggaugcuaccaggcccagcccccagacagaagucccugcauuccucucucuggggcucucaagauauuguucccucugccuguacaauggagggacaggacuagaugagcuaugagguccuuuuucucccugacauaccaaggaucucauuacaaguggaaacugcugucgggguggccaggggcaacaugugacccggggcccaggaaagcacaaucauagcuggaguucccuggccuagccagugacuguacacccaucagcaugucaccccacagguaugccgggggcugcccaggggacccaccggugcacagcugggguccgggaggccaggcccccaaagcuggcagagaugguguugauuucgaucuguuucagggcuggggagccaucugcgcugcgcuggaacauguagucugagcgauucaggcccaggaacacagucuguggggaaaacugaaggcugacaguaccugcccagggacugacucugaggaccuagccacagagcacacagguaccaugaacucuacacagagauuagagguaccagcaaacacucccaagcccaguggaaucauucuucuggucauccuagaauuggucacugggauaaacccagugaggaccagugagaggcagauucccaugagcugagggccuggaccaaauucuucaagcaaaacagaaaacaaacagagaugggagggacagguuacagacuggaguagggcugggaaugguuaccugggcaaugcccucuuuuaggacuugcuuguggaugucaaagagacgagcgguaaagucauccuguuugauggugcuggaggaagaaacagagaacauuuugcaggcuuaauuggaccuaaaauuucaaggagucccauccucagucauugacuccugaauccucucugagucuacuggccaaaacuugaauguccgccccaaugugguagagaacaguggcuaagaauccaacucuagaccuggguucaaauccuagcucuaccacucacuaguaggcaaccucagggaaucauuucaccucucugugucucaguuugcugaucuuuaaaauggagaauauaauuauauuuauaucauagaguugugguaaaaagccaauaagauauuacauucaaagaauugaacauacugcaccgaagaagagcuagaaaaugacaugauguaucuauucuacuugaauagcucugaugguuggcaagccuucugguugaccuaauacuaacucuccauagcuuuuccuacccucugcgaccucccagggugagccuucuccuccuccuccacagcagcccuuggagauuagaagacagcaguuaugcccugugcaccaauaagauuuuucugacccaagcuaaauauccuggguuuuuuuuguuuguuuguuucuucuucaacuaguccucauaugaugugauuuccucagggaagccuucccuaucugagucagaucccccuacuauguguucucauagaacuaagaaccacuccuuuacagcacugacugcaguugcaauuuuacauuuucuuugugugaugauuagugucaucucuccuguuugacuauaaaccucaugaagguaauggcugugucuaugcaggcucaucgucacagcucaguguacugccaugacaugugacauguguuaggggccuauccaguaugguuuucugaagucucaacaagagccacaguaagaaggaauccacaggugauuaacaucacacuuacugcccuuugagauucaggguggauucugcacaccugcucaagccugaaucaccuuguuacagaaacgucacagcagaccaguggggggaagccaaguagcccaggccugcccugaaguuccucugcuccucagccagcucucucccaagggugagcucucucaugccagcccuugguuaggaggagagucccagcugggcuucagccuccaaggaaguugagacacacuuuccuuuuucugaagaggugcuccccuucauguuuuguagggggcucuucucccuuaggaacuaggguuuauauguguaugagaggagagaggaacagagaaggcagggguugcaaagaugagcugcaagucuccuucauaauugcaucauuaggguuauaagccaggcugcucauguuucccacaauccaggauugcagguacaaagcugggcccauuccaagaaacagcucaggggcaagguggugggcagauucauacauucaugacucauuggguuuuuggcuacaagucaaugguuuccaagcuucuuaccauuaugaccccuucucauauucacccacacauuuuuaaaagauuuugucuccaacaaaagucuaauuucuguugaaaaauuaaucaaagacaugcaauuacagguuggauaucccuuauccgaaaugcuugggaccagaagucuuucggauuuuggaagauuugcauauacguaaugagacaucuuggggaugggacucaagucuaaacacaaaauucauuuguuucauauacaccuuauacucauagccugaagauuauuuuauacaauauuuuaauuaauuuugugcaugaaacaaacuuuugacuguguuuugacugcaccugucacaugacaucaggcguggcguuuuccacugguagagucaugugguguucaacaaguuuugaauuuuggagcauuucagcuuuuggauuuuuggauuagggaugcucaaccuguacaguauauacacaucuagcauguauauguaaauacauaauauuucuagauauuuaauucuacaaugaauauauauacauauauauauguauuauuauuucuuuuuuuuugagauggagucucgcucugucgcccaggcuggaguacagugucgugaucuuggcuuacugcagccucugccuccuggguucaagcgauucuccugccucagccucccaaguagcugggauuauaggcacccgccaccacacccagcuaauuuuuuuauauuuuuaguagagacgggguuucaccauguuggccaggcuggucucaaacuccugaccuuaagugauccacccaccucggccucccaaagugcugggauuacaggccugagccaccgcgcccagccuauauauauuuaauucuaaaauaaauaaagaaauuuuaagaaauugccccagaaucugaagaaaaaaaaaaaaagaucaagggaaagagacagagaagggcggaugggcugaaccauuucagagguugcuuccucaugcccugaguguggcccagucuguaccccaucccauccaaagaugagaggccugaggugacaagaaagugucgcugcuuaggagaaguagaaaaucugacuuuaacccaauaaccuucccuaccucuguuuuccuccaaaaccaggcugacuuccccuaauuccaaauggaaauaucagucuucaaaguagggugucacggauuacagaaugucaacaauaaagggaucuuggauuuaagccagucucuucauuuuucagaugaagaaaccuuaggcccagagaaggaaagggaguggcuugaggccauauaaauaacuggucgagccaggauuagaagccagcuuuccugacuccuaugacuuuuuguucuuuggagguaccuuuccucuaucccaccaagucagcugacacaguaacaccucacggcucugcaaucuuccaguuccuuggcucuggcagcuccuggccccccaaugcuucacuguccccuaccuggaaagaguuugcuccaggaaggcagcguucuggcugacagcauccacuagcagguugaaguccaucugcacagcauaggcuugcuccagcagggcacuggggaccagugaggggaagagcgugaauggggcauagcucaccaccugugaucaagaagagagaaugggacagggguagggcaccugugaacggguugucuuccugcaaauggaaucccauggaaagucuggccuauauuuacugaggacacaccaacuguagauuagugguuaccuugggagaguggaagggggagaguggaacccagagagcuuccagauucugugauaguuuaucucuacguauugaagagagagaagcaaaaaagcaaaaugcaaauaacaaaaagaaacccacaaguuauugagcacuuacuaugugcaagguacuauuuuaaauacuuuacauagauucaucauucagcccugugaggaagauacuauuauuauccacacuuaacagagacgggaccugagaaagagagguuaacagauccaaaauuauauucagcuaggaacuggugcugggauuugaaccagaacaguuaacagauccaaaauuauauucagcuaguaacggggugcugggauuugaaccaggaugguuacuaaacacaacacacacauacauacauggaagccugcuccuugcugguugauguucaagcccaggcccuuccaugcaucaggagcucacacuccaguuuccuugccuuuugauuuugauuugguuacuggguaggacaagugaacucugguucccuuaguagaagccaggaguguuuuuuccaccaauguuagugauggugacucagguuaacaggccuagaguucagcugcauuccgcauucuuuggacuuuaucauagacgagaaacccaaauaccaucaaggacacugauucuagaagggaaaagugcauucugagaucccugccaacaacugaacuagaacuuggguaagagaugaaaagaaaaucuugugacuuguauuauaaagcauuccugaguuuaaccuuugaguuaauaucaguuugucauuauggugguauaaguuuacgguguuagaacuugguauuuagauauuuauuuuuaaaguacuauuuuuuuuuuugagguagagucucacucuguugcccaggcuggagugcagugguacaaucucggcucacugcaaccuccaucuccuggguucaagcaauucuccugccucagccucccaaguagcugagacuacaggugugugccaccacacccagguaauuuuuguauuuuuaguagagaugggguuucacuguguuguccaggcuggucucaaacaccuggccucaagugaucugccugccucagccucccaaaguguugggauuacaggcaugagccaccaugcccagccaaaauauuauuauuuuuuuaacagguaauacaaauacaugauacaaaauucaaaagagacauaagaauauauagugagaaguaugucucacucucauuccagucuccuggggaaaagacugggccccagccacccaguucuccuccccagaggcaaaugacagacuagugucucacacauccuuccagucaucuuuguauugauauauauguauacacauauauuuucucuuuuuuucacccccauagcaaacuauacuacauugugcuuuuuaaauauuuccuuauauguucaaauagagcauuuucauuauuuuuaauugcuguauauuauucuacucuuaggauauaccauaauuuauugaaucuaguauauaggugguuucuuuauuuuccuauuaccauuaauguuucaauggguauccuagaauauacauucuagauauuuucauauaugagaaaguccauacauucuaaauuucuaaaaguaaaaauaucaaguaauucagguaaaucuauuuuaaauuuugguagauaauuucuaaauuacccuucucagcaucuuuuuuuuuuuuuuuuggaguggggucuuacuauguugcccagacuggaauacaguggcuauucauaggugccaucauagugcacuauagccucaaauuccugggcucaagcaauccuccugucucagccuccccaguagcugagacugcagguguguaccacugcccuggccucagcaucuaagauaaaacugaggaaggcuauuugugagaauaagguuuauucagucugaagccuuuaugaguuagaaugggaaugacugcagauuacauaaggggugaccuaauacccugaguagcuaugugaugacuacaggagcauuuccuuggcuugaacacauagagcucugcugcccccaacaagucucaucuuggccucaaaaacucagaguuuuucugcuaagacaucccucugccucugucccagggcucauuaugcccuccugaauuuaggaucaauaguuuauagcuguucucugcuaucuacaggcuaaaggcugaaacacacagucuucucacuuuugauagagacauuaacauaaaaugacauuacuggccgggcacgguggcucaugccuguaaucccagcacuuugggaggccgaggcgggcagaucacaagaucaagagaucgagaccauccuggccaacauggugaaaccccaucucuacuaaaaauacaaaaauuagcugggcgugguggcacacacccguagucccagcugcucuggaggcugaggcaggagaaucgcuugaacccaggaggcagagguugcagugagcugagaucgugccacugcacuccagccuggcgacagagugagacucugucucaaaaaaaaaaaaagaaacauuuuucuacuauuuaaaaaaaccuauagcacgugcaugacaaaauucugcuuuguagccaggaagcaacagggagugauaggaauuguggcaaaaagaaguacuugcaucuucucuaaagggggcagccagaacucugcucuagccaauuguugccaugcaggaaaguaggccagaguugccagaugauauaauuuuucaagacaaguuggguugcuagauuuuuuguuuuaauuucaugauuuuuuuuuuuaaauguuggcucugacuuuuuaaaaauacucuggugaaaacaacuguuaacaaugcuugccccuggucagggaaacaguggcuggaggaaggggacuuacucuguacugaauacccuuuugaauuuugcgcccuguucaaauguauuugaacguauuacuuauuguaaaaaacaaauuaacuccccaaacacugcaggagccaaauacucagccuagauauggcuaguuugcagcucugaucuacaggauaaaguucauacuccuccuccacccaguagcuaaggccccgcggcugucugacgcuggccugccuucuuucccacuauauccacuuaugcgcccugcauuucagcugcauucucuugaacauuuuuuuuuuuuuuugccuuuuccuacuuuuggguccuugcuaugcuguuccuuuucccuauuugucuuuuaaggucuaguucaaauaccaccccccaucucaaucaucuaaucauaaugaacuacucuuucuuccagcuguccuauauaguaucuugggagaggaaaaaaagcauggauguucagagcauggacucaggagccaaauuccuuggguucacauccuggcucugccaauuauuuuaccauuuaaauaaccucagguagguuacuuagccucucugggcuucgguuuccuuaucucuguuguggugaggagucagugauuccaaaguguuuagaauaaugccuggcacauacuaaauacucaauaaaugauaguuaacuuuguguagcagacugccuguguuuccucauagagcugauguuauuuaauuuuguuuugugguauguucucuaacuagaccaggagccccagaggcuagggcucuggcugacucaccucucuguccucagugccuacaauggcccggcauagagcaggcauuugguaaagauuuggaguaaaaucauucucucucucucucucucacacacacacacacacacacauacacacacacguacacuuucugacuuuuuuucuggauuagaaaucucauuguggauuacgccuuuucuaggcuccauaaccucccagaaagaccaaguguuggaucuucacaugguaccuauugauuaacagaagaaacaaaagcguggaagagaaaaugcuucauuuuagauucauacaaguaauucacaaaaucuagguucacagcccaagcaauucuauuccauaccaucagccugccuuaggugacagacauugucauuuacuugggccuuagcaaacaauuacugaguguggacuccaucaggccuguguagguucugggcacacagagacaaaaaagaaugggucuggcuaaaaaaagaagagauguuggcagcucuuuagucaccaauauggucuuaagguguacuguuaaguuaaagaaaaaaaagugggcaaaaggaggcugggcacggugguucacaccuguaaucccagcaauuuuggggggcagaggccaguggaucacuugaagucaggaguuugagaccagccuggacaacauggugaaacccugucccuaccaaaaaaaaaaaaaaaauuagccaggcguaguggcacaugccuguagucccagcuacuugggaggcugaggugggagaauugcuugaacccaggaggcggagguugcagugagccaagauugugccacuacacuccagccugggcaacagagcgaggccccaaggaauauauuuacuuguuauuaguuacuuguuaugaauaagccaucugaaaggaucaacaagaaaccaaaacacaagcugcauuaggguaaacucuuguaccauuugaauuugaaccaugaaaaugucuuaccuagucaccaaauuaaaaaagauuuuauuuuuuuauuuuuuuuucuucccuaaggaugagguuuuaaaaaggugugguuuggacucagcaguucuacuuuuacguauugaaccuggagaaacacucacauaggugccccaacagacauaugcauggauguucccuauaaugcuauuuauggucauaaaauaaugagaaaucaccuaaauagacaugaguagagggaagcuaaacugugauacacccacaucuggaauacuaugccucagaaugaagaugacccuaauagaaggcauuagaaaguucuaagacagacaaauaaaaaaccaaaaacauaucauagaauaauauauaugauacaauuuguuuuuuaaaaaagacguauuucuauauauaccuaucuauguauauaaaugcacagagaaaggcuugaaagcauauaucacaaaccaguuacagagaagguagagugauuaugggguuuucaguaauagcucacugggcaaagugcuucacaugaaucauccuguaauucucuuaccaaaccagugagguagguccuauuauuaucccauuuuuacaccugaagaaacugcagcugagagcgguuaaguaauuugccuaagucacacuucaaaccccauauuuaaauuugauuacuccaggacacugccuuuuuauuuucuacuucuagagaucaauuuuaguuacuggaaaaaauaaggcaaaagagauauggucccugaugcaaaggagugacccucagccuggccggggccagacagugggccauggugaaugcuguggggaggagcuaggggcuuaccuccgaggaagugggcuccugugagguccucagcaauacucccucagccagggcccgguccacggccugccgugccagcuccucuagcugcuguuuauccugcaagaggcucccccaguugguggccaucccaacaccugcaaaagauggagagaagagaguugguaacagauggccugaagcccagcaaccaccgaaacuggcuggcggccacccccaacacagcaggacccugaccucuguuggaagggaacagcgugguauacaggagugaacacuggcugguucuagcucuuaacaacuuccaugugcacaaaauagaaagcuugacaaagcauuuccauugccacucucucuuuugauucccaacacaauggcauuauucucacaguaaggaagcagaggcuuggagaggugaaaugacuugcccgaggugaugacugguauagccuggacuugaacccaugucucuggacucccagccuaaaggcucuucauuggagaaagaagcacuaauaucagaugugacuggggcaaguuccuucccuucccagagcuacagauucccuaacugugaaacaagaagaaucggauagaucaguuuccaaaccuggcugaacauucuggggagcugggaaagaauacagauuccugggccccaucccagagacucugaugcaagaggccugaugggaaggagggguugaggcuuuguauuuuuuuuuuuuugauauggagucucacucagucgccuaggcuggaguucaguggcucgaucuuggcucacugcaaccuccgccuccuggguucaaguaauucucccgccucagccucccugaguagcugggauuacaggcacacaccaccacgccuggcuaauuuuuuguauuuuaguagagacgggguuucaccguguuagccaggaugaucuugaucuucugaccuugugauccacacgccucgaccucccaaaguacugggauuacaggcgugagccaucacacccagccgaggcuuuguauuuuuaacaaguuuuccugggauaggagucacugcaguacauuauuaauucccuucaagcuccaacaacucaugucagcagaucucaaauaaauuacaugggaagggggagggagcucuuuguggaauaccaugaaaugcgaauaaggugaacuccucccuuauacaaaccagaaggaaucuuaguagcaggaaaugacuacauuccauauauggacauuuaucaucaaagcaccaaaagacagaaaauauuuuugagaaaucacauuagcaagauggaaauugcugaaacccaaguguccaauguaauaggagaaguugucugauugguugcccagagacauacagagguguacaaacucacacccugauacucauucauuuuucagcaggccucaggaguuuaagaucuggguaaaaaucuggaaacacagucacuaauuuuguucugcccuguugccauuuaacagaacaugguugcccaacucagugguccccaggaagggaguuagagaauaauaggaaaccuccaucacauucagcucugucccccuguccccaugacagagccagugccaggccaauuaugaaagucugccagccucagcacaaugcuuugaaagaaugcgcaugugaucucaagaggguccugauaauaucccuguugagugagacauacaugagggcaaucauaguaaagaacaagguucaagucagacagacagacagaccuggguuugaguccauaauaauacgacuucucccuuucccuucuuuccuuccuuccuuuucccuuucccuuucccuucccuccuucuuuccuuccuuccuuccuucuuuuucuuucuuucucucucucucccucccucuuucuuucuuuuuuuuuuuuuuugacggagucuggcucugucgcccaggcuggagugcagccgcacgaucucggcucacugcaagcuccgccuccuggguucaugccauucuccugccucagccucccgaguagcugggacuacaggcaccugccaccaugcccggcuaauuuuuuguauuuuuaguagagacgggguuucaccguguuagccaggauggucucgaucucgugaucccccacucucggccucccaaagugcugggauuacaggcgugagccaccccgcccagccgacuucccuuucaaguaagauugcuguguggauuaaaagagaaaaaucagugugaaauuuaucagcaguguuugaagcucuauacaugagaccauuuuuuggcuguacucucuuuauagguaggaggagacuugucagaggucacacagaagccuaguggcagagccaggacaagaacccauuaccuugacauuagaguaaugaaacccuccaugagcccccaucguuccacaacucugaaauuccaacaucuguuugcuguugggcuuuuauuuaguuggcaaacacugauuugcauuuaaugccacucccuugacuagguacuggggauauggaggaggauaagacauaaagauaaucaccaugggccaggugugguggcucacucguguaaucccagcacuuugugaggccgaggcaggcggaucacccgaggucgggaguucgagaccagccucaccaacauggagaaaccccaucucuacuaaaaauacaaaauuagccgggccugguggcgcaugccuguaauccgagcuacuugggaggcugaggcaggagaauagcuugaacccaggagguggagguuguagugagccgagaucgugccauugcacuccagccugggcaacaagagcaaagcucugucaaaaaaaaaaaaaaagaaaaaaagaaagaaagaaaagaaaucagaugaaggugcuaagugggcccuuuguuuuucucauucuacagccucaacccucccuuggcuuuauuuauguuuugcugaugacauucaaaucuacaucuucacagcaauacuuuccuaccuucaaacuagaauauccaauuuuuuccugcgagucuccauacaaccagaauagaauuuguuguugucucccacaaaucugcuucuucucugaugaaccccacccagguacccaagccuugaguacuuguuuccuacaucucacucuccccaaauccuauggauuuugcugccuaaguauauaguacuuugaauuccuuuauuuaucuccauuuccagaguuuguagccuagccccggccacugucaucucuucccugggcgugaaacagauucagagucaggugucuucagugaccaggauauguuggccucugucccccuuccaggacuuggcacgugcugucuucucuuuggaacucucgccaccacuccugaucugggcucgcgauuucguuccggaagcugucccuguucuccgccccgggcuucuacauucuacagcccaucacuuuucccuguaccguaggaacaguguuugucuugaucacuucucuaccuaguaauuagccgcgcuuaguacuguauucauucaucacaugaaugaaugaagaaugaaugacagacgggucagaucaccgaaagccucaaaacgcccacaaggaaaucggucgcacuuuaucgccaggacuuaggccagugccuggaaaggccccgaggcaacgacacggucggcugcccaggcuggccccacuucacgggcccgcucgcuuccacccuggacaaaguuuggcccuaaucgcuccccguuguagcucuaacuggcuccagucucacuggccuacaugccccgacaccggcccgaucuaaaggcagaagauccggaaagucugggaucagugcgcgccagcccaacccccucacuagacacuaguugccccgcuccuacgaaggguuucagccacaaggucucccggccuccggaauuccaaucucuugccagaccccucccucacaucguuccucccgaggaaacgugacccaugccggccgccguggccgccccaaccuacuaguucgccuuuccuccgcgaacgguucucccggcccucgcgccgcuacccaggcucagggggcggggccuc

SEQ ID NO: 192925 - RNA, 135961 nt, Homo sapiens
uucccuucaacuuuguuuauugauguacugaacaugaaaaaguacaaagaauccaaacacaaaagaaaacauguacagccucuuaaauacucaacagaauauauuuucuauuccaacagaugugaauuaagucauacuguacaacuucaaauaaauaccagccuuacauuuuauuaagugcucugauaaaacacuguaaagugaagcacaauuugcaugcccucucaucaaugccuugguuugcuacaguaguauaggaaagaagcauguagcugcuguuuucccuugagggaaaccuuauuauuuuuuuuuaaguauauacauguauuuuauuuuuuaguguuuuucuuuuuuuaaacgcagaagguuaacucuggcaaucuaaaugcaccuaaggauaugagaaagugcuaagccaauugauuucugaauagcauugagugggucagcaugaaaacucgcuuauucacuuuagcacgcgccucacaguauauguacuguacuauacugaaaaauuuuauaacuacaauuuuaaauaauaaaaaauaaaacucaaagcaaccgcaaagauaauguacaacuauguuaugcauagcacauugccuguucuaaggggaagcaugugagcaucucaguuuauacaaaaagcaggacguaacuauauaguucucagugcauccugaugaaggcauuuuugccuucagcuuuuuugaaaauuuauuauaagcuagaugcuaaucagaaaauauuuuguauuuuuuaaaauuucuuucauacaugguaaagacuuauuuuauuauuuccccaaauagugguuuuuaagcaucauacaaaguuaaauuucaauagcauacagauauuuaugauuuuuguaugaaaaauguaaggaaauuuguucaaaaccuaugguuauacucauuuuuuuauaccacaaacauauuuauaaaccaaaauguagcaucaccauaaacagcugaagcuagacuaucuacagacaaaauuugcaacaaaucugaugcacuguaaauucaaguccucaggacaacaaaagugauuaagcaagaccucaaguaacaauguuaaugccauuuacaaaggaaaaaacugauacaaaaacauucaaaaccugaacaucacuuggcauguaagggaaaaaaaauuaaauuagcugaaagguucauaaacacaaggucuuauuuacauuacacaaagcucagguguuagccuugaacguaacuuucaaaauaccuucaaauauauccaacucagaucacuuuugcugauuugcugcaguacaaaucaugugcaacgucuuuuuuccuuaagacaaaacaauucuucaaacaauacugcaaguacaucacuaaacaccaugagcucuaucugaagggauuucuuuaggaagaacagauuuuuucccccaucucucgguaauuuaaauuucuugccugcucuuauauauucuuuuguaaauuuuuuuuauuuguuucaaaaucacaaaucaaugugagccaccuaucacauaauaaccaggaugaucagacgcuccacuggugauuacaaaaaugaaaccagcaguguuuccccccauugauucuacuccuuucauacaaagaucucaaaaguauuuucuacaccauaaaucuuucuaaauuuuccaaccgcugcaaauuuccugguaaauuuuaaaagcucacuaggugucauaugaagagauuucucaaaguauucaagucaaaauauuuguuccaggaccaguaaaaaguuucuccaaauuuucuuuuuuauaaaaauagaugcuuuuuuuaaacccacaucaaagaggcucuuaucucuuuggcaagguacugcuuuacgaaaaguucuccaguauucuuacaauaagcguuuauaauguagcccccccuuccccaacccaaaucauaauuacaaaauaaauacuguuuuaaacuucauaaauaaaaauguaaacuucaaaauacuuuucuuaaacagacauaacagcaaugcuuuaaauguaaaccaaacacaaagcuaaucagaaaaaggaaaaaaaggggggaaaaaaaagacacaaccaacugaagaauuacaacacaaagccucaauauuuacucacagguucaaggcaguuauguaaaaagaaaagaaaugucuucccuuagcugaaacacuuuaaaagguccaccuucuucaaagaaggcaauagaaugcaaugugacagguaaaaacccuguaccucuuguccauauucaaacauaaaagauauuuaagaaguuuuaauucaaauacuagcaauaaaaaaucucacauauuucuuaggaugcuaaguagucauuuuauccccaucucaacacugacuuacaaagacauuuacuaauguauaaaguuucucuuaacuugccuuuguuguauaguuuucauauauaaauggacugaggacaagagcucauuaggcuuugugcguuuuguuugucuuaaaggagaccugcaguacucugucucccagacgguauccauugaggcuagcuaucgccauggcagccucaucauaguuugucauagucacaaauccaaaaccuuugcauuuauugguguuaaagucacggaugaccuucacauuggugacagcuccaaaaggcccaaacauuugccacaggauacucucaucugcgucaggagccagguuguacacaaauauacaccacccuguuccagggugcccagggauauuaauuccagccaaacuggucauuccgucaauggucauuggagaaaaccugcuaaacagaauaggaaauacacacauacacacaaaaaauaaaaacagagguugguuauagcaaugaacguauaccuuuuccauccccaagaauuuuaguaacucuccucccccaacaaauauauaaacuauuucauguuuugaccaaggucuguguguggcuuugcagugacaugcuagacuacugagauauuaauaaguuaugaaaugaccauuauucacuguacugaauaucauccacaauagcaaagaaauauauuuagaacuggcuucaugaauuaagcaggauuggcaggggaagggaucaacacauacguaaacaugcuguaacgucguaacgcaauacgaaacaaaugauggguuuuuaaaagaccagguggcauccggugguauaaaaauuucuugagucaauugugcuucaaagagcagcuuuucauuagguugcacaugcaaaauaaaacccaacaaaaacuuaugaggggugugaauagcacucccaaaaucaaagaaaccaaucaacuguggaaagggauuaugaguaucaugaaccucuaucauuaccucuuuacuccauaagccauauugagcagauuguccaaccugcaaaacacacauuuagcaaacuucaguuuuuaauuuuuccccuugauguucaagaaaguugggcucauuacugccaucuuccgaggggauaucuguacacugauuauaugugaagacucagaaugcugggucuuuuuacguuuuuaagcuaaugggcaccgacugccacaggacaguucuuccaaugaaugguuucucucuacaagggucaguacaugggacacagugacggucaucugaggauaccuuucagagaggaagugcgaaagcucugggauaguuaacuuuaggguucucaucagguagcuucaaagugaucaauguauagcuacauguucuuuauacuacuuuugauuuucacaacucuguuggugccugcagauaccuaaggcacacaggguuuaaguggcuugcucaagaccacagggcuaguaaauuauggcauugauacucaaacucugcagguuacagaauucuauacauuuuccuuucauuucccaacuuugaagggcuuucaucuuuuagaaucaaggagguauaauuacagguagaaaaaaccuuauggacaacccaagcuaacccucccauuucucaaaugugcucagcugaggucuagagaaggaaaaaagaaaaauccaucacuccagugugcaacaaagccaagaguucagauccugaucuggaugcuguauucaaauuacgcuacaggaagugucguccuacucaguuuucaaaggccagguaggaaacaaaacaagccaaucugagccucacuuaaaauguuuauagaaaguaaauagggguggggguggagguguaaguacucuuuaaaaccuucuacauuuuuccuauaucaaauauuaguuuuacagcauuugacucuucuuuaucaguuucaaaacaccacucuaaugucccaaauuuccacagugcuuaccaacuaauuauguguucugaggaggaggcauaacuuaauacauaguccacaaccacccucaacugcuacaaugcucaacacucuccaaagacaucccaggguugucccucugggacugggggugggggugagaauuuuuucuuuaacacccgugaaagguaaguuugaaaagucucagccuuaucaccuaaccuguggcaucaagucacgcuaaaguauacaugcaaaagccaacaccuuuuaguuuuguaaaagccaaaacacaucucaucuggucuuucagaauggggaaauauauagccucccacaucccugcccucagucuccacugaaaauucuguuuuguaaagaugagaagaacugagcuuaugcaaaguguaaggaaacagaacagaucacaaugacaaaagaucuucgugugugagugugucucugugugcguggugcgugugugugugugcgugccuugacccaccacccucucauugcaccacugagcacaagccagggucacugauaguuuauaauaaauaugugaugaccaaauaaagacaaugagguuaccaaaauuauggucaacuuaguccagaaugaaaacuaguaagaggauugguuggaugaccuugucugcacauaaguaaaaagaugugggguuuuauuuuuugcagaggugaguacagucaaagaugccaugccuuuauagucaagaauaaggaucacaacuaccagcaauaaagacaaacacauauuagcaccaccaaucauaaaguaacaauacaauuuuaucaaauugcuggaaugaucaacacagaaugcauuuggcauaugcuaccuguagaagagaaccgcauacugaggucuccaaccaaagugcuagaagacccagaaugcagaggcaccuuaucaauucacucaaaaguuacaucaucuaugcccauuaauugcauccauguagggacaggucaugcuuugcuaccacccacucaggacaccaagcauacggcccagagacagaugaguuuucagaauuuucaaacaggguagaaaccaaaucugccccugaagugaauuaccgucaggccuuuuuuaacaauggggauauguucugaaaaugugucacuaggugaucucguuguuguacgaucauagaaugcacuuauacaaaccuagaugguaauagccuaccacacaccuaguuauaugguaugggcuauggcucccagucuacaaaccuguauaacaugucacuguacugaauacuguagguaauucuaacacaaugcuaaguauuguguauuuaaccauaucuaaacauagaaaagguaaugcauugcacaauauuaggaugacuaugauaucacuagacaauaggaauuuuuugcagucuacuauauuaugguaccacggucguacaugugauuaacugaaacguuaugugaugcaugacuguacaugcagugagggagaaacauuucguuuuccauccuccaucucccucacuuccaucucuggcauccccagacaggagguuucgaauuuuuuauaacaggaucuccgaggacccuccaaauuaugauagggcaucuuuuuuacccuaucugugaaguuuuacaugauaccaugaucuucacugauuccuucacuucucucucauuuuagaaaaaaauugguccuuuggaacuaagccaaguuauccacucuaaucuuucuucuccuccaucaccaacgaguguagggagaagcauggaaccuagaaaacagugcccaggcacugcugaagcccccugacuguaugcaucugagcccagaaguauuuccuagcuuucucggugccauagauucauguuucccaugggagcucagaaaaggcaacgggugcucuacaugggcaccauucacuccaaauccaguagcaguuggcaaacuguaacacaggcaguuguaagagaaaauagugcagcagcucaaacacaaggacuacuacaacaagccccuagaaauaugucugcugggucuguccacugcucaaggacaucuuuuuauuuuauuuauuuauuuuugagacgaagucucgcucugucacccaggcuggagugcaguggcgugaucucggcucacugcaaacucugccucccggguucacaccauucucuggccccagccucucgaguagcugggacuacaggcacccaaccaccacguccggcuaauuuuuuuuguauuuuuaguagagacgggguuucaccauuuagccaugauggucucgaucuccugaccucgugauccacccgccuuggccucccaaagugcugggauuacaggagugagccaccacgcccagccaucuuuuauuuauggucauuuauaaauggaagucaauuuuuaaauggagagcaagcuagcugccuccagaauaucucagggagggguguggaugauaacguaguacauauggaagguaaauauuaaaguauccauuaaauauauauuuaaaauaaaauauaaaauaaauauguauuuaaaauaaaguauuuuuuacuuauauuuaauagaugcacugaacccaguaccuucucaguccuguguaucaccugccucccugggggaagacugagcaaucaucgaaggggagaggcggcgaguggcacucucuccugcucuuuagccugaacaaaauccauuuuacaaauaacacagcaagcagauauggaggauuagacuggauaaccugcuuuaauuaaaaugaccuccauuuaaagaaaaaguaacuuaaaaaaagauuacuacaaauguaaaucagaguaaagaaugguaccaguaagggaaauacaaguaaauaaggaaagggagagccgauuauuucuccuacucuuaguacaagcuacauuauaagguuagacacaagauaauccaacaugcaucacaugaagucagaugagauaucugaaauuauuuuauggucuugcuuuaaaagacauuuauuaagauauuagguacauggaaaaugaagccaaccaguauaguaauuagcaagacauuuaauacagauugucucaucuuuauccuuuuuuauguuugauuagaguuuauaauuuaaugaauagcacacgcccauguacauauguaauuuaugaaaaaggcacauaggagagagauguguauaaacauuuuucuaucaacaggaccaaagcuccaauuauaaccugucaaaauuuugaacagaaccauguaucagaucauuccuauuuuaaagcuagguguucauaaguagaaaauaaaaauaaaguaccugccuaauuucuaaaaaaauuagcugauggacuaugggaaggccuacauguaaguaaggggaaaugugaacccgauuaaagucagaaauaaaaauaggaagauaaguuauugauggguaagaaaauauacucggaaucccacaaauaaugauuaucaaaaucucuccaaagcgccaaccgagaacugcuuggaaauuaucuacaacaagaucaucuucuuacugccuuacugccuuauucaauuagaugguaucaucuguccucuaagaaagaggaaaaguauucaaggggauugauaccgguuucuuccaaaaggaaauugugauaaugcaaccaguacgucaugccuuaaaggcaacucaagugcucauuuaaaaggcuuuuuaaaaaaugcauaaaggcucauagaagcaggcacacaggucauuacacuagaucauauucaauaaaauuauagcuguuucacagaaaagaacaugaaaaaauuuggcuuaaaguuuaauucugauaucaugucccaagaauauacuuaaggggcuugaauuacaccauccauccaaauaaauaaggcuuguccuauuuugaaaacugcagucaauuaaauaagcguauuagaccagcagugcucauauuacaacaauucucugauuauucauagauugacuaagccauaaaccucacaaacccaccuuuaaacuuaacccuuauuacauggauuuuuaagcuuuuugaccauaaaagauauggcucauacuuuaugauuauuaaaaguauucuugaccauaauacauauaacuuauauugcucaaucucucucaacucccaagguacuaugagaacauaaaaauacagugagaaauuuucuacaugucugcugaaaggugacaaaaacucaaggcaagagcauuaaaacacaaauaucagggacaaaauauaucugugugaugauuuagacucgaacuacagaaaacagcaaaauaccaacaaaacaagcaagcccuuaauucaaguuucuuuaucaggugaaagaagaagggggaguggggcggaaaucaagauaaugacaaccagguucaauauacuguauuaaagaaaagcaucaaacaucagguuaaaccugaaaucugauuucuuccaacacacccaaucuagaucaaacacuaucucugagcacacuaacucguucauauuuuauuaucuggacagggaucaugggaggaaugagaaauggggugaaugggacaacaguuaaaaaucugaagagagaauaacaauuucucccauuuucugaaaccaaguuucccuuacaacugacaaucucuuauucucuucuuccaaaaugucuuucuauaggagugaaggaaaaagaauuuucaaguuaaugauaacauaugguacuaaaagauaaaaacacagaaugggccagaaaaagauaauuaaauuugaccauaagaacauccuguaaagcuuuacucaaccaaaaauaaaaagcacagagccugcagggauggaggcuagguaaaccuaagggcugacacccaucaacaaccuagcaccugagucaccuacaagccuugccauuucaauaaucaggcacucucccaaauccugucuucucaaucuuccuaagaauucaaucuugauuccaagaacuuuguuuuacuuaauaacuaucaaacaaaaucauugcuucaaucuggaaaaaaaaaguagcuaauauagcuuuccacuaacagcaaacauuuuauaacuucacaauguuaaaaaucaaccaauacauuaugaagaacuuuguucuaucuaaacucgagaucauuuucaaggccccaaagagcucugaaauuaacuggacaagcugccuaggaaauaccuguaaaauuccuucaggcuuguucauccuacguuugcaauuuaaaaaaguauauuuauacauauauuauucacuuaagaugucacagaggaaaccuaugugcagagcugaaaaagggcuuucuuugugagacuucuuucuccacaaaggcaagcaucaggcagccccacgcaucucccacacuagucugaucaccacuaccaugggaagucaaagguggcaaagguuuuuuuuuuuuuuuuuuuuuuuuuuuuuuuuuuuuuuuuaauaccaaugccuuuuccucacagcagagcaugaaguacaaggcucaaugcuuuugacaguaccaccucuucucccacggcaaaggccaacuuaaguugaaauuuaauguggcauucauaacaaauuuccuucucauaucucaagcaacauaauuuaguauuuuuuuaaaaggagcuauuuuuaacugauuuuaucuccacucucuucagcacugcaaauauuccaaugaaaaaaauaaaugcauagauuuaagcuagaaaacauaacuccugaucuuauuagguuauauuugugauuauauuuuugguaauuaacuauucugucccaugaaugaaauaaauaaaauugauaugcacuuggaaauaauuuuuaaaaaucagugugggguuagauagcauucuggguauaguguaccauauggccaaaaaggauauuuaaaaauguccuggaaaauaaaaacugcaugacuugcuuaugaaaccaaaaacucucugcucugcuuaacuucuuaaagucacuguucuucucacaugcagauuagagauuuuuugaaugacuccugguuuguuaucccaggaucagaauaaaacuuaaacaguuagcauauguacaccugucagugagauagagugucuucuuugggcuaaagccacggucauucuaugaacuacagagaggucaguaaauuacaaccgacaggccaaauggagacugccucccaccuguugcuguaugggcuauaagcuaagaauggcuuuuacauuuuuaacagguuguuuaaaaacaaaaacaagacagaugcaacagugaccauaacccauaaaguuaaauauuuacuaucugguacuguacagagaaagucugccaaccuguuuguaaacaauuuugaaaaggaagagaggaacucauuuguagaaacuucacguagucacauagguuauauacccuuaauggugcacauacuauaaagugaaguaacagaaacagcuugaccuaaaaauugacacaugagaauaaaauccuuuaagaaaaaaaaaaaaggaaaucugaagcccuggaaacaauucagauaaccccagaaagcuacagauuagaauuucucaaccacagcauuauuggugcuuuggaccagguaacuucugguugcuggggcuaugcuguacacuguaggagcuuagcagcauccccgaccucuagcauuacaugcuaguagcacccccacagguugugccaacaugaauaccucuagacauugccaaauguucccugggaggcaaaaaucacccuugguuaagaaucacugcuguagguuacuguccuuugguccccaccuucaauauuagcaaaagacacuauuccucaaguagauucucucugugcccauggagaugaaaaauuaauaguaauaaaaccaacaacacugacaaaagcaaaccagagauccugucaauaaaaguacuggacaguaaaccugaguauucucuuucaguuuaguagcugggcacaagaaccaaaccagacuuaccuaaaacgcugugccugcugagcuagcgguccuggauaccuucuguuuggagacugguacagcugggaaaggauggccugauugguuuuuuggcuuggguuauuagcaaacuuuacagugauuggcuccguggcaccgggagguuucuggccauuuaggccuuugauagcuucuucugccucaauucgcuugucaaaucgaauaaacccuacaccccuugauaugccuaugguagauuugaguaaagauuuggaaaagagggaacagaaggagaagggaaggagagaagaaaggacacauuaauuuuuccuucucaagaacauguuuucaccuacauauaacauuucccacaaaaucacaccaggaggaaacuuuccccuuuacuuacuagccauucaguuuagaaucacaauuuugcauuuuuagaaaaauucgugucacuuacauaaucugaguacccauuaucacaugcauuccaaucagcuaagacaagaaaacacaagcauguccauguuuucucucucucccaccucccucccguacacucuuuuaaugucaauaguguaccggaguuccauuuuucaauuugugcuauuggauaagcagcucagaaaugagggacacaguaguuccuguccuugaaacaaggagaacagaaagaagaauuugcuaaaaaugcuacaaagcuaugcuaaaaauacauacacugugguagaaagacauuucgguugaaauuuuaaauaauauauucagcuuaauaauauugcauaggauauagguccuuuaggaaaaaaaugccugaaaaugcucuuccaguucucugaagcucucuugugcuucugacuagcuauauuuuauuacagaaaaauauuauauggagaaaaagaaaagacguagauuuuaaaaauaaauaaauuucuagaaguaaagcaucaaagcuuucugaccucagcagcaucacuccugacuacagaagaucacucccugccccacauucuccccagugugaaagacacaaaugggaaaggauagccaagaaccuuuccagguuaugaaaaauuguagagggaaacccagcuuauuccauuuaauuagcgugaacaggcuaguggggugaccacagcuggucaucaugagauaagcaguggcagggaaauuuuuuuuggcaaguaaaugagcacuggaccaucauacuuggaggagcuuaaaaaaaaaaaaagaaagaaggucuacuugcuuuaaaauuaauacuguguaaggucaaugacuaagaauuuucuaauguagacaaagcauuuuuuccacauaugcguaucuaagacagccccuaucacuuuaccuuuucuauuuaaagagcaugcauugcacauuauuaccaccugauggcugaauaagaaaauugcaggguuucauuuuucauuucagguaaauugaguaaguucacuuugaaagccuuaaguaugaagaauaaauagugaaaugauagcaaauccuuucacuuaucuacuagcgccuauuaagaauuaauaaccucuagaauuuagcuguuccauuagaaaagcaucagauuagcaaaaaaaaaaaaaaaaaaaaaaaaaaaaaacagccucuacacagcuagagucaccuaaaucggugguccuccuacuuaagcauaccuaagaacaaccuguggcucacccucagagauuuauucaguagguucugaaugaagcccaauaauuugcauuuuuagcaggguuccagaagacugcugauacugcaggugcgggacauacuugagaaccgcugacuaaaacaagcuagguccaccugugauggacuagcagguaaaagaugagacgcacuuugugucauaggugaaaccuacucucaauucacaagaucucagaaugaaugaauuagaaagcacaaaugaaauaaaaaauauuuuuguugcuuugaacaaauucaucuuuauuucuaggccuggauuucuauuuaacaccauuauuagucuaugugauaacaacacaggguggcaauguauaaguauuaugaauuaacuaacacaauuaaggaggcuguauuuuauauacucucacuugacuaaauagucucaugacagcaaaaucuguaggcuauucucccaggcaugcauguagugcuagcucucucuacucagaacucuaaagguggugcuuccuaugaagccaauuaacaacacagaggcagguaauaugggcuccucugauuagauucagaucaacuaaauggaucuucacuugaugaaugaaaaaucuggcucaauuuucuucugaagucacugcuuuaaaagaauuagacauuguaauauacaacaugccuccaagguauuauuauuauacggguggcggggagagaaacaaacagugaggagaaaagcuaccuuaaaaaaacaaacaaaaacaaccucacaaaucuucauguggcugcuucagucuaugguacuacagcuaauauuuccuccucacaauguuucucuauuuuuuaacuguuuccuaaagaacaaguauugcuuucauuuuauuuuuuacuuauuuuuugaaauggaguuuugcucuuguugcccauugcccaggcuggagugcaauggcaugaucucagcucaccgugaccuccgccucugggguucaagugauucuccugccucagccuccugaguaccugggauuacaggcaugcgccaucacacccagcuaauuuuguauuuuuaguagagauggggcuucucuauguuggucacgcuggucuugaacucccagccucaggugauccgcccuccuuggccucccaaagugcuuggauuauaggcaugagccacugugccuggccaaguauugcuuuuauaauagaaaauuguaucuguauuuuauuuuuaaaauucauaaucaaaucuauauugcuauagcuuuguuaacuaagauuuggcagaacaacucccuuacauucaagaguuuuaaugaacauuuuagucuucccauuucaguugggcuaacagugauauuaggaauaaaauaaauuuuuaacauucaaaauuucaaacucuuacauaugcccauacagcacagcaugaaccuggaaaacagccugaacagcaauuaccaguguggauguaguguaauccucccuuggagaacuagcugcauaccgcugcauuaaacuucgcuuuuugacaaaagaaagguuguuuauuaguacucuauaagcaggaugggggcuuuuaucacacaguggcuuggaaaugaagauuauagcaucuauaaauuuauuacaagccaugaaacaggcuucaauccugcaccuucaggguggaaaugacucaagcacgcucacuauacuccacaaucuauuuuuauccaugcauauuuaugaacaauuccagcagaaaauugcauuuucuggcccacauauaccuuugauauguucuagaagcaagacugcuacauggaaagacagaauauuucacaaucugcuagucagagacagggaaagacuguccggaguggcugucuacuuaccagugaccuggucgacaagaauacgagaaguaauaaugcguccauauugugaaaaaagcuguuccaacuccuucugggucauuguuuuuggaaguccgcugacauauaaauuugcaucucugauagaagcugaacuugggcgagcauaggaaaccuggaaaaggaaaauaaaauuaaauguauaugcaugcucacucacccaccucccuuuagaaacucaaaaacugccucgguaacuuucccaugaacagcauagaacacugaaguucaagcaagucaggugcuaacugcuuuauucauuuccaggaaaauucuagacaaauggguaguaguauucccauucccucuccccuagguggacagggaagaguaucuguaauaugcuggacuagccuacugcaagggacagaaauuucacaauauaucccauccuccagauuauuacuaaaaauggucaaugggucugggaucaauuugcggagguauagugauucaacaacugccugcucauuuuaucauuuguacccaccuuuaguccaguuuuaauucacuaaaauuuaaaguucuuaaaacagaccaguggugcauacagcacaguacuguucacaauaauaggcugucuucuguggggccaauccccuagagcagugguccccaaccuuuuugguaccagggacugguuuuguggaagacaauuuuuccauggaccauggugggggaugcauuagauucucauaaaaacugcacaaucuagauuccuugcaugugcaguucaaaauaggguuugugcccugaugagaaucuaaugcugcagcuaaucggacaggagguggagcuugggcaauaaugcuggcucaccugcugcucaccucuggcugugugcacugguuccuaacaggccacggacugguauggguccauggccagggguugggaacaccugcucuagaauagggauuuaggcccaaucauucuaagcuuaaagauuccaaauucauggaacauuuuuguuuucuagccucucacaucugugugggugguagugcuacauuucuaaaaaaaaauucacccuuaucaguaaguaugcucuuuugauauaugcuguaugauuguccauaaauucccagaaauuugaaugugugaacaagcccucauuauccuuugucuguugucuucucauccacaggucuuuuuaaccuugauuuucaaaaggucuuaagucccuauaauuaacuuugccugccacuguauguacuuucaaaaaguuucaugucuuugagauacgguauaccaaaucccacaaggacgaaagacaaaauaggucugcauguauuuguuuauaaucaucauuccucauguaaacucugugagggaagaaaccacaucauucuuggucaucacuguauccucaaugccuagugagugccugacaugugauagaugcuaacacauuuggugaguaaagcccauccaauaauaccccauugaucaugcagauccacaacggcuuacugaaccagagcauuuaagggucaguucaagucauccagaucuccugccccaauuguaauugaugacucucugccuauaaccuaucuuugccaacauuuagucucaugagcuauuccugaucgcauucccuuugguuuagcuguaauauucuggacuagccuacuucaagggacagaaauuucacaauauacgccauccucagauuauuacuaaaaauggucaaugugucugggauugauuugcugagguaaagugauaacuacugccugcucauuuuauuauugguacccaccuuuaauccaguuaacaacaaacuuucccaauuuacacuaauacuuaaauaacuuuuaguaugaagcaccaaacauuuuccccauaauuugaauugugcccacagcucucuguugccacuuuuucuuggcuuuccagaaaaaaauauaagccacauuuuauacuacuuuauaaagaccucguuaucuuucacaccccugccccaaugguguuaacauuuaauacucuucuuuauucaaaccguuugcucauuaacaagugaaaauauaccuguuguuccaaaggcuauguuuggaaguuauauuagcacuguccuguucuacagaagaaacaaggaauuuggaauagugguggagaaaacauacauaacuauucauacgcuauuuguuuucucuaugccuaaauacuuaagaacaaugaagacuggggaacuuaaauguaagugaagaacaaguggccaauuucaagugauuaauguaacuuagauggaaucaaaucuugggauugcuauaaacugaugaaacaaggccaaugaauuauauaugcauucaguaauaugaaucaaugaaaacuuaauuucuuuucucguguaagauucucaauuauccagaaaaggugaaaccucaccagcugggacgugcaucccuaucuaggauucuauggcuuuuuuuuccacaggagggagcacccaacaagucagcuguuacucuguuccagaucaugugacugaaguacucccauuaugaacagccaugucccaugggcuccagggcaggcaucuacacauucuccaaggaggcuaacuuccaaugacugaucaagcaaccagcagcaggugacaggcucugcaugagaucaagugucacaggaggcaguggaaaugugguuaaagguaacagcuaaucggugugccugggcucaaaacuagguuuaauucauaaccaguucugugaacuuagaacuaaguucuucaagccuauuaccacaauucuaccuucuuuauauggcuauuaggaauaauuaaauaauuucuaauccacaugaaaagcuucagagccuaaucuaugugacauuauaaauauuauuuaccucuacaugcaucugaaaauuuagguaaaugcccagccccuuaaaguagagagaaaccuggguccauuacaguguucuagaacaauuuacucaugcagugacauucacugcuuugugcaauucagaugaguguagguggugugucuuaaaagucauccuaaaauauauuuaggaaaauggguuuauauuuaaugcuuauauaaaggcuuugaaaacauaccuaggucaguuaugugauuuuuuuuuuccccaauguccacucuucaguuuauauuguaucuuuaguucccagccacauuaaaaaggcuccaagacaaaccuucucaaaaacaguaucuuucagugacauugucaaagaaccauuuuccacuaccacaggcaggacaggagugauuagauuauauauaaacuuacgucgguaacaauguuuaauguuaaacuuacauuuagggcauuaugagacuucaccauuuacaaggcauuuucacaaacuacaauauuuugucugugccucacaacaaccccaugagguaggcagcauacauauuaguauuuuauagcuggggaaacaggcacagacaagguaaauaacaugccuaagguuauacacaacuaguguugaauucuggguucaaacucugaucuuucucuuucuguguccuggucuccucauccaguuuuccuucaauaauacuaugguaagugaguguuucaguucacuuguucugaguugggaaaaauuaaaugaauccuggcuguuucuuaaaggcauacacagagaaacuggccacagacagaaaacaggauguugcuagaaauuaguuaaaaguuauuccacuuuuuauuauuuugagacggagucucacucuguugcucaggcuggagugcagugggugaucucggcucacuguaaccucugccucccggguucaagcuauucuccugccucagccuuccaaguagcugggauuacaggcauguaccaccacacuggcuuuuuuuguauuuuuuagagacaggguuucaccauguuggucagccuggucucgaaugccugaccucaggugaucagcccaccucggccucccaaagugcugggauuacaggcaugagccaccacgcccggcuccauuaauauuuuuaagaguaauuuuuucuaagaaaagagaaguggccacuaauuacaauuaaccaaagaaacuacacaucaucauuagaauuuuuaaauuaauuuuuguuacuuucuaauucucaggaguaagcaaugccauuuucguucacuuucaggaaauaaagguguaagaaaggguaauugccuucuccuuccucccagaccaaggcucaagguccuaccccuaucccuuuauuuacuguucuuggaauuaaaacagcuuccuuucccuuccacuaucaaggauaucgcugucaucaaaauccucccuuccuggaaaacauuucuucuuucaucuaaaaagauuauaaauagaaaauguauuuagaccuaagugggaagaaggcugauagugggauaaggacucacacucuggagaucaguuaccuaaggacucacacucuggagaucaaaucaguuaccaaacuaaauuuuguaucugaccauuaccagcaaccuucuccauuccgauuuuuuuuuuuuccuguggauuuagaucuuacaggugccuucauaugcaccuacagaaucauacaggggcuauuuucagaaaguguuaaguaucuuuuugguucuacaagacuaaacucccuugaaggcccaaaagaguucgcuuuaaaugacaaauucuauuuagaaaugcuucaaaacaauggacuuccagcauauguccuacugaggucaaaauagccucuuucuccacugcaaucuguucuccauuuuccauuugcuggauuaauauaugaguuuggauuuuaaauuuucacugccacuuaaacaggugaauauuuaaugcaugagaagcaagguuaugaaaugucaaaacuacuaagugaaggaucuaauuuaagaggcagccagagagucugcaauuuaaauauuuaaagaugauacagggaguacaacacugaacaccaaucuacuccaaagauagcaauuuaaaacucagguuuauucuggaauuucucacaaaagcuacgagugauauaauaaacaaagacaagcaauacugagauuauaugagggaaggggagggacggggaggcaguaaguacuugcuacuacagguaaguaaauggcccauggcuucucaaacuguucuucacaaacaagacuagacuagacaaaauaaagauagaauauauuuauugaauuaugucuugaaaauggaaccguuugaaauauaguguauuacuuguaauuaaaagcucauuucuucaucagcagcuaaaacuaaugauacauuaaacauacaaagaugaguaacacauacacuaagagugggcuaucaaacacaaguugaucaaaauuauacaaagaaacaaaaccaucuuaugaauuaguacuuuauuaaauguacauagcaauguuuaaaaucccagugcaucacuaucagaagucccucuaaaugcuuucguccaaacacacaacugcucucguuucucugauucaucaauggaaagaucagugacaguggacauuaauaccaauagauuaaagugauaaggucuauaaaugaacaaagaaguucccucuuuuuuaaacuaaaaacauuugagaagucacccacugcuaagaucaccacugaacaacuuuuaucacuugucaauuacugacccaggacuacaaacauuaaaccugaaaauuagacacuugccacuuuagacuuuuuucaaaaagcuccuuucaaucucuccagcugaaaggucacaguuaugccuauuuaaacggacaguuaauugcuguucauauuuuuuaaagauggagucuucgugggacuaucugaaaaaugacacuauaacucaauaaaaguuagcucuaggcucuaaguaagcaguagcaaaggucuugugacagcaucauggauauuuggacagguggcuacaucggaccuuccaaaaugagcucagaaguauaguacacagaagaagggggaucucuaaccacaacucaggccagagaccucaaaauucacccaaaaggaagauguguacuuugaucugcuucuaaauucaaacuccuaccaggaacaagucucaaacacacaucaaggcauacauguaucacaguccaauauuaaguuuucaauaaggaagggcauauuucacaauggguugaaaaugaauaagccuaagauaacaauaagaaauuaaguauuagcuccagcaaaguuagagcuaaaagaaauaaucacauccaaacaggaaauuuuauaaaagguauuaaagguuagggcaguuaucuuuaacggauauuccaaaauauaggauuuagaaaacuaucaguggaaaauacacacagaaccuuaaauuuuaucgugacuggauuuguugaauguuuuaagacuaaacaauugcuuuaauucaagugagaaguucagagauaccacggaauauauuugauaaugucauccucaacuuaaauuaccuaaagggcucccuaagacuuucagauaaauuuuagaauucuuauuccuuuauggucagagcacuggcuaccucuuccauacaaguauacaaaaccuucgguaguauuccaagcuuccugcucucacuucucuguguuaaaaauaagcugcccuccuuccaaucagcuaaauuucagucauuucagacaccucauggguaucaccuagucccuaaagucaacacuaaucaguccucuccacuacagucugaguugggugccucuuaccugcacccacacugcauuauaugccuuguuuucuuaaauacugacuuaaccaaaauguacuuaucucuuaacccuuucuugugacugacuuaaccccuugaaauaagaaaccuugucaucauccuacuuuguacauccugguaacuaccacacacucacuguaaugaagaugauuuauaaucacauauuaaauugagaguuuauuucugaaauacuguuuaaaagcuaacagaagccacaaucuuugucauauacccaacauuauacgcauugguacuuuguguacagacuacaaugaaaauucuauuaaucauuucaaaaaugaaauuucauuucucaaauuggggauucaaguccccagaggcgacacaaucuucaacaaaguaauauggugcugauaggaggcuguggggcggggggagucuuaauuuuggagcaaaaagaaaauacagugaucauuuaguccaauuucuuuguaucugggaaauaggaagacugaggcacagaaaggugaagcaacuuuuccaaagacacaaagaaaaagaguuggguguaggacucgcggucuuagcucuucaucacgggauuuuccauuacaucauuagcugcaacacagucuucaaaaucauaaaaucuuccugugaaaugacagugacugggacaauaaucagacauuuccaaggagacaucagaagagcuauuccuagaaaauaagaaccuuagcuuugcuacauagaauauuuucuuguauacacauaaggaaauaauaaaacacaucaaaaaaacugucuuaggacaguuauuauaauucuucuacuaguaaugccugagaauuauuuaggagauguuggagaaaaaaaucuaauuauuugggaguugaagagaaaaaucaaacuaagaauccugagacuaguacuuuccaccaauuaaaacguaccaaccuacaauagcuagaaucuuuuugauagugucucucccuuuuauaagauuacaaaccaauuaacaggaaaacagaauggcaacuggcuguuuacacuaggggagauucucauuuucauagaauuuucaaguuuuagugcaacaucauuaaauauuagucaaggcaguugaucuuagcuucaacuuaaaggcgaccuaggaauaaauaaguaaugucauaaaaauaagugauccuaugacauuguuaaagacaauaauaaaucuacugaauagccacagaaaaauaaaaaguguuuuggcuguaagaacuguauaucaagcaacugaucaucaacuacagacuucacaaauuagaccaccuuuuucacacaucuuaaacagccucugacaaacuacacugcacugagugugguuuauuaaaugcuacccaaacaguugcauccauguguaucaaagagggucuaaauaggcugcccugacaggcaucucguuuuuaguaaaguacaacugguacauaacuucugcccuuuuauuguuguuucuccuugguucuaguaugaaguugguucaacaaggacaucucauacugguaaaggcaaaugggauacaugguaaagauauucuugaaaugcaacuuaggccauaaauaccuuaccauuucuuaaauuuuuuaccugcagagauacuuaacagaaaauaaaacaauugagcaaugguaguggauauggcaucugagguggaggcagugaaaucaaauucacuaugguaguggcaguaggcuagccauuccaagucuaagcaggaacuugucaaucaaaauguuccauguuccauuuccaauccuguauauuucacuuagccuuuucagacuuuagaaggugauuacacuaaaguaguauaaaaaauagaugggaguuuuagcguaaccaccaaagagucuauuccuaccgguagcucucugcauuagaaaauugucaguagugguuaagaaugcuaacucccuuacuuuuaacuucagaaaugagccugcauuuauuuagccacauaauauuuauaaauacuaaguaaugugaauaggcugcaacugaggcaagcacguguuagcuuagcaccagguucaaaaauauauuauacaaagcagaagagaauacacuguaacugguaaaguucuggccacuacacagcauacuaugaaacuagagguuaggauggaauguuuggaccagaacccucccauguuaaggaguaaaaacauaugguauggagucacacagagcuagguccaggucuuggcucuguuacuuaccaguuaaucauuuccuuaggucuucuaucucuuuauuuguaauuugauguuaaucacaguacuuaccucauggaaaccuuacaaguauuaaaugcaacaauaaaacuauuagcaaagagcagaggaaccauaaauguuuuaaucauaacaucauuuuauauacauacauaggaaacaauucagauaaugauagcuccuaacacuuauuguuuaccaugugccagacacuguucuggauauguaacauauguuaauucaauugcuccucccaauaaguuuaugcagcaucaucauccccaauuuauggaacaaaaacucaaggaauacuauuaucuuugaggucaggaaagaugacacagaggaggagacguggcacaagaacaauguaugcacucuaacacagaaacaguucaaaaaucacauauauaaaugaggcuucuuccaaauccauggugauaauuauuaaaguuaauuccugaauauuccaaauauuuuguaagaugacagcagaugagugugcugggaagccugcagccuggauggagggaacauaaggaaggagcugucuuacugacauacagagagcaaacauucaacaucuauaaaugggccaacaguuaaggccccaaaauuuuauuucucccaucaagcuguuacauauuaaaccucucacuaccucaauucucuuuuguagagaccuguugaaccuaagccaguaaaacguaaaaugagcgauucuuuuggauagacaguaguagaaauauaaaugaacuucauggaauaacuucuaucuugagaugaagguuauggguauguuucugcaugugaaauguguuacaagcuaccaugcaaucggccaccugaugauucaauaugauuucccaguuaaaaaaaaaauacugaagaggcuacacucucaaguaccacuauaaaacuuucacuuuagacauuuucauuaaauauacuaugaauacauucgagagacuaaaagaaaaaucucaguacucacuagucaguacucaguauuuugagccuucuuaaauacggccagagaacuagacugccucaaagcuuccucccaaguuaacaguauuaccauucaaagcuuuuauauuacuauguuuuauacuucuagagggaggguugaaacuaagucuuauaugaugccuaucucacauagucccacccaccaaguagggacucuacuaccuguugaacguauacauuccauggccuugugcaggagguuuuucuuuuuugaggcagagucucacucuggagugcaguggcacgaucucagcucacugcaagcuccaccucccggguucacaccauucuccugccucagccucccgaguagcugggaacacaggcgcccgccaccacgcccggcuaauuuuguuguauuuuuguagagacgggguuucacaguguuagccagaauggucuugaucuccugaccucgugagccgcccgucucggccucccaaagcgcugggauuacaggcgugagccaccacgcccagcuaggagguuguucugaaguaccucucaagcaagaugauuagaaguuguggcauuugcccaaauaacuuggcuuuugcugcuucacugaaaacaacgcaggcuaaauuggcuugcagaaaaucagauauauucauucaauuguuagaagcccauucuccagcaauggcuucaguauucuuucaagauucugaaacuugacccaaugacaucucgaacagaugccaauacuaucaagauaaccauggcaacuuuaucuccaaaaauguacuuaagauauaauuuguguaguaucugaaugucuaguaugccuaagacacugucaacagauuaaaaugcugaguuagaauguuaaacuaaagaaggacuacacacuggcuggcauaaauaaacugcaggugucuuagaauaaaaaacaaccaguaccgguugguaaugugaaaaaagaaaaaagguucucaucaagccaauuuuggugaauuaaacauccuaggacuuucauacacuucuucauccaugaucugacagagagaaguacaugaaaaggagaaguggauaagacaagagacggguagguggacauuauguagaaaaucucacauaacgggauaccuuuacuuaaaucuuuguuuuucaccacauguucucacucauaggugggaagugaacaaugagaacacuuggacacaggguggggaacaucacacaccggggccuguugucggguugggggaggggggagggauagcauuaggagauauaccuaauguaaaugaugaguuaaugggugcagcacaccaacauggcacauguauacauauauaacaaaccugcacguugugcacauguacccuagaacuuaaaguauaauuuuaaaaauauguauauauaaaaaaacuuuguuuuuguaugaaacaaaaaagcuguuaaguccuuuacauauccuucauccgaccacaucuucaauguauagugacaccuaccaacaaguuuugaaaaacacacccaaaguuaaaaauggcauuaaaacaaaaacaaaacaaaacgaaaaaccuccaagaaucucaacuuuuaauuucacuuaaacugugacuuuuuucgucuuugagcacacagagcaggucuucacugucucuuauaagcaauagacagaagcuuccucaugcagagguuauaaauaaaaacauucugcaagcugcucuccaaagacaaaaaucccguugcccucagagagcagaccaccaaauagaugagaaaggaaauguauaguuaagaaauuuuuauccacuuuauuaauuuauuuuauggccaaauaaaacuuuaucaaugacaggguuagagggccauguaggcagagaauaauccaaggcaauggagaauuaggcuuccauacugaaugaugaagagcccagcugagccagaauaaagauuucuguaggacacugacaacacuagaacagugaguugagggcagagucuagagaccuugaaugucagggcaaaacuuuuaugagcagaggaaugacaaucuaaauguugguaaguauuaucagacagaaauguauggaaggagaauacagagacaguuucccaucauaacgcaggugaggagaacagucaaaaucagugugguaguaaaguuaaauguaaaugccaucuacaguuaaguuucccuuuguacuauaacuagaagaaaaacugcuuugcaacaauguucagaaacccaagucuucuuugaccuacuucauauaguaaugaaaauauaaugauccuuuccucuguguguacacuaaauacugcuuagagaaacuucaucuugauaccauuuguaaauacuuaaaugagucccaugggucuccacggaucuuugcagagcaaggcaaauauguuucuacgagcaaauuacuugauccacccaaaauucauuccuauuguuucucuuauaaauuagguccucacuaaagggggauaaauguaaaguacagggcuagguuuaaucaaauuuuccugccaaucauuuuuguagaagguuauuacuugauagaauaaguauacuuuaugguguucagauguaagcuucuccuaaaagguacacaucacgugaaggccucugugcuuuugaaugagacauucccuuauguguaauacauuucuucuuuuuccgcccaauaaaaccuagcuuguaaaacaccaucaacucugaaaucaacacagaggccucuagacagcaaguggcauauccauuuucauuguauucugcacuuacucaucauauauccaaauaauggucauauaaacuaagugcugucucccuuacuacacaaugacaucaaggacaaggcuaccucuugucuuauuuuaaugcuguucaaacauuuagcaaagcuaacuagcccacauuaagcacucaaaauguuuauaaaauauuuaauuacagauacucccuguccaacacuguauagccaagauuacauggucucaguaaaacaaaaaaacaacuugcaauuaaauacuucucaaaaacuuuuacauuugcuuauccuggcccuuuguuuugugggcaaggugagcaccaugcacaucuuuuaaagcuacugaccuuuccuacaaacuuggagacaggccuauuagucuuguuaugguuccauauaauauaauaaagcccuaaggggugggaagucuugaacauaaaguaacuacuucuacuaaaucuuuaacguauuuuaaaaauaggauuccucaaacacccagagaaaaauuccuaacaaauaaucuuccucuuaaaggauguuuuaugucaacaauccccauuuaaacaccuguuuuaaauuuaaaacacaaucugcaagcccuaucuacauuacaaguaaaccauacgcuauccaagauuuaguguuuugggcccugauuugacacaauuaucagggaucuaauguauguauacagguauacauacacaaagaaguuaggaagccagcucacuuucuuucaagggcagccugucuuugguaauccucaaucaguagaaacuguaccaguuuuuuaaaaauuuaaaaagcaguaacagcaaacacugcagauugcuuauggcauuuaacaggcagagauggaaauuuguguaaggcacguaugauaaaggagaaagcaaggaaaaagaauaacagaaauguuauuaaaagcccuccccacagagccaaaggaaguuuuaccuacacauauuuuguggggcugacauaaguuaugcaacuaugaaaaauuuauucaauacauaaggggauaaccccugaaacauuagugaguguuguuuuaugacuuuaagucuaccaagauauuucucucacaacaugauuagacauuagagaauaaccauagggaaagcuuuuuuuaaaugaacugauuugcaagacuaauagucucauucaaagacaauccuucauucuccaaguaucuauuagacaccugagcuguauauucccccuaacagcuuuaacaaaaaauaauuacuguauucccaaaacccuuugugugacaguugugaagauuuuaaaagaaagaguuuuuaaggaaaacauggacaaccuucacuguacgcaauaaagagaccauaucauugccaucuaugcaacaccugcagaaauuuaaagaggggcagcgaggaggggaacuaccaccuuuaucuuuguucuaagacaaaguguucuccugcuucagaucuccagaagcaccuugagaaucccguccugagauauuuaauuacacugaaugauuugguaccaggcccuuucccugggucuugcugacugauagcaucaauaacacucacuggcuguaauuaaaccgccaaauaguauccccuuugccacuuggcagauaaauguucuuuaauacuccaaagaacaaaguacaaaggugagagggguguuuuuaccccucaccuucacaguucaucugacuuugugcaccaggauauacauauacuguagacaaugcauauuuuacaauuccccucagacauugcuuaaugaagaacaugaagaaaaauccuugguuucuuauuaauucauuuuugcaacucugagcagggggaaaacacuguaagccuuuuggcaagaguaugcacugcuuucacauagcuuuggggcaacauuugguuuacaggucaaaaggguuucuaaauuaaguuugcauauagcaaaaaauuuuuuccuuuaaaaaauuauagcauaaaauguguggaagcucuuauaauagagcaaauucccauuuauugaggcccuggcuagaaagcucaaauaucaagacacuggguagggaaggaagagggguuugguuggcaggcuauaaaaauaagacaaauuuuuauuaaauuuuaaaagccacuuuuuuuuuuuuuuuuuugagaugggaguuuugcucuuguugcucagguuggaguauaauggugugaucucagcuuacugcaacuuccgccucccggguucaagggauucuccugccucagccuccccaguagcuggguuuacaggcaccugcuaccaaacccagcuaauuuuuuguauuuuaaguagagacgugguuucacuacauuguccacgcugaucucaaacuccggaccucaggugauccacccgccucagccucccaaagugcugggauuacaggcgugagccaccgcgccuggcucaaaagccacuuucaaaacuuaacucccaaucucuauaagacacccuuucaccuuuuuuuuuugagacagaaucucccucuauccacccaggcuagggugcagugguguaaucucggcucacagcaaccuccgccucccaaguucaaguaauucucccugccucagccuccggaguagcugggaucacaggcacccgccaccauguucggcuaauuuuuguacuuuuuaguagagaugggguuucgucauguuggcggccaagcugauccugaacuucugacugcccaccucagccucccaaagugcugggauuacagguaugaaccacugugccuggccaagacacccauuuuaaauggauaggcccuaaagaaccauacugaaaauucuccaaauacccucagaagcaaauaaauuaugcuagcauaauuguaauguugaaguauuuaaugacacacaaaugcccugaaaaugagcaaauugugugugagaacgugcauuauuucuuagguaaauccagcacuauauucauuaaaaacacauuagugaaucccagccauucaacauaucuugauguaaccgacaaaugaaaauccuauuuuuuacaaguagacuuguuuuaaaauaagcaccacagaccuacccaagugcaaaucauuaagauccacugaacaguguuucucaggucaggccaccaucugcuuaagaaucaccugugguggcuguugaaauacaauuuccucagucucucucugcagauaaucagauucaguaaguccugguugggguguagaaaucugcauuuuuaaucaaccaccccaccccacugauccugauaaacauuaaaguguuggcagucucuuguguaaaggcauuugaaauaauccucaaaacucugggcauauuaggguuuccuagauagcucauaacaaccacggaugccaagcccuuuuccuugccauccacugaucguuaguuucuaaauaagacaaaugccagguagcuugaaagcaaagcauuuaggaauauaaaucaccugcaaaugcaaaaaugcagacguaaaauaaagcccaugaaacucauccaaagauauuuccaagaacccagacuggcuggauguggcucaacuggguuagccucuucaaaaaggccacugugcuugauucuaugaaguuaggagcuucucucaaugacucuuucuaggaauaugaauaugguuauuugguuaaggcaagcacaaauuucuagauagacauuuaacaaccaaaacuagaaacugaaacuuuuucugaauuauuaguuuccaggacuacaugcuuguucuauuuuuccuugcccuuccugcagcucaccugaucaagaaaccaagaacagaacacaaauccaagacuuacaccuccaaguccuauugcagcauucaaaagaguucuucacagaaggaagggagaggaggcaggcaaguaucagauuuccuguacuguuuucaaaauacagaugacccuggaacaauauggguuugaacugugugggugcacuuaauaugggauuuuagaccaaccccucccucuuccucugccuacucaacauaaacaugacaagggggaaggauccuuaugaugauccacuuccacuuaaugaacaguaaauauauuuugucuaccuuaugauucucuuaaccuuuucuuuucucuagcuuacuuuauauuguaauaacacauaauauguaauacaugaaacauacaaaauaugugauaacuguuuauguuaucaguaaggcuucuagucaacaguaggcuacuaguaguuagguuuuugaggagucaaaaguuagacuuuuugcuauaugggggcugcuacccauagcccccgaauuguucaagugucaacuguacagcucugucucauugcccaaaagcagcaugucaagacacuucuggaaauaaaacauccacaaguaauucuaauguaguacaugcgggugagaacacacacuaaaaguaaugauaggaauggcuggcagaagugaaaauaaaagaaaaugcaccauccaugcuuuuuuaaagagucuacgcaaauuuaaagagagaccaauguuaacacacauuucuguaaccuuuaaacuagcaucuacgacuuacaugaaccuaccagaaaaacauugucgaagaaugcguagcugccuaaaaaauaauuucaggaaguuacuacuauaauaauaauuuuacuguucauuacaacugaaauaacugaaucaauguuaacucacuuaucugcuaaguaugaccuccagauccaguuuucuucucaaacuguacgucuggcugucucaagugcucacucugcaagagggcagaguucuucacuccuaggcaaagacagcuccacucucuggcaccuaagagaucugguccagaaagucucaagacaaagacacucaaaggcccaaauuaaggccucucucaguugguuuauuuagagugguaucugagcaaaacaguuuaacaucaauaaugugaaauggaaagaaaacaacaaaagcuacggcaucagccaacaugauacuacauuucugaugcuuauuagcuauuucauuuugaacaaaucccuuuuaaccugagcuuuauuucaucaaagggauuaaguauuugccuaccagagacuacugcuguuucugcacgaauucaaaacaguaaaaagauaauaguccuaugaaauuuguuucaaaaguagauacagcaaagaauuaagggcuccuucuugggaaguuaacacaaucaucuuaacuucacaagccagguaugugguagaacagacugaagccaaacugaccuagcaccacuuuucccaggugauaaaugaaagaaaagcccuaccccacauuccccuuaaaaagcagugggaaaguaaagcaacaagggcuagcagugugauguucagguagaaaagauuuuuguuuucuucuuguaaauuuguuugaguucauuguagauucugguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucacaaggacaaaaaaccaaacaccgcauguucucacucauaggugggaacugaacaaugagaacacacggacacaggaaggggaacaacacacccuggggacuguuguggggacgggggagggauagcauuaggagauauaccuaaugcugaaugaccaguuaaugggugcagcacaccagcauggcacauguauacauauguaacugaccugcacauugugcacauguacccuaaaacuuaaagcauaauaauaauuuaaaaaaaaaaaagaaaagauuuuuggccauccagaucaguuucaauuuaucuuaucucacuguuaucuuagaaaucaaacucaaacacauuugaacaugugguucaacuauuuucagugucuucuaucaugaugcacaugguuugcuugaaucucuuccucagccuccuuauuauucggaaaccaauuuugcacuuaacauucuagaccugugagcuguuauaaggguucugccucaaugacucaaauuucugauaaacaguaaguuucagugacauccccaccacaugccccuuucaauuccacacgugcacacacacacagacagcaacaauuuccuaaaccuauacaaguuauuacuucuguggcuuucccccuaccuuacacagaagcaauacucacaaggaggcaguuacucuuuuaauuccaauggaggucuucauaaaaccugacauucuccaugcugguuacagaaaugaaauagccaggcuuuucugguauagaccauacuuugcauaaguuuaagcaucugccaugaggggcuaugauaccccuguggagcaugcuuagguaacaaaaugauccaucaauuccaauaaagauggguucagucaacuguugagacucuucuaccaucacuauccacuguguggcugacaggcaggaaguaagcaggggacacugccaccaagaacccuguuccucauccuucccucuuuguaggcucugccucugcuccaacaacugugggaaaaucuaaaggaaauccauuggaagaaugccuaguuauugcccuuugagaauuccaauuaacucucacuuuggaguuggcuaaaaggaacagaaguaacacaagaggccugaggacaggacauucaagcucuggaccuuacuugggcuaccuacccacauucccuagaccacauuagaugaguaagaaauuucugggcuuuuuguaugaaaaaaauuaaagcugacaagagagcauucuacaaaacacaugaagggcauuauacaaauaacaauaaaaaagucaucugugacuucucacuucaaauaaggacuauguaaaugggacucaauauagauagaagcauuuuauuuaaauguauugaagaggugcugauaaucagauguaauauacuguuaaaacuugacauguggcuguggaaauuuccagaauacaaguuaacaaugaaguuaggaaaacauguacucggucagucuguauuuuuuaaaaggcagaggaacaauuuacucaacguuucaauuuuuaccccacuccuggcauauacuuuuucaauuuuuuuuuugucuggauaaauaacaguuauuaggcuaacaucucauaaguaggucaguuaauuugaggccuguucuuccaacuauuacuucuaaauuuuccaaaucugcucaagguaaagguuuuuaaaugagggguacuuuguagacgaugauuuauaaauuucuacccuuuguaccaucacaggaaauaacaaacuacacaagccagaaaaacacuaggguggguugaaaugcugagaaagauguggcguuuaaauacaaaacaaaccuuccucuccgaauaaauacucaaggucaaucccaacacuacucugcucaaaacccuccggugccccuuccucaccuagagaacaaaacaucagcgccuucacauacaugcgcacccagaacacacuucuauaacgcauaacucaggcucauuucccacacucgccucccauccugcuuucuuuuugggcaaauucuauaugguuccccuaucaacugcuuuaaaacuuccaugcccuacuaaagucaugaacucccagcauuauggcuauuagagccacucgucucaaacacagaacugugcugcagguauuuuaacagaggaccuacuggguggcaagcccuuagcguagcuuuacuuacauuccugccugcauacccucuccuccuucuuuacagugggggcugguuuacacagcaucuaagaauauuuccuucuggccaguauuaacuuuuauaaaagaacaaauuauaaugauaaagaaaaaccaacccaaucccaauaauccugucgcaaaaggagguugaacuagaaacucaaauccccauauaaaguuuacaguggcuauuaaacuuucaagagugaaagaagaaggcaauuaaaauuauucucucuucaggagagguugcugcuuuucaucaaaucauuuuaugcaauaaacaugaauuuguuuaaaaaguuaacauuucuucuuaauaugcaacuuagcagaccaugaaaagcuuuuuuuccucuccuaaaaagcagguaaugaaaauucucagugaugaauaaauuauuuuaacgauauaaauggaaacuuaaaugguuaaaagcucuguccaagauuaagcagccaguuaaaucauuuuaguaagguaauuuagacagaguaagauuucagaaauguaguucuauauuccuauguuaagggucaagcucaugcugaacagaaaaaaaaaaguauaaauaugacauuuacuaaugaggaaaggauaagcuaguuagaaaaagguauaaauuuaacaaaaaguuaauggcaauacaguagcuuagaauacagguuucuuagguuugcuuaaucacucucaaacugaacacaaaaaauagauaauacuauuuauaauauucucauuuuuauaauagaauuuuccaaaugugguuaaauugugguuuauuucaguauaagaaauuucaugauuguauaccaauuaauaacuuuuaagcaaagguaaauuuuagccuggucuauagcugaaugauuaaggaaaauauuucuuuaaucaagaccaaaaucgggcaguuuuucuaugguaguuaauucuagacagaauuuuuuuuucuuuugaggggucagaacuuaccaauaacaauaaaacauucuauucccugagauaacagcuccuucuuuccagauaaaucaaccccaguuucaggaaaaauaaagcauccuaggcccauuguagaggagggaaaagcugagagagaugcugggagccacguauccauuucacuguguuaugugauaaucaccuauccagaguucuuuaugcagaggagggaggaagucuacacauauucuuggaaaugaaugauuuuaguuugcuaaucaugaauuuaagucugacaccguuaaccuaacaagucaaaaguauuggcuuuaagccauaaaaauuccacauacuauuuagauuuuuuucaauacuuaagaccccuaaaaauaaaaugaguagagaaagagcaugaagacugaacacaguagguacaaccacucacuucaugaauaacucaccaaaggaaggauuccuuuagggaccugaaggaucuuggagaaaaaccucucuucuucucaccagcauacaacuugacacuuccaugagauuacucccccacccccaugccugaacuguacacauaucaccuuuucacuaccuucccuaaugagaaucuuaaaacauuuuuguaauauucacacuuuauuuaccaugucaacacuggggauacugugggcaggcuuaacccaaaauagcugccucccaugcaguacagggaugaugucauuucaccagcaagguaugccucugggacaucuccuuaaccaggaaaaaaagugaccuuuaggacaagagaacaaguaucucgagacuuuaaccuguaucugcuacuacuuaaacaaacagcauccuacuaugagacggauacguuguuuucaauuucuaugccauguuuuuuuauaagcaaaggcuggugaaccacguugaacucugaaugcuaaacgaucgcccagcaugcucaagaaaaaacauuaauauuuugguuaacagaaugaaccacaggaggauuauuaagguaaaaugcuagaagacaaacugaacuuugcacacacaaauaccaaauguauagagaaccgccaaacaucuuuggugauucccaagugcuaggccuuagacuugcugucauaaauuaccugggaagcauaauaaaaaacagaacccggaaucucaccuguggacagggaucgaguagaucuacaguggaucccagaaacuguauuucuaacucacuucccuugggauuaagaugcaaccaaaguuugggaacaaaugcuuuagguccucacagagccugagggacuucacuucacucaccauggaaauacugaacaucugucauuuauucaacacaccaacuacugcacaaaacccuacugagcuaaugcuauuagggagccccaggagaaacugcuaaauaaaccaccuuucacagcacuugauucacuguuucaauaucccaauaaccaggaauuuuaccaaacgcauacuaaauucuaaguggcuuggaguacacaaacacuuguauauacuaaccaaucuucuguaccuuucuaaaguaaagcacaguguccuggcaagaguuuugauauaacgaucagaagacaaggauuuguuugagucgcagcucuuucuucaacugccuggucuuggcuaaauuguaugaccaccaagaucuccacucugacuguggacagagaacagugcuuaagccuaaauuacauaugggucccccuguaauuccaaaacuucugugguuccucaaggguaaagaauauagacuucaaagaagggggaacucagcaggagcuggaacaaccuggaaagacagaagcugaaggacagaauuccuuuagaugggcuccaaaagaugagaugaccacaguuaaacuaaaaaugagugugaaaggguauaccaaaaagucggagcugcaaaagcauaugcauggacgcugggaguaagaucagcuuacaaguaaagagccagucugagaacaguggagaacggcaauagcacuggcaucacuccuacaaaacucagccagaugauaggguaaaacaguagagaaacaccauagaguuuugagugagcaguaacacgaguaaaguggugcuguguaagaaaguggugcugacagccaucaccaguauagauuagacgagggaaaaagacuuauuuauggaauaguaucccaggaaaugaaaaggcuuaacucaacuuccaaaacauucuuaaagcugugaauacuagaaaaacuuggcucaagacauuguacaagagcacaaaaucugucuaauggaaauaaauaaacauagaaagaacaaacaggcaaagggggugcuauauacuugugggaaauggucugcuuugccucuuagacaaaugugggccaaauugaggaugccagcuguuaucugauauuuuuacaggaaccaaauaggggcggggaaagaaguagccugcuauuugcccauuacccugacccacaucucagaaaaucagaaacugaugucacacuauaaaagccacaaagcuuuacugugcuuucuuccacauauucagcccaagcagcugggcccuaaagagaaaaggcuggaugaugaacaguaaggaagcagcugucaucaacugucuccuugaaggccacgggcauuucuccuguggagaccuauuuccccugcauuucuaccuucuucuggaucuucgugcaggaggauauuuaguaaaagaacugacacacuagaaugaaauaaggguaauuauuucuagaauggagaaaaggauaguuccugggacaagccaucuugaccaccuauuccauuuucuucccaacuacaacucaggaccucagaacuaggacaaauuagcagcaacgcuggaaaucaauauaaauugaggaaaagaaaccugcaaaaaucugcuguaggauaaagagcacacggucugacgguaacugaacacuggaugucuuuuuaaagaacacuuauuguuacuuaauaguacuaguaaaagaucucugacacagaaaguaugcagagaaauauagauaacgagaaaaagcaguucagacugaaaaaacuucaaaacaaacuugucuuacacuuuauuggaaaucucauuuuucccuucacauuuugauaauauacaguaaccaguucauuuucugauuggugaaucuuuucauagaacaguuucuugcucaagaaguaucuagaauucuuggaccucucauacccuaguauauuugggaaccacuauauacuuucauuuagauaagacagggcugguaggcauuuuucuuaggggccaauaaauauaaagacugaugugucaaaaccacucagggcuaauaaauuaccuuaacugguaauucuaagaaaagcaacuuuaaagcacaaaaaugacacuucauuuccagauaccugaaaaaaaugagcaaaaaucuuuuacacaagucucuaagcaagauggauacuacagucagccuugacuaacuuccccucaccacuucaggcuauagucugagcugguuucuuaaaucaaggguggaaaauagguucaaacuugagucaauugauagaaguugucuggaacacuauuuugaaaaaaauauuugggagccacaucuagacucugugagaaagagugccaugauugacuggcaaugucugcacugggcaggagagggcaaauugaugguacagcuaacuaagaauuugcuagaggcgacaucccucuuauuuucuaaaggaaaagaaaucuaugcugugaauuagauuagcucccucucaagagagaaucuacauaagaauuucaaagauucacaaaagcagcaaaguauguacaaaguuauuuacuguacgucuuaaaaagaaaaacaacagaaaaaauaaccugugucauguaaguuccuccagucagucuccucaaagcaagcugaauuagcuagagcaaacuacaacucaagcaccacaucuagccugccaccuuuuuguauaacccaugagcuaagaaugguuuuuacauuuuuuaacuuggaaaaaauaaaaagaauauuuguaauacauaaacaucuuaucaaucucaaguuucauugcccauaaauaaaguuuuauuggauaacggcugcauccauuuguuuauguaguggcuauuacugcuuucauacuauaaaggcagaguugagaaguugugacagaaugcauggcucgcaaaaccuugcuuauucacuacccagaccuuuauagaagaacaagucuaagguuuccucaaguuauagggcaaguaauucucuauaagggaaggagacuugauuccguaggcuuccuauaacauuuaucuaagagaguuguugcucugucccccuuugcgaauacaugaaugauuauacauagcacucuugaacaaacaguuucuuccaucuugcaacaaacaccaaaauuccacuaugucucccagguaacuguuuauaugggcccaaaaggaagaaaggaaagaacuacaaauaaaucuuaauuuuuuuaaacuucuguuccgcaaguagauauaaaaaaacuuuaaacauacuuuuauuguuuugguuugaagucucaauccauucaggguguugauagcuuucucugcauccuuggggucaauguaguucacaaagccauaucccaagcucugcccuaaugaaaaggaaggggaaaaaggcauauauuaguucuauacuguugacagagaucaacuuucauuuuggcauauggucuugucauuaacaccagcauauuuccucaacaguaaaaagaacucucuauuaauucuagaaauauacaugaagucuuuaugucuccugucuacuacauuuucaaguuuuagaacucagcaagcagugcuguuuaggaaaaaaaaaacacacauccccaaaggauuccaccauccaugcccugccugagccagaguauaccaucagcaagacaaggucagcuucauaaacuguggggauaaaucucugugcuauggagagggcuuaacaggcaauaccuuuucagcuucaguuuccuuagccauaaaaaugggaagacagaaaacaucaaccaagaaucugucaguguucaguaaauuguacccugacauauuuacagccuuuaccaaguacaauaaugucggagucuaaaauggugaagaaccaugugugggcguguauacauguaaguuuauuuuagacgagggcuuaucuucaaauacacucaaucaaauuucuccaaagaggguuuuaugaucuagauaagaacaggaaaauaugaacacaaaagacuuacagggaugacaucgaagacaaugagaacauauaggaaaagaagaaauagaacauaaacaaaaauaacaggagaaaaaaagucuagaguaaaaguugcuucuaaguguuuguuguuguugccacccuccccccaucaucugagcccucucacuccugguucacugaugcccuagaucucagacaaugggagcuaucaaaagcaguugcaucaauggaaugcaaagauaacuaaagucaaucgcaauggucucaacuuuucaaugaagcaaguuucucaguuugaaauggcaagaaacauuauacaggugacaaaaauggcauaagaaaaguuuagucuacaaaagucaaaacaaacuaaaugacgauuucccagaugcccaaggacgguccaaaugcuuuuacuaaguacuacuguugcaucaauuucauagggaagugagguauuuuuucuugauggggcaccguaggugcaagugguuaucaauguggguuuuuaggacagcuacucugguuauccuaauguggauacuuguuaccacauaaacgaaaagagaaggcuaaauacagugcccaauaugaaaacuagugauuauauuuugggaccacaaucagaauuuuggauaaucacugcuaauauauguccucuaucaaaauguauuuuuuccuuuuuaaaaaagagaaaggaauagagagcuaaaaacuaauuagguuaauuucaucucacacuaaaauugagguuuuauuuuacaguucuaguaaagagucacaugugaagccacuguauuuuuaagcauucagcuuuucauuaauucaaaauuuaucauguguuuacugcaugcauugugccccucuuaugaaaauguguugcaguccuauugucauugaguagaauuaaauuggcugaauguaacaaaaucugcucaaggaaccagcuuauaguggaaagacagacuuccaauaccggcucugguguuuacuggcucgcaguuagcugugcaacuuugaagaagcuacuuaacaccucucugaaccacagcuuccuucucucuaaaacgaggguaauuccuacccaacuagguugcugaugcaaugaugaaaauauucauuaaugaugaaaguggaucgucacccuagucaaaagauaacaugagaaaaaauaacaugcuuacuguuaaagauuuuaaguauauucauuuaaaguuaaauaaaaaagaugccacaaauauaacagaaaaagaaaagggcaauacaaauauaguuuugucauacugcuauucuaugacaaaauaaaucaauuguaucagcauagucuaauugcccuuucuacugauagauacuccuccuccugcaucuuagcagcuucuaaccccagugcauucucaaacuugacugcaauggaaucaucuagaaagcuuaaaaaaaaaaaaaaaaaaaacuaaaacaaaaaaaccugauccccgaaucccacucccaaaaauagauagauauauauacauauauguguguuugugucuguauauauauguguauaugagaugagaucucacuacauuggcugggccaugcuugaacuccuggacucaagcgauccucccaccuugggcucugauuuuaucagucugucaugaagcauugguacuagcuuuuuaaaauccuggugacuaacguacaaccaccauguugagaaaucacugccuuaauggugagaaccuagcuggggcuacaacggggcugcugggaggucuaagaaaggucuugcagggaugacugcuguuucacaguugcguuguuuagguacacguggauguguuucuucuaaaaucuucaaguuaccuauuacuucaaagaaacaguuuauuggccuccugaggucugucuggggcacaagagugccuacugagauuagaucacuggguaaagugaaaagccugucuugcuuacuuccuacuuagcuguuucccacucuagccucugaacccuuacuccuggccugcuguaggcauggaaacauuugcuaaaugaaagaaugagaaacuuacugauguuauuuauuuaaccaaagguauuaucaucaucaccaccaccaccaucagaagacccaaccaucaaaugggucuuccaccugauacccucaagcaaucaugacuagcuauaugagucagucaaauaucuaguaucuguuaaguuguuuauacucagaaauauuuauccccaaaugacuuugccuccuuauaaaaaguuucuuauuugccuaguggcauuauuaggaugagugccacucagaauauguuugagguaagcaaaacuguauuauuauccuaagcaaaauaauaugaaaggggguaucugcuauuaaaagacugcauuccuaaaccuaccaucguugguguauuaaaauguuggcacuauaacaaaagggaguuagaacuuuaaauuacuuuacagugaaaaucuguaaucaaggcagcaaauauuuauuggauguuuaaaauauauuaaggguaucgcagaugauaccaagauaggcaagccuccccauucucaccuuuuagcuacaugguauuuuacuguuuaauuguagcuucacauuaaccauguucgguauucagauucuucuccuacaagguagaaaugauaucugaagcuuggcaaggucaaucagcuucuacaaaucaaaaaggcagggaggaaguaguaaagucaggacuugaagucaggacuuucaaaugcugugcucuacuccacucaauuaacuaguuuauaccugaacugagacuucaggcauauugcguauaagcccaggacuaguuuguacccaauaugccugaauaauaacguaaccaggcacuucugacacuuuuaccgcaaaaguuguuucuuguuugauuacuaucucaaacuucuguaccuuuuauacaaauaucaguuuuacuauauaugaauuucagugccauuauucauuccuaugacaacauaaauugcaucuuauuuauauagugcauauuucugguuauaaaugagcgcacaguuuuuaaaaauaaaagcaguagcaaggcaaacauuacaaaaaaaaauaccuuaccuacccuuuucccacucuuauauucaucaguaagucaugggccaccagggaaggcuuggaaaccaagcaucacuuauccauaucauccaaaccuauuuuucaagucucucugaauuuagaaugugcauacugauaauccccaaacuaagauucauuucuuuaaaaaguuuuauaagaugcuacauuuaaauuccaaguacaaccauuauggaaaccaacaugauuaaaagacuauucugaccaaaaugacaaagcuaaggcucuucaaaaaaaaaaaaaaaaaaaaaagcccuuaagaaaaacaaauccugucuuuaaaugccaaaaaauuugccugguaacugaacauaaagaagaggcucaaugccacguguccucagcuauucucagaagcuaccuguggucaaguguucuaagaauuuucaaaccauuaauucaaaucuuucuucuuuugaggcaaggucucucucucugucauccagacuggauggcagugggcaugaucucggaucacugcaacuuccaccuccuggguucaagcgauucuucugccucggccucccaaguagcugggauuacaggcaugcaucaccacacccagcuauuuuuuuguauuuuuaguagagacaggguuucgccacguuggccaggcucgucucgaacuccuggcuucaacugaucugccaaccucggccucccaaugugcugggauuacaggcgugagccaccguaccuggcccaaagucuugauuuuaauggccuugguagggauucuagaacuuuugcuauauucugugcugcacuguuguguaugaaugccuuuuguuucacacgcuucuuuuuaaucuaacauacaugccacagaaaagaaacccuucuucacaagagauagaaaaauaguuuauaagaugcuccuggcacaaggagaacaguuauaaacaggcugguagaaaucauggucaagggaucuauaccacagagcugaagcacuccagaggccucugaagaggaccaaagacuacugagagcaggguucagagcaaggagaggaaaacaggaagaaaacccguuuaguggcaaagugcuacugugggaaacacaguaaauggcaauauaucccaaacuguguguaauucaaagcaucagcuauuccccugccaccuacauuguuuuaauacccuacuuuaauuaaaauuuuaauugcauauuuuaauuaaaaauacacaaucuucuggaccuguuucauucaaaggucacuuuauuuagucuuuucuauuuuaaauuacuaccaauguucagaaaaaucaaauuacccccucagguuuaaagguaaaggcaauagacuaccguaauucuugauuaaaaguauauuaacuuuauccaaccaauauuaaacaagacccucaacacaaaauuguggaaaauaaaauuuuguauuuaaaaaaaacaagagucacccuacaaauuucucaucuacaauaagcauucaauaacuaugggaaccauacuuuuugcuaggcccugagaaugcaaaggagaaaaagaucuuucucauaaagccuauauucugacaggaacacauucuacaggguauuagaagaaaauagagcuaaggagaaaaaagcagcagggggugagaguggggaggggaggagcagggcugcuguuuaaauacaauggucagagcaggcccuauccugcagguaacauuugauccaaggcuugaaggaacuagcucaagucuaacagugaagaugugcaagacguuccagcccaaguucugccacacccgcaucacguucugccaguccuaccagcuaaaucggccccuugucugcguuagcauugguucucuauuauucuggcccugaucacugcuacacuauccuaauaggacaacccuugcuuagacucccauuaauuccaaaaacagccauccuccaccaaaacauuguccaggagaacuucuuaaaacacaaaucuaaccauacucugguuuccagucacugucaguuuuuugcucacuucuacuuucgcucaucuuccaccacuccuacacauacacccuaaaaugcacauucaguucucuaugucuggaacacagcucuccaacuagccaacucccauguauccuuugagacucucugaagucauuuccugccacaacuugccccauccccagugcacacuguacagugcuccucucgacuaguccucccacagcuucuuauauuauuccguuaucuuuguuaugugugucugggguccauuuggaugcucccucacuagacugcugagcaagggcaagcagaacauaguuccugacaaggaggacccuaagacagaucauuaaauguucugugaaugacugaaugaaaaacaaaugaaggagcagcagcaucugccuuccaggagccugugguuuaggagauaguugcccuuauaaacauguuccucaugucccuacauuguaccagauggauuacagaacuuguggagacaagaugcucaaauguuauaguaauucugccuucauaaggaagucauacgaguuuuaaauaguucauguaaaauuguucauacgaaaaauuucuacaaauaccauuaagaugaagucucaauuuuaaaaagugucaucuagaguaauuugauagauuuacauaaaucuguuccacaaaucgguaaguaugaauuaugggaugucagcauauaauuuuguugaaaguacuuuuucacuaauauaauuaagucugcugagacuauucauguacaagucaaauaaaaugcagagugaauucuguaaaaaccugguaguugaaucaacaauaaaaggugacuacacugauugauguguaucuauuauuccauuuacagcaguaguaauguuuuaugaaauaaaagaauaaaagccgugugaaucuuuuucaaaucccacaguuagcagaaacaggucacuaugguccucucugucaaggaagacuugcaaccugagguuuaauaaugcaauacuuuuaaaaagcaaaauggaaagauucgcuuccuccaaacacagcucuugcauaaaacugcaugccuuaacgacaaaaaaaagcaaauaauuugauuugcaaaaacaaguuuucguuacaaagggggaaaauuuuuguuuuuaauaaagacccuguugccuccugauauccuucucucuccucccucaaacacacaauaaaguugcaaauauauuguauuucuucagauggacuuacuguucuugggcacucauuaugugugucuguucagacaggcugugcacugcaacucuggcaccaaagcaacucgcaccagacuucacaaaggagcuuucuuaauaucucagaucugauacacagcaaaaccauguggguaccacacagcagggaaaagguuugagagaaucucagaacagagggaugcaguucucucuagucacguuuuucuccacauuuuaauuccugacuuagccugagucuccucaaauguagcaugccagaugcagcagguccuuccauuuaaacacucaaguuaaggugggucaaguuaaacaggucuuccuugcugcccucuaaugaguaagaucaaauugugagauggaggacuggugagauccuauuacuacaguccaagccagccuuccugaaagcugggagcauuucuaccagcuucccaaaggacauuaccagggauuaucacaaggauggagaauucaaccuagacacucacauaauacagaaaacagauggcucacucgaagacucaucuuccacccaaaugcuaauaaagcuggccugagacugaaaggccccaaaguuucuaaaugauuuucaggacuuuacagauacauggagcuaauauagaagaguuuaaaucauaacuuuucugcugaaaucaaagcugcaaauagugaucauuugguaaauauuaccuaagcagccuaauucuagagagagcgguuaauguccucagcaccagggcauuuucccuucaaguuaauuuuaauagccauaucuguccccugauuaugcaacugguagagcucuauuuuccuguaguuccagucccaguaauuaugaaucugcuggcaaugcggcaugacccugcuuaaguuggcgauacuguggguucuuaauauaucacauuuucagacaacauuaagaacucccacacaauucagucuuagacuauugagaacagaaacagcauauuaaauccucuaaauucuugccaaguauuacaccggguacacaaagauaucuugcauccaagaccaggaagaugaggaaaaauuaugugcaguaggaaaauaaaccaauuccucuacaacccacaggaugagacucuaccugaaagcagguucuccagccugaaagaaagugacugagauaguguagcacgcucagcaccacaaugaaaacaaaaggcgguucucaucacuuauugauauagguaguuucucuaaaagauaggucagcaguucuaccuucaaacacuggagcugccaccaggauagagcaaaugccaaaauaccuucagauagccugaaagucauaccugacaguucaaaaaagguuaggacauuaacaacucuaggcuaguccaaucuacuuucaauuaaaaguuuggguaugcugcaacuuucucauuucuuuguuaauuauaauuaauucuacacagauccgccaccgccccuacccccacccccacacacacuaacagucuuauauuaucugcuuuaucuuguguuuacuuaaaagacaauggaguuguucaaguauauaccauuugggaugaaggcaaaggaacuguauuccucaaaauaguauugugguagaggaaaacaaguuaacugugguaguaaaaagggcaucugcuguugcuugugcgaccagcuggugucaaucuucacaaacaugcacucuugccugugccugcacacacacacgcacacaccccccccacuaagcaguccaucaagaggcaguacagcuucuuaauguguuuuucucucuguacaagaucauuuuuuaacucagauaccacaagaaacaaaaaauuuaaaggcccuguuuugaaacuaugucagagucccugcaaaccaccauggagagcuccccauuuugucaagaacgggaaacuauaaaauuagacucuaacaaacucaccaaguccaugugaaacaaaaauucucguuagagauaaauuuucuucuugaacacauuuuucuuaaaaaaaucacucucucacccaaaaguuaaagguucaccagcccaaaccuuccaguaugaaaaagucaguaaguuugucggggaaaaaugcccauucccacugccccauaaaugcuaugucuaccugucuggcagucaacaguaccacugccaaacuaaacuaucaagcaacuaggauccuuacauuacauauaucacauuuaauucucaccacaaggcuacauguaaauacaucuguauccauuuuacggacauaaaguuggagguucaaagaugcuaaguuaacuugcucaagggcacacacagcuagcucaaaggagcagcuggguuuccacacuacaaucaaccuuuccaaacucagucuuucaaaaguguacacuuuguugccuuuggccauguguggaaauuacuuuguggcagaauccuguacauccaaaguuuacaacuuuccaaucagaauauuuauaaucuccaaauacaucuguauuuuuuucuuguucuuugucaugaaauaaauugacuggaacuucaauucuuucuuaauccauccaagagacuaucugugaaagaaaaaaaaaaugaccugaaagaaaaggaaggacauccugcaggugcacaaaccacuuaagcccccaaaacaaauccaucauuacaaaacagauagaugagagguaucugcauuauaaaaagauccauuuaaaaugggccuugauuuacauacuccuuuuccaaacucagaaagcaguucuuauggcuaaagccaaacauguuugcuacugccaaaacggucucccacacaagacauuucucuccucagcagauugcauuaaaaugcuuucauacgcauagcaugauuucauagcgguggaaaaaagaugggaucaauaccacauggucucugcccucuaagaugcucaaaaauuuuaagcccaacacaguaaacaagggagagaggcaggcaccuaaugaacaugaaauacauaaagugcaucgcagggguuucaggcuuaaccaggaccagcuugaaaaagagaacucuuuagugugucaaaacagagaagaugaaauucagguguuuccugacaaacaaauuaagguaauaggaacauggagaagaacaaauuuguaaagaaguauaaaagagacaagccaaaagcauacuacgcugaacguaaggcaucuauguagagguaagcaaaccgaccccccauccuggaagcaagacuggcccaugugaagguuuacagcagacaaacugcaggaugcaccaagcacugaggcacaaugaggaaggaggcacacgagggacccagggacagucaccuuaguggccugguauaaucacugagcagaugcagauguaagacuguaacuagggaccucaguguuagaaaucacccacauucuuuuuccuucuucccuccccucucaacucuuuauuccuucccucucuagacacucccccuuaggcaauccaugcuuaucuacuuaggcucuuaagaaaucccacaggcuaaucuugaaacaaaccaggaacagaguccccacugcaaaauccucaugauuaggaggagucauaauuaguccaccaccacugagccaaagucaagauaaugccaauuagaccuucagacaccugagagagccacugaacaagacacacagauccugcaccacuucugcacgucucccauaccuuucucccuuugaaagcccuacgguaaauuuuuaaauugaagaugguacuuuagaauacuaguuugccaucuucucaguuugcuggcucccauuaaaaaugcuuuuccuuccaccaauccuugccucuuguguucuggcuuucaaguggcaagcagcugaaccuggguucgguuacaggccuucuagaguaauggccaggauugaaaccuagcaacuccuugugucccaggaggauccauacuuccuuggcaugauaacaucuggccuuuguaaaaguaacuagaagggcaagaaaccuuuugaaccauaauacccagagauuaauacaacacaccaacucagcagccuugaaaguauucuugcacuauaaaacuaacagauauggauaaccccaaccaccaaaaagcuaaacccaagaugacuacaucaggcagggcuuacgauuuucugagaccuccuuuacacagcuguaaaaacaaguaccucaauccucuuucugccccccgaccaagcuaagcugcuauuaugaguggacaaaguguuaauaacuaccacaguaaauggggaaaaacuacugcaaguguuaacaaaccuuauuuuuaacugaguagcaacugcaaaauuacacaugccuugugaaugcacguacauaccuacguccuucgcauacaauauggugacaucaaguuagaaaaggagugaaagagggagggaagcugagucauuaagaagggaauauuggguagcaucacaugaucagguguuucaauaaaaacauauuucaccuuauguguacugaucauaaaguaucugcuauagaccgauauguacaacccuuccaccggggggaaaauguccacuguaauuccuuuuauaucaaaaagaaagagcagaauuaaauuagagguauuuuuagcaaagacaaaggaaguaaauuuccaaaggacauccaucguccccagucgacacaaggauuaaguauaaauaacgugauuuuucuucucuuuguacaggacauguugcuuaguuuauaguuaaugaagagguaguuaaucaagaggguaggaggaacauuuuucuuucuuuccucuaaacuuaaaauagucacacacagcacugauuuuuacaugcuuaggaaaaauuccaaaacagacugaugguguuugggcugguggggguauaaaugcugaguauaaaggaaaccuauuuaaauacuacagacacagcuucacaaaccucaagaacacucucucugaagcaauaaagaaaaggaauccuaauggaacacaguccccagaggaaauugagcuguacaugguuaaaguuguaaaggcuaugggucagaugggaaccauggcuacgaauuaagucaaagagguacccugacagaaauaaguaucaauuuuguuuuugcucagggacagcuuaugcuacagcaaaccacucugagaccacagggcaacuugcccaccaauuaacagauggcuccuaaagagaaguacaaaauggugcagcuccuacgauugccacauucauaucacacauaagcauuucuucccaaaucaccucauccaaaaguugaagugauuagcuauuguaauccuccaaauuuaaaauucacggauacuuugaggaagauuuugcuaaaaagauuuuaccuagacaaugauucauuaggacacaaaaguaauguggcaccauccacaucagcaugguauaguaaacgcauuauccugccgaaugagcagagcacagaggcuugucuugucuuuuaccacugacuuuaaaguauauuaaaaacgaacuaucuaaaucauauacccagcaacuuaguacaucugaccauugcugcuaauucuggauacaucuuuccuaugaaacaggaaaaaccuaaacacaaaaauaauuuuaacauauuaccauuuuaucaucucaaguacucuuaaauguauaacaggguagaggguuaaaaaaaucuuauucaacaacacuucaauuuuaauucaucuuaaaaacuuuuaaugugaugcuuucuuuaaucugcuguuacugaaguuacucgauuugcuuauucacauaucugagacccacucuuggggaaggcgcuauguuuuuauggcaccagauuaaacaauaugaaggaccaucugaugugggaaguaacuucuauacacagagcuucucagcuauuugggccacauuacaugcccacuuggcaaacacauuuuaagauuaaggcuaagacaaguggaucagaagaauccaucuuauuaccacaaaggggucccuaaggaaaaggagguuaggaguuuaaggccuccagcuaacuagccuuaugaauuugagauugggaucucaucugugggaaaagaaacugcacuaaagguacucucugaugcucgcccccaccuauuauucuaccgucuccaccuuaaguuucacaaauagauucugaugugcguguuagaaucacucuuguuaaaagagguuccuacaauguagaaugccauacaaaauguuagguauucaauuacaaguacaccacucgaagaaaugaauguuuuacuaaauaacuaguuuuucagcucauuccaauauucaauagccuaugcugucaagaguuuuccuauuuuguugcugaaaacuucuuccuugcuauuucuaaugaaggaauaaaauaguuauauauuauaaacuaaucuccuuuauucagggaaaaacuuuaaauauguaugcugccagaucacuuacuagccccuguacccaaacagaauauaaccuauuaagugcuuauucuaguuauccuaauugacaacaacauuauuaaggauucuacuuagauuauaaacuuuauuuuucucaagcaagaguacuuucuagcaagaaaacauauauauacugaaauggaucuuaacacaaaagccuacuauacuauuuugggcuucuuuauccuucucgcgcaccccccacgaaaaaaaauaaaaauaaaaauaauaauuaaaucuaauaguaaaggaauuagaacuuuuaccucauuauucccuacaaagcuaauuuguuccuucauuugcacucucugucauuguaaucuaugacuuaaagaaaaugaagcaaaaaaauucuuuuaaaaauaaacaaaccaaaaaaacaggcugggcacaguggcucccaaauaccagcacuucgggagucugaggcuagaggaucacuuaagcucaggagcucaagacuagccuaggcaacaauagggagaaccugucucuacaaaauauauaaauuagcugggcauaauggcacaugucugcggucccagcuacucgggaggccaaggugggaagaucacuugagcuugggagcuugaggcuucagugagcugugaucacaccaccacacuccauccugggcagugacagagcaagacucugucucaagaaacaaauaaaauacaaaucaaauaaccaggaacuaugguagauuuuuacaauccccaaagaagaauguuuucugaauguauaaucuacagccaaauuaagauauuauacaaagauuuucuguguaauccucuauaaccugguauuaucuuggccaggucauuccccugcccuacccaccaccaucuuuucacuuuaagcuaccugaacagauaucccauucaaauccuuuagguguacacaaacaucuuaauagguugcaaagaagaacacaaaauugacuagauucuuuuuugaacaauuacauuuacaauucaccaucaaugacuuacuugcugggaaaaaaaacauacuguaauaaagguaaaacuagacuugcaucuuuucaaggagaaccaaagacuguccaaaaaccuaaugaugacauauacuacuuaucccauaggacacagaaauauaaugccuguaagcauacacaugucccuacauggcuggaaaccaaaagcguuaacugaaggguuuuaaagaaaugaccacuaaauaagcagaggagauaaauguaggucauucagaggcaaaucuguuuuaccacaagauauauggcucuccuuagcuacuaaaagcaaugggagucaccaaacauuacugaccucugaagacuaaaagcuagagaugaaacauucaaaaagaccugcugugugaaugcuacugcuaguagucaucucagucauucuucagguuguucuugcucacacucagugagcaaaguagugcccaagaaacauaaucaaaagggggaggaagucacaagagaugacuuggaagggaggaucgguaucuucacugcaccuacuauuuucaaaauuaaauucaaacuuugcuuuccuccaacacuaacaaagugacacaaauaugaguaaauuguuugaaaggcacugacaagugacuuuauuuacaaaauaugcauacauacauacacaccucucaaaacaaacuccuuuaccaauagcuauggcaaguucacaacaggggcuucuaaccaauuacaaaaguuauucucuuauaggucaaauugagaccaauacaaaauuaauaagcuuacuuuugaguuaaaaaacacugauagaaaaagauaaaaaauaugaauuacauaaauauuguuucaauggaguucuagauuguacacugacucuaccuaacuggcacaaagaaacacacuggaagagucacagagcguuuucagaaugaguaagggcugggaaccagacuucaaggaguuaaguaguaggaaguaaaacuacccccaccucagaacagagaggugagucaucaucaccaucuuauccuucuaucacuuccuugagacccuagguccugagauaaaaugccuaauugacuuuacuucgguuccuuacuggcugcuugccuauaggcaggcagaaagagagaggacccacccaacuggcuucuggaauuagcuuuuucccaucagcaauauacuaagaaagagaauuccccaauacagaaggacccuaaugaaauguaagacugagacaaguuugucuuggauccacgaacauccuuagaagucuuuccauguaaacugaaaaagaaaaaaaaaaaaaaaagccucucucauuucuguucaaauaaaugacugcauccaauauuaaucaucaaaugaaauaaucaacaaaucauuaguggaccagacuauacuuuacaucuucgcucaacaaaacaagcaccaauuuagaacauccugcauuccaccuucacaguaugacaauucccuccuucucuaccucccuugaaccaugagguauaccacaagaaguuccacuagccgaguacaguaguccuccacccccuaccuuauccuuggggguuacaagacccucaguggauaacugaaaccacagauaguacugaauccaacauaauauacacuacuuuuuuuuuuccgaucuguuaagauggauucuaagugauuaaaggacagggaacauguaccagccauggauaauguggacaaagggaugauucacauccugggcaggaaggugcaaaauuuaaucacgauacucugaauggugagcaacucaaaacuuauggauuguuuauuucugggauuuuccauuuaauauuuuaacacuaugguugaccaccaguuaacuaaacugcagaaagcgaaacuguugauaaugggaggacuacgguauuucauggcacaggcucucuucaacagauagucaccacuugaaaucaagaacuuaacacuggcugauauucuccagcacacccaaagcucagacaaagacuacugaacaacugguuaagcuugagucaucuuuaaucaagacaagaccuuacagcuccagagguagaagaccuuccucaucucaaucagaggcuuuuggaaacucccuacaaacaugagugcaaaguaggcaguggggauaagucuacacaaagcuugcauuaagacuuacccaugaaguauucaccuuuuucauuauuuuaaacucuuacaacccaggggaggcuuucuguuaagccccaacacaggaaauugcuuuucaguugucaauagccaacgucugaaaauaaauccagucacuaaguguggaaugauguacuugcagccaacaugcauuuggcugaugccaacagagaaggcaggaggccaagauauaagaccuaaauuuuuuuuuuuaaaaaaaggacuguucuacucaguaacagaaucugaaauaaugcaaaggcagaaauaggccacaaaccaccugccucucuagcuucaacauacaucagcaucugucucccaagguugcuucagaaagauauuuaaguuuucucuaacuacaauaauuguuccaguggucuaaaaaaaagaaauggcucuguccuguggguuucugguugggugguugacuguuauauugauggggggcuuccuugagggguagggggaaagaguacuagggaagggggagaaaaaaauggaagaacuaaaacuacagaagagaauuucuaacucgucgcucuuugacucugauugaggaauggcuuucugccaagauuuccuucaagugcucagcagagaaugaagugagguaacgagaaguagucuggggauguuacacacuguguccugugucccaagaccccacacggauguuugucccuggaugcucugacucucugggagaaaagaguagaaaaguaugaaggcagagaagacuuccagggagcaaaacuacuuggguucuucuuucugacccacuguacauacaccaacugccucuuccuccagguaacuugccaagauggggagugauaagagauugaaggcaauuuucaaaagaauaaaacaagcuugaaaccaggcagaacaacugcaaaggggguaagaugaagucccugcaaguagucagcaaucuggcaaaauauugcacaaauucaguauuuuaauuggacguuucuuuuacggggaauguggcaugaacuaaauuugaagccaggcuacuuauuucagggggagggguuggucccuaaagccacuuggagaggaagagaaauaaaacauacagaagagucuacagcccaaggggaaaaaaacuaguaucuccugaaaacaauuaucauaauuuacuuucaaaauacuuugguauaucaaauguuguaugauuucauuuauaugggguaccgagaauaggcaaauucauagagacacagaaaauauaaugguuaccaaaggcugggagcaaaggaggugggugaggaguuacuguuugaugguuacagaguuucuaucugggaugaugacaagguacuggaaauggauaagggugacggcugcauaauacugugaaugugcuuaaugucacugaacuguaaacuugaaaagguucaaaugauaaauuuuauguuauauuuugccacaauaaaaacauuucuuuuuaaaguuuagaauuaaucugaugacacgugugcaccagccauuuaagcuuuaauucuggguggucaucuaacauacuaucauuaaugcacaauccaggauuaguuaacuaguauaauacaaguaggcuaaaauucaagugacuaguguaagccuacauacuauccauaccuaaaucaacaaccaauucucugcugauucaccuaauggaugucaaaauaggguuuuguucuguaagccaguuauuuguuaauuagcauaacgaguguuagaaauggagucuuaccgguaaaauuaaaggaguucaagauacgcagaugggcuaaauuaguuuagagacacuucccaccuucguauaaacagggcacaaaauccaagguggcauaauccaaggugguuauaucuuuauggagagaaccccuaaauguuaaaugguccuggguuucagucuuuguuuaaagggauuucuuuuugcaugaugcaaagugagggugcagaacgugacuuuugggauauuguuagccuccggugaacauuucauuuaaaguguguucaaagcacuuaaaaaagaagagagaagugggacuuuaccaagcuuucagaaaaggcuucuccaucaauuugguccugcuugcuagauagagguuucuauguguggugggaucuggccugagaccuucuuucauuauaaucuauagagcaacuaacgcucacccuuccuccuuuggugccuacuaacaacuacgcaaaauuaccuaagagcuguuauucacuauacuaacagguccauuuaauaaacccagucucaaggagucacuggucaugaacacaguggccuccaaggguacugucuuaaaaaaggaaaaaaaaaaaaaagacucuuuaaaagucgguuguccaacuauaaaggcuaggaaagaauauuagacauccuccuuacuuugauggcuauauccaaauauauuguuuucuauaagcauucagagaacuaaaauaucaaauagaguaagaaacuaaccccagaagauuccauauucuacuuuuaaguagcacaucaggacuagcuuuguauguucuagagcuggggauauaauggaauguuaucacgccuuuuugcaaaggcucccaauuuccagcacuuaaaaaaauacacauauugauauaaaacacaguaacaaaucgguauuaacaauucuguauuuuaauccuauuccaauauguauaaaagggcuuacccccauaaaaaaaggacaacaaauaauaaagaauauaaaggucuaaaaacaaaccugguauaacauuguuagauuuuaagauauuagaucccaaaucauucuacuugagaagguaguacacugucugcaccauauaauggcaaaaucacuuggcaccauguuuaaaaagagcuaaccuaauacucagguucacaaaagaaaaaaaagacaauuuuagaggcaggauuugggaagucauuuaggagagcccuugucuacaugagaagaugucaauugauuugauacaccaucagucucucauuuauauucaaaauguuuagauacauuuaaaguagaauaagagcaaacuacaauucauuuaaauggaaugaaaaaagcucccauggcuuacuuaguaccaggguuaggaaaaaggauucguacgacaguacccuuggaggcaacuccuuaagacuggauuuaaagcauuaaaaugugaggaaauaaaacuguucucucaggcuccagugaccuuaaaaacagugcagugauucugauuuaccaguuuacacacagcuaugccucccuuaaacuuuacuuuaaaaggaggauuugacuuucucaguauuaaguccaaaggucaaacagguuguaaagagucaagggccccaucagaucuacucuacaagguaauaaacauucaagucuaucaucccucaccaagaaaugcaaauuuuuguugagcuagaggaugggaguugggggugguggauacaggacuuguacgccauacacauuuucccuacaaaaucaaagcaguauguacaaaacagaguuccaacaaaaaguacaaugaugagaaaagaacucauuaagagcuaaaaauaaacucuaauucacaauaugcauaaggauuuaacaaaaaaggaaaacaagauguaaaauugcaucugcuaaguuaaccauacccucauggaaacugcccccucccccauacacacaaacugaaaucuguaaagucugugaugacugaaugaagaaaugcuuuagauguuuucaaugaauauuucaauggaaaagaaaacaaagggauaguaauuuuuuuccucagccuucugaucugcuaacacugcaggaauauuagguuuuugaacaucccaaaacacaggucucuguauaucuagacuugaacaucaucuuugauaaaaugagacuauuuaguauaguauuuacguuuuauauuaaacggauacucaucuuaaggaagaugaugucaauaaaaguaaaaauaagccgcaguugguuuuuaucuaaccaacacuucauggcucaauuuaacaacuugcugaccuucgaaagcccaguaauagcucacuggaaagcucacuugagagcaccuucauauuuuaagucaagcuaauucauucugaaacauucacacaauaccacauagagcaauaauuccacacuccggugcucuaguucauaaaggcugguguaauaucauuaaucaucauucugggcucccaaguccugccucgcacuuucuauucuuacuuuguuccaccccuggaaaaucaauuauguuggucaaaucaccuagaaagcaaaggauggaggaugagcuuugcauucuucccacaucaugacaaacuccaagaaaucuaggacaacagaucuacuucaagauguuuuucaaaaacuacuuuuuaccuauggggggaaaaacaaaagucugcaacugucacguaacugaauggguauuaacugguaagaagaggacaggaaagagagacaguaccccugugugcuagguacuuuaugaaagaaacugacguucagagucaaaaagcacacacaggacacaacacaaauugaguggcuaggcuggaauuggaacccaaguguaacaauguucuaagcuaaaagcucuaagauuaguguccaguaggccaccucccuagcaggaggaagcaaagguauuuugauucaaacuuaaucccaagaacuugaucccaaacuaaguaacaaaccuaguguacacagggguuuaguaaauccuacuaccacuuaagaaacuuuuuuuuguuuuuuuuuuuugagauagagucucccucugucauccaggcuggagugcaguggcucacugcaaccuccgccucccggguugaagcgauucuccugucucagccuccugaagagcugggauuacaggcacccagcaccaagucuagcuaauuuuuguauuuuuaguagagacgggguuucaccauguuggccaggcuggccuugaucuccugaugucagaugaucugcccaccuuggccucccaaagugcuggaauuacaggcaugagccaccauacccagccaaggaacucuuauaaacacagcuuaaauacuucugucuugcuuuuuucccccuuaaaggaggcauaagguaaaucuuuguucuaauuuagaacaauacagaaugaucaccccucgauuacauaaagaugauauauggugucagaaauuacugaguggagucugaaaagaugguuuuaacugcgaaucuguuucuucacaacacuuagagcagcaaaugcuacucugugauuuacagccccucaaaaaauauuugauuacauuucccaacaccaauaaaaggggcauccaaggguuuugaaauauugacaaucuaaaacuuuaaagagccaaaacaaauaccuuaaggacuaaaacaugcuaauuaagccacuguauagaccugacaaaucgaaugacacucaaauaaaaugccagaaaauaucuguuaaaguugaccuuuugagcuggaaaagcacacucugaggguuuccacagcucucaacguucaguagcagcaguguacucagcugaaagucaauuaacuuagaacaagcucaaaagaaguuggcaaauuuugaagcacaguuuuagcuccaauaaucaacuauucuguucaggaauauuugaaaggaaauguuccaacagguacagaauaaaagugcuucggucuauucugaauuuaaacaaaguuaaaaaaaaaauaaaaggcugguggccaaagcugugucauaguuaagguagugaaauagaaugaaaacugucaaaaacagguugauuuuguacuacaucauaaaaaugggggguauaaaucauuuucauaccaaagaaacagaauuuuaaaauucuauaaacuacaaaaaaaagaagcaacaaguucauaucacaauuuaacuguuuuuuaucuucuaacugaacuauuuccauuuuaguucaccaucuuccucaucgacauuuuccaucauuccuacgacaagcgcuuaaauugagaauggugucucuucuauaccaccaaucuccugaugcaaaguaaacaaagacuaccccccagaaaaggucuggaauagcaaacagcacacgugcacucuuaugcugaauuauaaaggggcaaauguuacaagagaauuucaacuguaauuuuauuuucuaugaauuugaauauguuuacaaaguuuguguuuucuaucaaaccagcaaagcaacaaagagaaagguuacugaagacuauuccuaaucuacugguaaggcaaauacggcuauucuaaaaguuccucugauaagggcuaggaaagcacaaaaucaaaacuccuaaaccucauuuacaccauagguucaacuuuauuuucccaguaaacacucuaagacagcuguuggaaaacuguauaacugucucgugggagugacacauauuuuuuuuuacauuuuauucuaacggaacaaaauaccaaguaacacaaauaucaauaucaggaaaucagagaaacaaaucuggaugauuaaugaauuacuagagaagaauauuguuucauacuuuucuguauccucaaauagauguuucuucauccuagcaacuagccauuaaaggcuucauuaccacagguuaucuaaagaagcagcucuuugauuuaugaagagauguuaacugggaauuaacuuacugaauggugaaaagguccagauuugccaccccaaaauauuccacuuuggcauuaaguuuuuuuuuuuuauuauuuuuuugugaaauggagucuugcucugucacacaggcugaaaugcaagugcgguggcacgaucucaguucacugcaaccucugccuccuggguucaagcaauucucccaccucagccuugugaguaccugggacuacaggcgugcagcaccaccacaccuggcuaauuuuucuauuuucaguacaaucaggguuucaccauguuggccaugguuggucuugaauuccugaccuccggugauucgccugcauuggccuuccaaagugcugagaauacaggcaugaaucacugcgccuggcuggcaucaaguauuauuuuaggcugaggaaaauaagaagucaacagaugcaagaugaguucucugcccuccccuuuucucccuaaaagcagaguauaaauuucccaugggaagaugucucucuguccuguaccaguucagaaguaagcgacucauuacuugagacagucaacaucagauuguuuaugcauacaguucuguauaaaccaaccuuguuaaaagugcccuuaucuugucauuacuuaccccuacauauuuucugaacgcuuccccaugauuuccuauuccgcaaaguccaaaccuuuccuuuguuaaaaugguauauaagccccccaacccugaccacuuuaguuuuauaauacuuuucugucaacucccaaacacaaaauacgagcaaaaauugugugccauuucuccaauuaauuuccaaguccccagguacuaaacaaaagaggacagaaguuguuuuuccuaacaaugauaaagaacuguacuguauuugauuucuuaaaauguuacaaauuucuaguuucaucauccuguaaucuuuccacuaaacuaaucaaggcugacacugaaaauuguucuauaaaaauacccagguucaaguaaaaagugaaccuagaagaauaaauguuaaagacuuucuccaaaauuuuauaugaagcuucuacagugauaacaccaaauuuuuuaaaugacugcaagaccuuuggcaaagaaacaagauauaaugaaaaaauaauuaaguuuaaagauacaucaaugaagauauaaauaaaguuucuccauuaccuuuugccuaugagagauguuccaaaaauagagguuccacaaacuugacacaaauuucauuuuauacaaacuugggcacuaaaaucuaaaaauagauucaaauguacuguauuccacaguuaacgcacugcggaccaaagcauuuaccccugugcaggcaucuccuuuccuacagaccuaagaacacacacaaccuuucugccaucuuucuaauuaaauagcauacagaguuugcaaagugagguguuuauuaaguuaccacccacccaaccacccugcuguuuccaacuacuggucugcaagaaucagaauucuugaucucuugauacuauggacauuucacaugcucacuguacaacuguaacugacauacaaaaucacauuuucaaauuaauguucaucaaaacagcuuuguguucacugugauugacucauaggaaauaagugcuauuaaauuugaagguucccauuagucuaauaaaauaccacuuaucuguuucaauccugaggagcuaagauuguauuuguuuaaaaagaagagaauccuaugccauuaaaauaguuuggaaaucacauuauuuugauagaauaaagaaggaucaaaacuagcuguaaaauucucagcaagcagagacacaagauaaaccuagcuaagaacacucauauuaauaaaaaauauuuuaagauacuagcccuaaggcgugcuggggcauggcaggagccuuaucaugcaaggcacuaccuacucagagguaaucaacaucucuuugggcccucuggaauuuauauuuggguuuuuguuuuuuccccuuuugucaaaguuucuaguuagcagcugaugaggucaguacaagaccuaccucaaacaacugagaguaauggugaaauacucauuaccugaggucuuccaccaacuacuccucuagccauucuuuuagaagaaaggaaaaauaacagugaaagaacaaucuacccuggaguuucaaaaaccuaauuacacuuaaacacacacacacacacaugcucgcacacgugcuuucagcaacauaucagaucaguaaggacacagccuagugacguaaacucaacaugucuaguucugaaagcuaggaauuaacucagagaccaaugcugaagaggggacagcacuuuaaacuuaaacuuuccaaagaauuaaguacugcaauuguuaacaccucuuccauaacgcccuaaaucuagaauucagguaaaccuggaaaucccugguucaaucucccuacaaaauguuuaagacauugauaacuccuagcuaacgaguaccuuccagguccccacuacagauucugauucaguaggccuggacagagcccaggaccgugcauuucuagcacucauuacaagugauuccaaugcgggaauccugugaccauacuucaugagacacagucugauucccaaaacuuuuuugggcuucaagaucaccugggaagcucucugacaacagauuccaaaacucccuuaggugaguaggugaggauguagagccaaauuuggguaccaccgggcuagaauaucaaguucacaaccauagauuauaauguuucuagagaagcacagauguucuuguucauuugguguauucgucaguccuuacugucaaaaaccuuccauucuccuuccagagaagacacacucgccagaagaugcccucuggauaacucuguaaaaaucacacaucucucuauaaauucaucaguuggccauuugcuucaucuuuaaagagugagcucuugccuccaacaaguggcaaagaggaaacauccagguaaagcauaagauaaucagaauucuggucccuacucuaccgcuuaauagcucuguggccuugaacuagucauuucacaaaccugggccucucaucaccuaugauguuuggggcaaagaagggagaggguugguuaaggucaccucuagggcuuuucugacuguaacacuuuauuacucauuccuugcaucauaaaauccauuucguucaucuagaaugcagcaucagcaggugucaaggacucccaagugcauuuaaaaacgcaaagggauggacuaaagucagcuaagcuguacaagcagcagaagcuucucaugaugaaugccuauagauaggaaacaggcugaagcauacagcugggcagaagcccaaagagacggaccugacaaauaacauaauaaauagaacuuagucuagagagaagauuauuguauuugcuacugaagacauuucuuaauguacuucccuaauccucacucgaucaaaauagugacauuaauuugcuaacacugacacagucuaaaaguuauacacucucuucaaggacuuaagaagcacacacuuuccuaacuagauauuuuuguuccuuagauauaguuuccugauucagcauuaagaaagauuuaagaaaagggaaaaggaaagauuucaaaucuuccuguagagugacuccagaguuuuccuguaacccaauuaacgcacaugcuccuacaaaaucggaauacagaaaugggucccaacugcuucccaggagguagaauaagcuggauaauuagagaaggaccaaagaacucuggucugucccuaaaauacguacugagaaacugcacaagacggguaaugcuacacaccacaggacaggguccaaagcuccacaaauucuuucaaaaccuugcuagagauacauuaguacuaccucuuacgaaguaugccuacuuuucaaaguacaaccacucagaacccagauuuagauacuaccauuuucuagacuauuuuacucaauagaaguauucaguaagaaacucagaaaaaaaaauauccuaaagcaguuuaugcuuaaguuaaaugagugagauccuucuaaaagccauuuuaacccauauuacaaauaugucagugguccaaaucaaaccaagauuaccagaaguugagaugccuaguguucagauuuaccuacuccacuuuugaauuuauuaucauauauguuucuuuuaggaaucaugcucauauguuauugaugugaacagguuaaacuggucugauaaccaguuaacaacaaaugauuucaaaagcuuuuauagcaccauguucaguguaaucuacugucagggagagauacucacucuucccacaguccccaaauaggcucuaugaucaaauaaggccggggaacuauaauucaaacagguuuucuuuacugcuggauuuuucauaguucuuaauacagugauuaucgaguauggaucuuaaauaaagaacuacagagugcagcacuuccuaaacuugucugucaauauaauacuuauguuaagaaauaauuacuaguaucucaccaaaugaagguugaaaaacaucuuucaaucuuauacacacuaucgugggaaggcaaauuaauacaccaaauacacuaugaaaaaugguaugaaaguuccucaaaaaauuaaaaacagaacuaccguaugauccagcauccccacuacugcauguuaacccaaaagaaaugaaaucaauuugucaaaagggaugcacgcauauccauauuuauugcagcaauguuuacaacagccaaaauauggacucaacccaaauguccaucaaccaauaaauggauaaagaaaauaugcuauauauacaaaaugaaauaccauucagccacaaaaaagaaugaaauucugucauuuccagaaacaugggucaacuuagaggacacuauguuaagugaggugagacagccaaauaccacacgaucucauagguagaaucgaaaaaugcugaucucauuggaggcgagagcagaauaguggguaccagaggguggagaagagaggaggaaggaaggagggggccagaugguuaaugaguacagggucacuguuaaaagaaauaaguucuggugugcuauuccacagaagggugacuaugguuagcaauauuguauaguauacuuccaaauagcuagaagagaggauuuugaacacucucaaagaaauuaugaauguuugagauuuggaaaugcuauaauacccugcuugaucauuacacaauguauauagcaucaaaacaucucacuguacuccacaaauuuguucaauuauguguuaacuauauacaaauauauacuauauauaguaguguacacguaauauauauguguauacaucauauauaguauuauauauauauauauauauauauauauauauauauaauguauagaaacgucuuacaucuuuagaaacaucuuucaauacucaugaccauuguggaauuucuuggggacucuacuugcuuaccaaauauuuuuaauagaaauuuuaccacaguggaaaucuccauuacauccuuccccucaagccacugaaaagacaacaggcaggggucagaggugaaggaaauggaugagaaauauuuacacaguuuuuuaguaucuagguauguauuaaagaauacccauguguugugcuucuauuaccaccgucuaccacacuaaaguuagagaggcaaaggaggugaagauaaagaacucaaauuuaucccauuuugccacauaacagcucuaaagauucacaaaagaguaagauuaauucaagauugacuagaggugagacgugaggaucuguaagaugucuccuguggcagaugccuaauaugaaagauguaugauuugucuaauauuuucaucuuauaaaaugauaaaauguaucauuucguaacaguuucauaacaaaacaugacuuuugugcucuguucaugcaucuuucuuuuuaauaguaaggggagcucuacuaagcaaucagaaauugcaucauuugugucauagcccucaagucauuuaucauauuuuuaucuuuuauauuaaaaagguugcaaaauccacaugucagggguguuguuuuacuuuaaaaacaaaagauaacauguuuaaaacauguuaaaaagauguuuaaaaacaucacgacagagacguaagagcagccuuuuguucuucaccuuuuucaacuuauuaaaaacacuauaaauuucacauaugcuuaucacacucauuuuggaaaagaaauugaaaaaucucauccaucugauuaucaguguucagaaacauaagaaccaccuuccuaauaucauagugaacauuuaagcaacauaauuaaaauauaauggccguuugcuauggaucaaugacaaucaguuuguacuuagcuuuuuaacuugauuucaguaaguugucucugugaaucucaaucuguagcuugaggaaauaugauuaugagccaaguccaggggcuggcucuagaacucacuugcagaucuuggagagaaugagcccuaacgauuaacggaauagcucaaagucccauguaugaaaaagucaaaagugaacuuagaaauggcccaguguuacccccuuuuucucugccuuuuaccuuauuuugccaauggaaaccagaagucuagggcugacuuauccaaugucacaugacuaggugagaguucagacuccuggucucauucuucacacugccuuuaaguaucuuuuacucauuucaaauauuccauuuuauauuuuugguuauaagcuuuguaaagcaauuugguauacacuaucaaucaaauuuaauuaacaugaaaaguccacagagucugucuaccuucguauauuuuuaguguuuaacuucauauguaugucuaacuucauguauuuuuaguguuugaaaacaacuccugcaggaagcauuaacccuucuaucccaagaacgugcucuuuaaauuagguuuugguuuacucuaaaaauuuagucaaaucuuaaaaaauacuaaggagauuuucaccuaauauucaaaauguacuauaauuaaggcuuuaucuuuauaacaagaaggacaaucauauaccauguccuuuccuuguuaaggaacggaacauaagaucucaucacgcuugguauuauaucagugaaaauguuuauacacugacaaugugaacauuaccauuuauuuuaucauauauaagcaaaaugauuauauuaacauaaggaaaacacauuuuaagauuuuuuccccucucccaaacacauauuguaucucacuguugaaaugcuaacuuaaauacacucaggguacuaaaagauaaaaguuaacaugacacuggcuaucccagauacauauacuuuuagaagauuuuccaaagauccuguccagaucagaguacauuaaaguccaguuaaaauauauacugcccccaaaauaguuuaugauuuaaaaagaaaauuuuaaacuaaguuucauauugcugauguaauaacagagagaaaaucuagauauguaaaauugcagcagugaauuauuuacaagcaguaaucuuauuauuuucuccuaucuugagacacgauccguuaaauauaaaucaucuacauaaaacugcuuaccuguuauuuugucucuuacaagcuuacaggacucuauuucaccaaugcucccaaagagacucuuuaguuccuccugugucauguucugaggaagguaguugacuauuaaguuggucuugcugucuucuguguucccagagucaacuggugacgaacaguuguuguuuauggugguuggaccauuggcuguguuauugcaaguuggcccauuagacaguuguguuuccauggcagcaauuaccugcuaaaaacagagaaaacaagaaaugucagaauucauauuucacaaccuauuagagacuccauccaagaauuuaaacacuugucacuaaacacaagucguucuaaugaaauuacaacaaugcuucaacaaaaaguguaauaccuacacuaauuuucacuucauauuaaccuauucaucuuaagguuacaacuauauuuucacauacauauuccauacaugcauauaagcacaauuuaaaucuuaaacauuuucuagaaucacauucugggucuauucacauauccuuacucaccugcaguguccacagaugagaaaaucaaguaccaaagggcacagaauugaacccuaacuaaaaaucauacuagaaaauaaaagugcuuaacaugcuacaaaaaugaacaaaaaaaugaccuaccuaacucugaagagauuuucaguuauccuaagagguucaauauucuaaaacugacagauagccauuaacuuaaaaaucaaagagcaagaguacuuuuaaaaauauaaauuugucaacauguacuguuuugguuacauauugaaaacguuuuugauggacaauaucuuaucucuaccauugguaagaaaaaaacagaugcuauauuuuagggaguggaaaggaacuaacuguaagguaacuugggaaugagcuaugaauacuuugucuaacugguagaaucuaauaggacacuccugucaaccuuggcagcuaaaaauuaccaacaaggugacugaucuacaacaucaaaauaaaauccccaaacacuucgauaugguguuucuccuugacucugcuuuuuaaugagaaaaaagaaaaccuauccagucaaugaaaacaacaauguaaauauaucaacuuuugcaaacagaccagcccaaggaauucucgucugagcacauaagccuguugaaaaugcaaguaauaggguaucuauaaacuccaaacaccagauaaagaacagaauuggggaaaauggccucaaacuguucaggcuacucuacaaaucacuuauuaagcaguauuaaaucuaguuuccuaaaaccaauccuaugcaaaagagucacaaaccacagccccaaauuuuccaaaaucauuuuccacuaacuaccuaucuuuggacagccaagacugugguggaaucuaaaaaucaacgcaucacugaaaggauuauccuucauauugcauacaucucucaccuccacaaagaacugcuucucaaaacugacaauucugaauugacgggaugcuaguuuuagggaagcuuuaacauagaaaaggcaaagaacuugaggcaaagaaaaaaagcaaaguaaagggaaagaggguuacaaggaaagagaaaaaacugucuuuuaaaacacauauugccuaagaaaaauaaaagggcacauuagcagauaaacauauaggaagaaaucucuacugccaggagauguuuacaaaagaaggcaguguuggacauauugagacuggucagacugaacaagaaucagugcugucaugauaaaaaaacaugaggcaaaauccagaauagcuuuugaaauauccaacaaccuguaaccccucugugacuucauuuccuugucaaagaagugggaauuuauucuacaagcugcaagcuguuucucuacguaagcuaaguuuucucagggaauacuuaaagggaugaaggaaaauaaaccuuuggaaaucuguauuuaaaaaucuuaaauaauucaagauauggguuuuauuauaauuagcaaaucuauuugaauuugaaaagggaaguuucagauuuccuaauuaaacauaacuguucugguuuguagaauauuagcugugggucacucuuuucacagcaaaaauucuucugggguuaacccuugcccagcaguuauggaaacaaugagcuacaagauuaaaguggccaaagacacuuaaaucacuacugaaaaguuuggauggguguagaaacuacaagagacccgaaugggagauucggacuaaagcucauugggauagcauuugaaauacaaaguguucauugacugaaaucagcaagauuuagaaaggacaacaaacacuccucacuuaauugcacauuuauuuccauguucagguggcaagaaugagcuccuaagccaacauucaagugaacagcugcaguaggcugugugcgcugaaaauuacagcaucucucugcuauaggaccaucugcucagaauaaaaugauacuaaugugcuauauuuuacaaauaaugcauauuccauugauaggcucaacacaacuguucacagaaugcaaacucuuucaacaguuacugggcaaauaauuuucagccagauuuacaauuucaacuuuuuuuuuggagcauaaagaauuguaaauaacuucaaaauuuaguaaccaaaaaaauacauaguaaacagaauguauagaauuacgguaacuuaguauucagaccauaccaaaacuuuuuuuguuuuuuuaaaaaagcuugucacucuuuugagucugcgcuaaauccuaauuuagauuguaaaaaaauuacauacgagagcaugguucugaugcuacauacaccacuacaguuaaaauugcaaugugcuuuaaguccuaaugauggccauaccacaauagguuaaauguaagaauaauuaguaugccaaaugaaagauucaaguguuugguauggccucagcacuccuccaacaugcuaaaaaaaaguagccuacagaauuuaagaaaaaucccacagaccccgguccaaggcucugcugcccacgaaccacuucuaagcagagaagccacaucacacagucugacugccauguuaguuuggaguugccgucugcaauauggacacaaaaaguaccguauguuagaugagcaagauaaugcaacaaaucaguuuguacaaaauuuacagugauuguauugauauucccagcacguccaugcaguguggcuuaauugaaauugaggcaauuccaaucuaaucuuuccaaauucauuucaacauguaguuuucuugcacaaauauaagcauuuuuaauuaagagccugauuuuaaaacaguauuaacuaguuaucuuggcaucuauucugaagaacuaauguaaaccacaccucaaaaauuuaaaaaauaaaguaaaauaaagcaaaauacugcaggcugucuuaucucuuaaggaugugggagaagggaggaaaugugaaugaaauuuuauagugggaaaaagucaucaugcaauuccuaagugauugguuugcauaaaagcacucuuuccccaaaauaucagaaagacauuaagagaagcuauauuugcccacacuguuacauuauacuauaaaugauccuuaauccugggacuuaaaauuaaaagugaaucgaaacccugugagguuauuuugccacuacagucaaacgguuucuaacaguuucaaugagaauugcucacauauacuaagaggcaguaaaccagcaucuuucaauugaaauaauuggaccgauaaauaggauuguuuggaguaaugcucgcauaggaugucagcuuugucccugaacgaaaucaagugaacauuuuuuaauauguaaauuguaaacccagcacgauuugaaauuagugcugcuaugaggccuccaauauaguuaaugggccauuuaccacuuauugaaacuugcccaaauaccaaacagagccaugauauuggcacaaaagccaaaguuuacuuuuuuugccauauaugcagaugcuucaaauggucaauauaaucagaaaacuuaguuucuaaaaauagacagugaauaacagaagagguccaaaaaugucuuuuacuuauugauaauuauaaaaauuuuauccugagaggcaauccuggcugugauuuacucuugauauuagcaaugccgccaguaacgauggauuccacuuucuggcaucuaucaaaaaggauuaacauacuuuuuuacaggaagccaugaaaauauuuuacucuucuuccguucucccacuguaacaagagauuuuggucugacccuauguuauuuuucaaaaaacuacuuauaguuuaacugaaccugugaaaaagugcuuuacacccaugaaagauuuuucauaagaacccaacuguaguuaagacuacaugagcaggaccacacccagcaggguaaagcaggcauaaauguauguccugaauaccuucaggaguucaaucuaaacauugcucacuacauaaaacagauuuuaauuuaacugccucagucccuucuauuucauaggagguggacacuaaugagcuaaucuauugacaccccucuuucugaaagccccagggaggugaacaaucacuuuauugcaccaacuagauaggaaggcuguguauggaaaaugauucuacugcacuuuuacauuucaagcaccccagacagucuucuccgcuugaggcagacacauaccuuuaugggaaguuauaaauaaguugcucacauggcccuuaccuuuaugcuggccaacaauucaguuacuaaaaauguaaagcuacuuccccuucacuuaaggacaggcaauucugcucuacucaaucuaccacagacaacugggcuguguacuauuuauagauuccacuggcucugaaacucuucggaaagaaaaaaaaggccauauuccagugaaacagagccauuaauuuuaaggcuuaaaaaaauaauguuucaauauauauucuccucuuaauuuagacaucacuugugccaauucagacugcuuuuccuccuguuauuauccaaguaauaauuuacgaaaaggcacuuuagcauagaugaaucuagaauauucuaaacuuucacugggcuccaagguaaaauggcuguuacuauggugaaagcguagguuuuauugggaaauagaagauugucucuacuuuuauacacacagguacuuccaaaaagccauaaagacuucuaaacuuuuuauuuaaauaauccuuuaugaauuuuaacaucuacuguuuucacaauaguggaauuuagaaaauaaaugcuuuauaucucauaucugggaagaguuaagaauuugagaagucaaacugauccaauaguuuccuggucacaugagagaaaagcagucuauauuuucuaaucuuacaauuaaaaaauucugcaaacuaagguaaucagcuucuucacuauuuucaaaccucuugcagacagccacuaaaccagguaguuaaucaaaagcaucuuaaauaggccagacucggcggcucacgucuguaaucccagcacuuugggaggcugagguagguggaccacuugaggucagaaguucaagaccagccugggcaacauggugaaaccccaccucuacuaaaaauacaaaauauuagcugggcguggucuguagucccagcuacucaggacgcugaggcaggagaauggcuugaacccaggagggggagguugcagucagcagagaucacaccacuucacuccauccugggugacagugagagacucugucuccaaaauaaguaaauaaauauauccuaacuauauucugagaguuguuauuaaguucacucaguauaauguugcgaggagggaaaaagguuccauagccuagaaaccaccugauuuagggaccagacuucugcggguuaaagucauagcagggcugcugaaagggccaauacaaugaccccuggugaggcugcgccuguugcuccagccacuccauugccauggucaacauccugaccugggcucucaucuucuucaggaccagcaaauuaaagccuccaaaaggucccucucuccucauccuaaucuaccuuaacaauguucccagguagacuuucuaaacccucccacagcucccugcugccuaucaaaugaaguguaaacuacuagguaucaacagaaauccuguacaacuacuuuuaucagcccacuuauucaagcaccuuaagaucugaacuacuccuugucccucaaacaguccaguaccuucacucuucuagcuuuguuuaugcagucccaucucccuuauucaaggcuccauccaaacccaccccaucuccauuucagggguuuguacaaacuaagcauugaaaaagcaaagggcaagaacaguuucuuaaaaauuggagacugaaagagcaaaucccucccuaaauguguacaaacuagguaacuuuuuuuuuuuuuuuuacuuuuuacaaauacauuuaaacuauaaauuggaaacacaaauaaucaugaguggcucuaacuuguuuuucuaucccaccaaguauuucaaaccagaaguaauuaugaaagcauauuuucaaguuuugacgcacuccaucagccacccucacccacugaaaucuaaauuccuauuauaugguaaaaggaaaccaucuaccuuugugaaaaguuguguauuuuuauuucaacaaucuaucacacuaacuacaaaacccuggaagacaagacaaauccaagccucuggccagcaggguuauggauaugggcauguggaauuuggguccaacuucaggaaaauggcaaaaucaaagguaaaugcaggaaaauuaaacagaucuugaagaaggcauuuagaagcacaucaugauuaagucguggaucaccagugaucuucauacuaacuagaaaaguuuaggcaaacagaaacgauaacaucucuuaaaagaaucauggcuagaggcaaagacaagcuuaucucucaggcuggaaagguccagccuaaacagagugaacuuggucucuacacuuauuugcaacuagaagcuuugaauacccugaguauucaaacacagcacaccaggacagaaucagcccaguacaaaggccuuccuucugaccacaucaaaccucucccuaaaugccaaguuacagaugaacagaagacauuugucucuaaaguuuuagagccaaacauacaaaacacaaacaaacaaacaaaaaacaaaaccaggcaucacaaccuuuaccacaccauccuuuggggaacuugcagcagggacaaaagcacuccaaaauuggugaaauaagucauaugagcuuauagaugacagcuggguaggcagucaaagggaucaucugcccgacacacaccauuccuauagcaaaugcuuuaucuuucccauucaaaucacuaagugguauuuucaggauauguuugugguuucacuuaauuaagcaagagaauagucaaccaagugcuaaaaucacaaggcuaacaaugucaguuacaggaacaagccauuaguuuguuuucuuuaacucucuuugcuuugugauuccuaaaauaaagguuuguagcuuuaaaugucaaaggauuuauucaaucuagaauccuugucaauucuccagcccacccacauaccauguuagcugucucacuagcucuacgaauuccucaaacccacauuuucagccuuggggcuaacaacggcccaagaacuugcagagacaaugcacugaacagcugcacgcgucauaaggagaauguucuuuggcagcaaacacuaacguuuuucugucucuuggcccuuuaugacuucuacggacaaaguacacagucuccuucaugccagucuuucugagguuuuguaguuucagagcuggcagguucaaaagcuuugagguuagagagguaagauaaugaguuuagggucccaaguccuucucuucagucuaaguccauuacagguauccaguuugagcaaugggaaaguaaagaucuggcgaaaaagaucugcuuaaguuucauguuuuguucauucauccauucaacgaacaucuccaugcagcucccacgaauucaggagaguccugagguacagcaaugaagaagcaucuuggagugcugauuugcuguggauggugugugcagaacauauacaaguaugaacacauagaagaaaacaguacaucagcaauaaguaagagugcuguggaauacauauagagaagaauaagggggguugaaaauguggagaugaagacggguaguuuccagcauuaaacaagcaggccucaaugaaaaggugagcuuugaaccaagguuugaaggagauaugggcuggcugcugugauaggaagaaaaauccccuuccccucaaugucuacauccuacucccagaagugugaauauguuauguuacaugacaagggggaauuaagauuguagaauuaaagcugcuaaucagcucaccuugagaaagggagauuauccuugguuacugaggugggccuaagguaauuacaagguuccuuauaagugaaagaggaaggugagacugucagggugaugaagcaugagaagaaaucgaaaggacauugcuggcuuuaaauggggccaccagccaaggaauauaagcagccucuaggagcugcaaaaggcaaggaaacaaucucucauaaagacucugggaggaaugcagcccugccaacacuuuaaucuuagcccacugagaaccacuuuggacuucugauguucuucggaauuuuaagacaauaaaucuuguauuguuuuaagccaguaaauuuaaaguaauuuguuagaggucuaacaggaaguaaagacagcccccauggagauaucuagaagaaaagauucuaggcagagaccugccagugcaaagcuugucugcugugcagaaugacaaggagauaacagggagaguaggaggagaugagucuaagagguaaugaggccggaacacauagggccuugaaggccaccauaacaaaaaaggaaacuauaaaagguuuucagcaaaagaguagcauguggcuacugugaaaauaaauugugugugggugugcaggaagacucagugaguuuggaaacagaccagucaagaagcaacugcagcaauucaggugcaggaugacagugacucccaccagggugaaguuggggagaagucaucagauucuggauauacccagaagaaaacacauuauuaaggugcuacauuuuaauuacaucaguacacuguugaaauccauugucaaaaaacugguuuagauacuaacugcucacauuccuacaaaccaccaaaacauuuacuaugcucuggacacuaagaacacaagaugaauaagcaaaggaagagauuuuauggacaguugugccuuaaaagaaaauaaggauauauauauaaaucuauauauagauauauauaggaaacccaacauacaaaaauuuugacuuuauaaauauuaaauccagaguuauucacuuuaugguuggauauucacuauucacuuuauauuugcuacuaaaugaauccacugccagcuucuuaaagaaucaacugauucauuuaggagcaaauauaaaaucacaaaucaguagcuuaaaacaugcaacuacuacuaaacauaguauaucagaaaauugauuuguaaucuaugugagcccccuuaaaacuuucagaauucaaaguaaaauagcucaaagcucuccccaaaaguuuaaaaacaaaguggaugaagauuagauuaagucacauuuuguaaaaugggaguaaacuuuaaaaucuguauuuuucaacagggucauuuauauaccucuacaauaguaaagguuaagccaugagauaacucugucuugguuauaggcuggaauacacuaaaucauuaccuucuggugaugaaucauuccaaccccauucuuucauuccaaccuaaguggacccaauuaauuuccaugccauuauuuggcaauagaaucuaaaaagggauaugaguacaacaagaauaaaaucaacuacucccucaguuuuguggcagagguuuuguuugguauaggcagauuaaucugaauugcuaaauuaagacaguuaacauaguaaucaacacagaaauuggauuaacuucacauucuucuacaaaagucacagcuaucaggaacccccucaggguaguacaaauugugaaaggcugauuggaaauccucaaauuaaucccaguaguugaguguuuucauuagguagguuaaaaacauagcuccucuguuggauacagacacuaaaauacucugucauguacaaacuccaaagcagaaagaaugacuaaucuuaaagggaaaauaaaagacaaggaagguuuauggacaaaaauaauguuuuuuaacucacaaauguuauaaaggccacaacacuccuccuggccagugagguuaacauuuuauuuuucacuguuauuuagcaggacuuagagauagaaaaccaaaugcuacacuguuuaaccucaagcagcuuacaccaaaaaaaaaaaaaaaaaaaaaaaggcaucuaaaaugucaaccaacaagauuuauuuccuuaguaacauuaggaggcuacaaauaaagggaugccaucccagggcacauaaauaucuuagaauucauugauguauuguggagagcaaaacaaggagucuaaaaaccuugaucaauacagacagcuuccuucugcucugaacuguggaucaucucaauuacugguauucaccuaugaaauguguuuuucuuuucuguugauguguaacguccugagauucccaagacauguauacuugugauuuagagacacaacuauguuuuauuuacuauggaaauuugaggcaucuuaaaaaaacaagauucacacccuaagauaguaacuuuauuuccuuugguccaccucugccucuugcucccccaaagacagcuuucuuuaaaaaccgacaucccagcuagaacaaaacacaccuagguacaucugugacuuuuuaugguaauuaaguuccugguuauuuacuacauuucaagaaaaaaaagugggggagggggagaauuuacauucaaugcaaguguuauuuuuauucagugauuccaaagugaggaaaggguugcuaagggcgagaaguaucucaaggaaaugucuuguuaaucugcuacauaagaauguauauaagaguuaauaauguuuuucaaaaaaguuaaugcuagacacuauagaacagguaaggcccuucuuagccucagaccuuauccacuuauauccacaucaggcacauacacccaauuucgaacaacccccuaacagagaaaggggucaauaugcuuagauugaugaccucaccaucucacccagcauagagcuuccucuuacuccuacuuuugucagacuucccgcuuugcaaguugucuuaguaucauucaaguaaagcacauuugaaacgaacgcuuaaggaucucaaaaaguagguggggcaaguacccccauguuacagaugaaaaaugaagcaaguguaugagcauauauguauauguauaaccuguauauacauuauacacacauauucccaaguguugaugagaaacaucuaucccccacaggcugaagaggagaagggagcacauacgcaauuacaggcuacauuuuaacaggaaauuauucuuaagacucaaaucacaaaagcauuagccuuugaauuauuuccacucuaggaaggaaaagagcagguaaaggggucuguucucuuuaaaagcuuuaauuacauauacauauuuugucugauaaugucaaagcacuuuacaaacucuaaggugccaagugaacagaggguauuaucauuauugcuggacaaaacaagaugucucuuaaaauguuagcauagaaaauuugcuuaucugggccuggcgcaguggcucacacuucuaaucccugcacuuugggaggccgaggcgggcagaucacgaggucaggauaucgagaccacccuggcuaacacggugaaaccccaucucuauuaaaaauacaaaaaauuagccggacuugguggcgggcgccuguagucccagcuacacgggaggcugaggcaggacaauggcaugaacccaggaggcagagcuugcagugagucuagaucgcaccacugcaccccaagccugggcaaaagugcgagagacuccaucucaaaaaaaaaaaaaaaaaaaaaaaaagaaagaaagaaagaaagaaaauuugcuuaucugucuuuuggauuaagccugucaguuuuucuuccccccacaucuaaauggacagcaaggcugcagagucguguugggagccuuuuaacauggaaaggaaagacuguggacagaaaguacaguaugcagacuuuuccuaaucaugacuguuaauuccuguccuggacugcugaagcagaugcuauguuaaacuacauuuagcacagucacaaacggugacuaaggaaguuaaaaauuuuuacuugcaaugcugcaauuuuuaaccccagaccuccaaagacuauguuuaaauauacagaguacuaacagcccaaguacuucacauuagaauuacagccuugccuauuuuaauuuaccuuauuuuuaaaagugugugacccccaccccccuccccaacuccccauaaaaauacacaucucccauccucuuugagccugcuuaugcucaggcucuuggaauuuuaauaagauuagaaauugcuaccuccuuauucuggcuaagaacuccaaagaugauccaggcaucuuguacuuauauucagauuuacaauacagagaaaacaagaguguagaaaucuaauccacgauuauacccuagaaucuagauuaauaauguguacauuaugagaucacaugggaucaaguuuccacaauuaauggaucaggcaaaugauccauguaucuacauucauacaaaaucauacacucuccuaucaucuuucuccuaucaugaucuucaaaaaugaccugaauuuaaacuguggcuuuaaaaucacauuuaauuacaagaaaaauagaaaaggaacuuuccgugggauuugaguaucuuuugcuacaguaaagaaguucagaugaucucccugccuucuggagaauccaacgaauccuacaacuaaaaguaaaaauaaauggcaagggaaagaaacuagcaauuauugauuccucuuuccaugccagucucaagcuagauauuuacaaacaaaaucuuauuuaauccucuuguggagcgggcaaggugacucacgcuuguaauuccaacacuuuggaaggcuggaggacaccacugcacuccagcuuggguggcagagcaagaccaugucuccaaaacaaaucuuaugcacuauaagcuauauuacauucucuucaauuuacaaaugagaauuucaaaacuucaagaguucacacaaguauuaagugagaaacugggauuugaaaucagugcugagaccccaucuagagcuuccuagcugaucucucuauuuccaggcuugccccuuucuccaauccuuccuccauuccacggcuguggggaucuaacuaaaauaaugggcagcacuccacuacuaucucuuuuaaagcucugcucacuccacguugccuaugaaguaacaucucagcucccuagugaggcagcugacuugaccgagcuccuaccucuucauccacaugcccagcacccccgcaucauauacacaagcucuaacaagcucccaguaguucuucccacucccaguguuuuccagugucacccaaccuguuuucuccaccugcaacagccuaccuuucuucuccugccucauggaaacauccucagcaccggaagagagcagacaaaccucgaggaagccuucugugaaccacucaguuggaccagauaacucugugugcuccuauaugccugacucaccuuuaucuccccaguaaaaaauaucaagacagauccauaaagagaaugaaugccaugaauugugauucaagguggcaaguaaaaaacaacccccuuacuuauccaugugguuuuauguucccugccaagugggaaaaauuuccauugcaacccuguauagcuggaggagcagccaaagucaucucagguuguuuauaaagaggaagguagacugucaaggggaaaaaggggaaaguaggcugucaaguccuaccacuaacacacacaucucuuuccgcauauagcuacuaauuccauauuguaagcucaaacuucaaguggaaucagcauuuuuuaauuccuagcuacaagccuuuguuaaaacaauauaaaccucagggaggaaccagggacagguguguuccauugucaccaucucacaguucaaaauaagccaaucucaucaccaauguguaaaaucaagaggaaaccugaaguuuauacucucuccccaacacagccaaggucugguguguagaauaccaaaaagaggaguaaagaaacuccccaaggcuagaaaagcaacauuccugaucuacugcauguaccaagcgcugugcucagaugcugggaaaacaaagauguacaaaaccccacucauuccaccccucacggaacuucuccaaaacacaccuguguccuaagaagguguccaaagaagucaaacgcacacaaggaaaccuuuaagaacccgcagccagaaauaaucccuucucuaccugaccuaugcuaaauaguuugcuaucaaaaaaaaaaaaaaaaaaaaaaagauggcaaaaucacugcugcuauggaaacuaccacuucuaacuucaauauuugaguguggacacguauuugagaagaaaugaggcauuuugcuucccaguguuuaaagugcuaaacaacaggagacugugcacagcauugauacugaacauuaaaguggacuucugccucacuaagaaaauuuuaaauuauaaagaagagcaggcugaaguuuuccugauuuagaauugcucagagaguuuuccagguacccauuuccuguuacaacuucauccuauguaaaguacaaguuucuuuaaaagaacucucaguagaguagauuuaacauguaaauugcuuagcaguaaauagucuuuaacuguugauaaaacuuucaggaaguaccuacuaaguaccaggcaauauagucuacagcaguuaggacugcaaucucuuucagaucgagcuaaaaagaaauucucgcuaucauccacuacuuuaaucugagauggguaugaacaaaaagauccuuaaaccacucuucuaaagggaaccaugacccugaacccaaauuuuucaauucuucugugaagaguguagaucuacucaaaugccacucuaucgcucuaucuuagacuauuuuaaagaguuccuugacgauucugagugccagucucuaguugagaaucacuauaagggaaauagaugguuuagaaacgugcccuuucuauacccuucugccccacccaagcaugcuuuuuacauccauccuuugucaggcuaaaacccaggauucacaacaaagaucuggagacugcaggccuuggaauugaguugagucaucaggacacuauucuuuauucuccauuucuaaagagcaaaagugggaaacgggggguaucaugagguagaagcaagaacgguaaauuaaaacugaagaaaacuuccacugcacuggaacaguaauuagaccaaauuugccugccaucaauuaaggaagaacaacugcucugcaucgcuggcuaccaagacagcaguuaguucucuuaaguaacuucuugcucuaacuggaaaaugacccauacuuuuacuugccaagaauaaagacagcuggccuccuacauuacaaauaaccaaaauggaaacaagugaaucuuuuuuauccaccaagguugacuacacauuaacuaagaccuauucuaauaaacauggccaacauaaacagcagcagccagguggccuacucugaacauucuuccugauacaaaguacaucauauaccuaagggcauggugaacaaaaccccccagaguggcuaugaccagcaggaagaaaacauugaggggaugggagucaaaagucuacuuaaaguauuaagcauucaaauaaauggcagaauccgagggccagcuugcaaaaacaaaaaauaaaaagccaacaauggacucugcuuaaauaaaucacgugcgagguugaaaagaaggacaaaggaaaaguggcaagggauagacaaaaacaagcagauucuguaacucuccucaaccuccaggccaaaguucggacuggcagcuagcggguagauuuagccugaaaacauguuacgugguuucuccaacguccuuaaaaacaaaacaaaacacaaacaaaaacaguaguguucaacauuuaaaauuucaccaauguaacaauuucacauucauaaaacuauauuucugauuucgcuuaauaaauaaaguuuggcaagaguccauauucccagagcuacuagccagcagguugcccuauaaauggggugccuucuuuccagcucucccaauacagccuuaauguuccggccccugcaagggcuggauuuuaaguaaaagaguaucauagccuaaaugucaaaugugcuaaagaguauaugcuuuucuaccaugauggagagguucagaaugucagaguacugggggagggaggggguuuuccaaggucaucuaaacugaggaucuuuaauuguagaccuaaucaucugugaaaauauucuaaugaauaugcauaacaaaaaaugaggcaaaaaagcaucaagucugugucacuaaacauccuaauaugacugccacagacauucaaagcacucuaaauaacucauuuuggccuguuuauacuacuauggauuuggauuagaaagucauccuguccacaaagaauuagguauauccugucccuucugggggcugaguuugagacaguuaauucaaaccuaaucaaauauuuugcuaugagaaagaagaggaggggccaaugaagugcuuuauccccaggaugaggcagugaguagggcagcacacaaaaaagauaaaaaucaccuggcacuacaccagaagcccuugaauuaacauuaaauuuccagguuaacgcucuaaaaacugucucaugacaaaccacaaauuguauuuuggagguaaaacaggagguaaguggggaaggaacugaaggguaaauaagaggucuuacuucacacuuuuucugcugcuuuugguuuaccccaguagaaucccaugaaaaccugcuucacacuggcaaagugggcagacagaggaacaaaggcaauuccagggccugcagaaagucuucaaaggcaagggaagaaagcaacgcccugccuaaacacuggcuauuuauagcacagcaauggaagaucugggagguggcugagggaauaugaaagcuagagagugggugggcgggcuuccuucuggcuuccuuagacucagaaacuaaugcauucuucccugccuccaaagcugcuauuuuguuuccuguguaagguuucaaaauacugcaacacugucccuaggugcauuugacaauaucagagcaauuacaguuugguuaaaaucugaagguaaucaacucaccauucuuugcuauucucuagaaaaagaggccugaacaaagaggaggagacaccaccauccaauucauaaggauggucucccaaaauccccugaacuuucacagcgcggaaaguuucugugauuucaagcagagaccaggagaaacuauacuuuucaccucuucucauuaacuaaaagccacagcuaaaaauaaaaagcuggagcaauuccaaaacuguggguuuuauagggcacauuaaauuauuccuuaucaacugcaaaccuuuaagguugcagaguauuauguuaaugcuauuggcuuuuucuuuuuuuuccccagaaucggugauaguguuccuuaaaaaaaaaaaaaaaaaaaaaaaaaaaaaaaaaaaaaaaaaaaaaaaaaaaaaaacuucaugaacuuccaaguccaaucucuauugcaaaguaaaguauggguuccuaaaucugcagagaauaucaucuauucuacaaaaccucacacauaacuuagguugauucucuuuuccaggacuguauuauaaaacauuuugaacugagaacagaucaacaguugguauuaauaguaaauuauaauaaucauuuuacacuuguuuccuaaucucaugcaugagauucaaaaauaagaaagcagucuaacaacagagaauuuucuaaacagaaugugaagcucucacauuuauucaaauauaaacacuaaaaaguguuuaggguucccccuggacauucaauuguuauuaacucuuaagauaaauuuccaacuuaauaaacuuggaaaauggcuuuuuaagcauauuuucaauuuguugaaaguuuauaauauugaauccuaugagucuuuuuauaauuauuuucuuagaaaauuuguggucaauuuccugugaccuucguaaaacuuaaacacaccucuuagcucacauccauaacuauguuggcuuauaccaacauucuucuuauauucuucauuaauggucaagguuaaagaaauaagaguauuuggucuaaacucaaaucaaaugaucauguguaacacacagcagcacccaaaacauaagcacuauuuuccauaacuaaaacaucagaaccuaaggcauccauuuauaccaaaaugaagauuuuaguucagcucuucaggagaguuaagacauggccagguaaauuaaggccaaaaaagggcaagucacaacacuauguagcauucaggaaauuuggagcaaauuuaagcuuucacauaaaacagucaggguuaggaguggccucagagaagcaauuaucucauucccaagucccaggcuaacaaacuaacagggauauggaaaaaaagacuagaacgaagguaaaagccuacauaaaguccaaagacaaucacugcugguccuaaaucuauuucuuaaugauucugugacccucaacaaguuuguuauguucauaacuucccucaucuauuaagaacagauuuuucucacucugcuagcgaacaggguuauuaaaagaaauaaguuauaacaaauuacagauaaaagaauggcuuauaaaaaauuucaggcacuauacaaaguaggguauuguucucaaggcacuaaccuucuugagaauuguuuucugcuuucaugcucuccuaaaaacacaucuuuaauuuaugguaaggucaaacugccauuaucacugcaaccugagaaauucaaauuaauggucaaagauacacauaaacacacacacuccaggcuuugcuuucuucuuucccucaaaaggucauguuuucaccaaacagaucaggaauucuacaauauacuacguuccaaguaccaaauauuuaagccaccaaaacauacagcagaauagcauauuuaagaaaaguuucuuuuuuuucuuuccuuuuuuuuuuuuuuuugaagauagguucuaauucugucaccaaccaggcuggaguacaguggugugaucacagcucacugcagccuccugggcucaagggauccuccuaccucagccucuugaguagcugggaccacagguacacaccaccacaccccgcuaauuuuuuaaaucuuuuuuuguuuguuuuuugagauggagucuugcucugcaacccaggcuggagugcaguggcgggauucucugcucaccgcaaacucugccucccggguucacaccauucuccugccucagccuccugaguagccggcaaccgccaccacgcccggcuaauuuuuuguauuuuuaguagagacgggguuucagcguguuagucaggauggucucgaucuccugaccucgugagccgcccgccucggccucccaaagugcugggauuacaggcgugagccaccgcgccuggcuaauuuuuuaaaaucuuuuguggagacgagguuuugccauguugcucaggcuggucucaaacuccuagguucaaaggauccucccaccucagccucucaaagugcuagaauuacaggcgugagccaccaugcccgaccaagaaguuucuuuaacauaaaaauguccaagcagauaaccaagucaaaacacuuuuauuacugaacagcagacggugauguuuuaguuggcaauuuaagaaucacacgcuauagcuauuccugaaaaauucaaaaucaaaguacaucguaagcauuugcucagaggcuagcauagugcuuaacgcagagucuuagcauucucaaaaacaugcaagaccagccuggccaacauggugaaaccccagcucuacuaaaaauacaaaaauuaaaaauacaaaaaauuaaaaauacaaaaaaaaaaauuacaggcgugugguagugcacaccuguaaucccagcuacucaggaggcugaggcaggagaaucacuugaaucugggaggcagagguugcaaugagccaagauccugccaccacacuccagacugggugacagagcaagacugucuccaaaaaacaaacaaacaaacgaaaagaaaccaaaccaaaacaaaaaaccaugcaagagcuuaagccauuuuaaagagcugcaaccaugaacuaagauuuagccugaagacaauuagcguacguuccaucccauaccaagaaaaccacuuuauaugcucaaauacuucuugguauauucugccaaugaggcgauucuaccugaauuuauuaauaaacuauuuaccagccugcuugaccaccaagguuugguaaacagacuugggcccgauguggaagcauagcuaaggauggagaccccggggcacaagaagugagcugaagugaaaccaggaaggaagacaaauuucuuugauagccucuucucuuuccaaucccagcuucccaucucaguugcucauugugccuucauccccucucccauuugagagcucagcugagucugcagauaucccaagauacuaacugguaacuauuuggcuagagugagagcccacuucauuuucuaugcauccaacaaacucuuaucucaaaagggcaauaagcauaccuggaauuuacuccaauaccugugaaagguagccaaacucuacucuccggaggcgugaagucaucauacuuccagauaagacauuaauaagcagaauuauccuuaccucauuuguuacacuuuaguccuccaaauuaaaaacagccaaagagaaacuagcuuguaaacaaaaguaaauauucaaggugccaagacuggaagacagcaagaucucacucagcucacagucugaagccacuuaaauggaguaacuccaaggaaaaccgaaaguuaaacugaagaaaaacauguaacuucagagagcaugaaaaacugguacaauucugcacaacuacaaaguggccaugcacuaaccugaaaacaacgagguucauuauugaauaaaggcaucaggaauucuuggagauggagcuuucaaauaaggcuuuagucaccacuaaaaggacacagaagaaaacagauaugccucaaauaucaacacauuugaaggacagacaucugcauucauucuaacaugcaaauccuaugugcagggcacugugcuggauaaccaagaugacucagauaaggaguucccacuuacugucuaagcaaagaagggaacacaugcagaaccacaacacaggacgcaaucugguaagugugagaaggagagauuguaucuggaugacagaugaaaaaaaaaaaucaggcucagaacagagaaaagccaugugcacuaggcucucuguugucauagguucaaauaaagggcaaaguacacauaguugcaaucauuuuuaaaaugcugggcacaggccgggcgcgguggcucacaccuguaaucccagcacuuugggaggcugaggcgcguggaucacgaggucaggagaucgagaccauccuggcuaacacggugaaaccccgucucuacuaaaaaaaauacaaaaaaauuagccgggcaugguggcgggcgccuguaaucccagcuacugaggaggcugagacaggagaauggcgugaaccugggaggcagagcuugcugugagccgagauugcgccacgacacuccagccuggggccacagagcaagacuccgucucaaaaaacaaaaacaaaaaugcugggcacagagacuauagcauaaacaagacagguacuaagggaacuuagugggagagacauauuaaacaagccaaagaauaaagcuaauguuuagaauugcaguucaugccaugaaggaaaaaaggaugcugugggaauaaaacugggacagugaucagaagaaaagccuucugcagauuaagugacauuuaagcugagaucuaaagauaaacaugacuacauauauguaauacuuggucuuuggaagguaaaggauggugccacacacauacuagguaguguugggggcagugggacuggugaauaagacauaauuuguacccugaggaaugucauccuagggaugcaauuacauccaauauguggaacccagcaggcagaguuuuacaauuauggauaaaacuuaagcuacagagaucuugaaacccaucuauccucaaccauuccuuuuuaucaaaugaaggaaaugaaacccagaggcuggcucaguguuucugaacuagguaggugcagagguggggcacaaccuguaacucccauuacaucacacugccaauuaacuuuuuaaucagaauuuauguggaaugucagaauucaguaaauugaucauguacaagaaacacuuaauauccguagggaaaaauaaguagacuugggccuaaaugccaaguacuucacuagacauugugggaaaaaucuuauuugguuccaggcaaaauaagaaauguaaugaguuuuuuguaaagugaaauauauucaauuucucuugugaaguuacgugcauccuacuuuggggcaucuaagcaaaccaggaaaugacagugauaauagauaaugugucagauggucuuaaaugccuuuccuuggcaaaacagaguugacaaaccuauuauuccccucccacaauguacaguuuuacuucuuauuguacuucccugagaaguacauauaucaaggaacaacugucacaaugaggguugaggcaguagagggagccacucccagaguucacagcagcacuguucaucaaagcacaagaaaugaaaacaaaguguuuaucaaggaagaugaacaagaaagauaugaagauaaagucauacaaguucacacaauucaauguucuucagcagccaaguaagagcccacacauagaccaaagcauauuauaaaaugagaauuuugaugaauuuaacuuaguguccuggaggacaaaaaaggacuuaggaucuuuuaguuaucacagcugcaccuacaagucaaauauaggcaaaaugaaacauuuuuaaucagauaucucccaaauuuugcauuacuuuaaggauagugugaaaacaaaaauaacaagggaggaaacaauccccuucaaauugaagccacuauagcucaauccucacugucucacgucuguuaacccaaaacucccaguaugaguacgaaucagucacgacauagaaaucuagaccuauucugucaaugagcagcugcuccaggucugcaucaaucuguaaacagguauuuccaaagcauaugaccagcuccagucugagcagaauaacagaucaaaacuggagaggacacacaaugggaaaaguaguugaucgguuugauagaggaagagacacugggucccacucaaaaauaaaguaucucaacuuuuucacugaauuuacauucccaaagaauagauuguaaaauaaguaagaaucccagacuuuucgguacuugaaggucacuaugaggucaccuggcauagugaucuacugcaagaacagccugacuggucuucacugaugcuacauucuauuuuguacucugucucaagcuagcugaacuugagagacuucuaagucuauccaaggacauuugaaacauuugugauaaaugcagaguauuuaucucuguuaacaaugaagaaaagucaccuuccagaagaauugcugugaaagcccacaucgugugcacuauuuuuuaaaaaguaacauagaaaagcuguuuaacauaccaggaaagucaaggagaacuuuaaaaaaauuauaaccauaauaccuaauuucaucaaaaugauguaagcaacaaagaucuaauuuauauugagauaaacuauauaggcucagacuauucaggcaaggaaccaguaaaugcuuauuucauacugaaauuuacaggacaugaaugacuuagcaauauauauugacccugagcuacugaaaugacaacaacccaaaggugauuacugacauaucagaagaauaacaaugaaacuugagggcgagagucucuuucacacuuuaaaaaaaaaaugcagcucaauaaaaauguaccuauuaaaaauagaaagacaguuaucccuuucaacugguguugaucugcccuuuauuacuggagauagacuguaucacucagaaaguuacccugaagcuauaagaagcuuggaggaaaauauuaaacuucaagguacagauaggaccaggagccuguuaagacagaaaacgaagacauuaauguucaaaaaguauauaagcaggaaaccugcaguagucucaguaacagauuuuaguggcaaaaaaaaaaaaaaaaaaaaaagagagagagagaaaggaaagccuuuuaaaaaucuaagccacuggaauuuuaaagugacacccacaugacccaguuuacuuuucuauucaaagaaguucugaugcuguuucucuauuucucuuuggaaguuuuucauguccaauauauugcaaaagauaaaagguacacuuuuauuuaagcacacaauggaauaaaacaucacugaggaacuuggaccuguaaauaaauuuuaaugggaaagacaagaauucaaacaugaggaaagggcaacagauauauauacggcaaaugugagaaagaauaugagcauuuggaaaaggaagacaacauuguuggacaggguaggaugacagcuauuaauuuaauuuaggauaugcuaggccaugcucuaagccguuuuaaagggcauuaccccccugugauccuaauaacuuaauaaaaugggucauuucauccccauuuuuuuuuuuuuugagacggaguuucgcucuugucucccaggcuggagugcaauggcaugaucuuagcucacugcaaacugccucagccuccagaguagcuaggauuacaggcacccgccaccaugcccagcuaauuuuucuauuuuuaauagagauggguuuccaccauguuggccaggcuggucucgaacuccuaaccucaggugauccaaccgccucagccuccuaaagugcugggauuacaggcaugagccaccacgccuggccucaucccuauuuuucaaaugaggaaauaggcuuaaaaaaacaaaaaaaaaagauuaacuuuuccagaacucacaaaaccugccaaugugggucuaacaaacuccagagcccaugcucuuugcaccacacaucaaugaagcagcuaaaauaaccaauaucuugcuucaccccagaccaauuaaauaagaaucucuccuaagggcccagauacuggcauuuuuaucagcacccgauuugauucuaaucugcaagcaaggaugagaaccacuguaaaagacuuuuguaagacaaguggacuaucagcuagguagugccaaacaaacaagagucaaauaaucagagacuggggaauucauccagcuuuuagagggcaaacagaaguucaaaaacaguggaggugcugaggcagagcugauccagacuaacuucagggaaagucugaacacaggcuuuaguccaagcagugauuaaaaaggcgcaaaaaaccagguuggaaucauuuugcugagagaaugaacuacagguuagaaaauuuuuacuuuuaagacuguagguaagaagggagcacaaaaugacuuuuacagcuaauguaaccaauggguaugaauuuuaggaaaauaaggaaaaaauaacaguugacuaaccuaaagccaauggaccaggauauaaaauauaacaagugagugacaauaaacagagcuugcugagcaaucggauauagccuaguaguuacaacuguuaacucuacggugaucccuucuagcauuugccauccuaagucuugauuuccucauuuaggaaauggagaaaauaauccuaucaucucauucaguuauuggaauaaauauaugagauauggcaguccccuuuuuaccaggcacucaaaagccccaauagaugccugaaacuucagauagaacugaccccuaccauguuuuuuccuacacauaccuaugauaaaauuuaauuucuaaacugggcccaguaagacauuaacaauaacuaagaacugcuguaacaguacacuguaauaaaaguuauguauaugugaucucucagcguauuuaguuuucuuuaagucgagaacuuucaccuuuuuacuuaaagggaacauggagcacuuuaacauccucucuuuggcaugucagaacugccagcaucacuacucuugugcuuuggggccgcugaaaguaaaagaagggcuacuugaacacgagcagugcaauaccucgaaagucaaucuuauaacugagauggcuauacuaagggacuaacagcauggauacacuagacaaagggaggauucacauccugacuggucagcaugaggguacaucacacuauucagaaguacacgcaguguaaaacuugugaauuguuuaugccuggaauuuuccauuuaauauuugugaaccacaguugacugcagguaacggaaaucauggaaagcgaaacuguggguaaggaggaacuacugccauccaagcaaaagaaaagagaccaacggcuucuguauucuuauagagggcaguguaagaauauagucccccaauuuuuuccuucuuaccauuacaacuuuagauggccuuguuaaagacucaguaaauggggaauagaaguuuggccugcuuauucaguuccuauuagucccuauauagagggacugcuuauucagucccuauacagagggucagugacccucuauaucagucuaggccagugcccagacacuagacgcagccacaagaaaugcaaguuuuccuaaaugguaagguggaauguauguccccuaacccuacugaagugaccgucauuucacaaauagugaauuuauauauuaagugauuuauuaaauuuaugcuacauacaaaauuacguauuaaaaugcauauguguccucaacugaauucuugaggcauaguauugaggaaacaguucaaaauaguaauacaauucgguaaaacuuuuaauuauuucucaaaagaauccacacaacuuaaaaucugacaccugcugaaugauaaagcuuggucaucugcacaacuuccuauucaacuuucauuuucacaaaccuuauuuugucuuaagaugauuuccacgcacucagcaggguaaucuuuuagcuaaaugauccgaaacccacaaucugaauggcaagaaauugcuuccuaaauaauguaucguauuauacaagcuaucacauaucucccuuccccagaaaaguaaauaaacauucuuaaagacagcccagaggaaaacaguaugguugcaaaacaguuagcuucuuauaucuuucaagacuuuacuaaaugucacuuauaaaugagaaaacauauuugaaguuuuuaaguguucuaugcuuuuuaaacccuuuccugaauguauacagguaggacacucagagguaagguaagggguaaccauguuccuaaauuacauuaauuucuaaugccugaaaccaaaguuuucaaagggcuauaaaugcuugaauaauccauuaagauacacaaaaugacagguugaugguaaaaaaggggaaaaaaaaaaaacaaccuuucaacaaaugacaaauuuucuccuaaaucauucuuugguuagaggaccaauguaaaagaggcagguccgagugcuguuuuguacuggaaacaaaacagauguaacagguguaaugaauaccagagagagaugagacagaaaaucuugaaauuaaacuucugugguagaaaaaaagagagggaauacaaaaauauauggaaaugccugguuggaugaaaggagaguagauauucuaaccaaaccauuuaaauccacauuauuagacaccccaauacccgcuuucccagucugugacugcacagguaaagccaaaauauauuuucugcuuuggaauagauuuucuacuuaggauuaguuacaggcauaucggcugcucugggaauucacuuucaaauauaaugaggccacacuaaaaacuugaaggaagugaaauaguauccuucaucucaucugucaccauaaagcucaacguaaagaaagcuaaaaggcucacugcagucccucaagaaaaaguuaaagguuugacucucugcugauuaccuugaauagacagccaaauuaggcuggagcaaauaacuauaaacugacuaucuaauguaacuaggcauuagccauucaucccagagcuuuaauuuuauguuuuauauauuacgguuccccuggugauuuuccgcauaccucauuaaguucugacuugaggaugucugcucuggacgagcacacagagcaacacaacacaaaacauccuaaaccucacaucucuuaguauuuccaacacaaacaucgcaggucuccugaugaacacuuaaccucuacauguucucuaaguacagagugccuagagucucagagcugcacagacaccagcagacauucugugaaaacacugccaagacccucuugacaucuguggcaaaaacauccugucuucuaaauauauguucuguuuaaguggcuuuuaaagcauaagcauggugccuuuaaaagcaguuuguaacaagaggucaaacuauaaaacugaagagguuagagaagaaaucaauuguauaucaauugucaaaacucaacuuuaaaaggcagagguggucacaaacuacuguacagacaggguaaauggaaaagaaaucuccagguugaaaacggcaaaugcuaaucgcaggggugggagcaaggagucuugaccaaucguaaagaugagaaagcauuucccuucuggaaugaaaaacuaaaacuguagaucagaaauucaggggaaaagaaucauuucuguucaugccucgagaaauuaaauacccuuaccccuguuagagaacugaaguguaucucccaaaauuaacauguugaaaccauaaucuccaacgugacuauauuugaaaacaggguuguguaguucaguaguuucaguagaaacgguacuucaaguaacuacacaaccacucuguuuuucacucuauuuccuuaauuauuucaggaaauaaggcuaaaugaggucauaaguguaaauaauuaagaauaaaugaggucacaaguauggggcccuaauccaauaggauugguguccauauaagaaaaggaagagacaccaaugauuucuccuucuuuacauacccagaguaaaagcuaagugaggacacagugagaagguggccuucugcaagccugaaacaguggucuugccagaaaccaacacuaccaaaaccuugaucuuggucuuccagccuccagaaccaugagaaaauaaauuucuauuguuuuugcuacccaggcuaugguauucuguuauggcagccuaagcaaacuaauacaacccccacaccaauucuuaaucucucaguugucuuuuccucucauugcugccacccaaucuuuuccuggaaucugaaccuuagguaugcaaauaguccccaacuuacaugguuugacuuaacaguuucuaaacuuuguaauggugcaagaucgauacacauucaguagaaacagcacuucaaguaacuacaccaucauucuauuuuucacugucaguauucaguaaauuacaugaaacauucaacacuuuuauuauaaaacaggcuuuguguuagaugguuuugcccaauuauaggcuaaugcaaguguucuaagcagauuuaaggcaggcuaggcgaaagcuaugauguuaagcagguuaaguauguuaaauguauuuucuacuuaugacaucuucaacuuaacuuaaagauggguuuaucaggacauaagccccaucauaagucagagcaccuucuuguagccacugaaccaugcccccucgcuuuugaaucaacacugucaucuauccauaacugcuaauuuaccuucacuaaaaugagugucuaccaauaucuaccccucauccuccaauucccaugagaccagggcaagccuuuaucaucauauacacugcuucaaaucugucuccuccuccaacaugcucaucuuuauauaauggcuagcuucaacuucccaaaaacaucucaugcuaucacuugcucaaauaccaucaauuguauacauacagaccuucauuuaagggccuuuuuaacuuucuaauccaucccuaauguuuucucccaacuucucaagccaaaacccugcauaaggucaaaaugacccauaaccauccucugaaucuguugcauuauuuuauuuacuuccuuuuuucauauuuuucuuuuauuuuuuagacacaaguucuuacucugucgcccaggauggaguacagcgguguggucacagcucacgguggccuccaacuccuagaaucaugcuauccucccccgucggccuuccaaguaucugggacuacaggcaugcaucaccacacccaguuauuuuuuauuuuuuacuuuuuguagacacaggguccucacuauguuguugagacuggucuugaacuccuggccucaagcaaucccuccccgcaaggccucccaaagugcugggauuacaggagugaggcaccacugccuggccuguuuccuugcuuuuauuccuauuguugugacaauuuggaauguccucucugcuuauuuccuuucuaaauggcagcuggaagaaagaaguucugaagaacauuacacaaucacaaggggcuuguuauggcaaaaccuucuacccucaacugcugcucugccacauacugauuuuauucaaauaggcuuuuaccuccaccaaaucaugccagguacuuacacaauaucugaaagaugguaccaauuucagcuccacauaaauagaaaaugggaagaucugacacaaaugaaauucagaguuuucagaggcucucaucucccccuaaguauuaucauccuaaguaaggucuagagaccaugagacacacauauagauuugaucugagcucaaucaguucuucucucaaacccucaacuuuuuuucuaaagcuaucaccuaaaucccagcaacaaaacuaauagagucucucagauuuucccaauuuucaacgauccccuccccuaucauuccuccaaagaacaucauaacaagccucuucaacacucucuuuaugagagccugagcuucguaaccuauacuggauccuuauugauuuucaucaugugagugacaaaacacaguaauauacuaagauuuccaacaaccugaauaccuggcucuugauuuuuacaugcccccaaaauagccucugucccacucaguggacuuuccaccuccaaacuuuuauaacuauuuucuccacucaugaucuucucccuacugguuccaauuuacacgcaugcucuucauuauaagcuuugcugaucuucucuaauaaauuuugcuuaccccuuuaaaaacaguccuccaagagcucuuuccugguaacuuagcaugcacuauaucauacagccauuuguaaggccccaucaaugacuccaccuguauguggucaucuuuauauagaaacccaaccagaauggagacauaaaauucuagaagagcuuuaguucuuucaucauugugaucuaaaucaaagggcacugcagucagcagcacccagagauacuccaaugucacugacuagcauaccaacagcauucaagcugcuucaugagcuuaucuuuccccuucuaacuucaggguugguagggcaaagaaaugacaccaaugacaucuacaaucagggccuggaaucaaaagcaaacugauaguguaacauucagggacuucagugacacuuuccuagaacacugagugcccaaaagggcugggccaucagcuuccccuaaagaggggaaaagaaccacccacuuucuacaacagauugacuguuaaacacacguacagcaggccucuugcaggagaaaaggcaagcuguccugccagaguuccuaaaagcuucugaggacaacaauuuuucuuagggagugaaaauauauacccuaauccauacuggauagacagcccccauuuuucaaauucaaggcugaauaagauacauucaguuuuaaacauuccuagaauuugagaauuccaaaguaucaaccauuuuuacaucaaauaacuacauuagucaaaccagacuaauuauuaaaauuacacaaagcuuguacaaaucaauccuuaauguuuaggaaaaucaugaaaaaauuuguguggggaaaccagucuaaucuuuucagauccaguacaccaaccacuuggcaaugcucccuacaaucugggaagauuuccugaccaauggaauacagauaaaauauggcagaguaugcauuaauccuuccaucuucucuuguuuuaauaauaaguagagagccaggaccauacaaauuagguauauacagcuccuagaaaaauaaaauuuaacuaaagcuaaagaagaugaacacuucuuuaaccaaauuucccaccuuauuuuaucuuaugcacaccuacaaaacaucuguauacaugccuuauaauagcuuuugaucaacugcuaucaaaacaaacuaaaggaguaaaauaauauuacugcucuucagacauuaaaaaacacauuucuaagcaauauuuucaaagucaacaacuuugaaaaauuaaguccuuaucuuuauagaccacaggcucauuauaauuaaguggguaguuuguuuauauuuuauauaagauucccuaagaaccuaagauccugccagugucuauuuaagaaauggagaaaauguugggcgugguggcucaugccuguaaucccagcacuuugggaggcugaggugggugggucaccugaggucaggaguucgagaacagcguggccaacaugguaaaaucccaucucuacuaaaaauacaaaauuagcuucguguggugguacauggcuguagucccagcuacucgcgaggcugugacaggagaaucgcuugaaccugggaggcggaggcugcagugagccgagaucacgccacugcuguccagccugagcgagacagagcaagacuccaucucaaaaaaauaaaaauaaaaaauaaauggggaaaacaacauuguaaguacuggaaaauacuacguccauagucauugauauauaaaaugucucaaaaaauaggacugucauaaaauacagaaccucuuacagagaagaaauuuuaaguugccacuauuaaaauggaauuuaaaaucucaagauuccacauauuuaagaacgaauauuccuuuguucaucacaaagcugagacaaaaacaagacauuuaauggcaaugugucuccucccugaaaguugauuuuauugcuauuuagcauuuccaggaaauaauuucuaagagcuaaacaaucauuuuuaauauugacuccucuucacagcccgcucugcagcaccaccaccuucuuacaaaccgggggaaaaaugcauaaguggauguuuaaauuacuuucuugaucaauauuguuucccaccagauuuuggaauauuaugaaaacgaaguguacccauuuugguccuuggaccuucaauuguuucuuaauuuuuaugagaaacaaaaauuugaacaguaauauacuucugcaauccaaagaagaauuaaaccaaaagacaaaugaugaacuuucuagguccuacuauaaaacacuagaguuagaagggugaucauuguuaacauacaacucugguucaagcccugguuauggggcuuucacuggguuauuacaguucuuguuauuuacaaauguggaagcuuauuacauauaaaagcucuuacuucuaauaaccuuuggguaacuugcaaucuccauuuaaaaagccucuuccucacaauuacuguccauuugaagagcgauuugacccauacucuguccuuugagacaucacauaaaaggacucucaccuacucaaaaaucaaucuuuucagucagaugaaaucuuaaugaaagcugagaucaucucgaggaaagcaaaauacugccaaaaggcaaaaacagcuucacacucuaacgguaaacccacaaaauugccagauuaaaauucugcugcuuagucauuaugauccaaagaugcaugacuugccucacuagggcaauggcugucuauaaguaagauaucuagaguuuacaccauccuuacggagagccuugacacuauuauugccaaaucuauacguagaguuaguucccugcacaagaagauauuuaauuauagcucuauaauuuuuuuucaaaacagaguaauaucccaaauauguaaaagauauccugagaacaauugcccuugcccuucguccuuuguauagguuauucuacugauucaauaucagucauggaauauacuagagaaaauagauucugacuugcuuaucucuucauuuuaaccccauuuuccucauuccaaauaguaaggaugcauuugagagauagcuaacuauaaagaaugaggacagggacaauggacugcaaagcugguugaugcagaguccaacucacaagcaugacaugguagccaauuuagcuaaauggacacagguugaauuaaccugaccuuuaugcuucaauguccuaauuuguacaauagcuaccaucugcccagcugaguccugagcagcuaacaacaggauuugaagaguuuaagauucgagacaaaaaugaaccaaaauccagaaugaauccuacuaauucuacuuaagcccaaaagugaaccucuauccucuguuuaaaagaaaaacacaggcguuuucaaaaaaauacaaccaguaaaggcacuacaaaaacagcacggcuuucuaaauaucauuaaacugaucuuaaauuguaaugcaugcuaagucccuagcacaucacaggaacaguguaaauauaaacacaaacuaaaugaagaaauguguaagucaucuucauguuaucugguaaaucucauguaugauacacuucaauaaaaucccaaaggccagcuauugggaauuuaaaacagaaagggugcuugguagcaggaggggcaugggugguagauaaugacagaaauaauuaaagguagggacugagaggagauuuuuuaaaggacaccagguguacgauuuagguuugccauaaugauauacuugagugaauaaaaaguaugggaugcgggcgugguggcuuacgccuguaaucccaguacuuugggaggcugaggcagguggaucaucugaggucuggaguuugagaccaaucugaccaacauggagaaaaccccgccucugcuaaaaauacaaaauuaggugggcgugguggcgcaugccuguaauccgagcuacucggguggcugaggcaggagaaucucuugaaccugggaagcggagguugcgguaagcugaaaucacgccauugcacuccagcuugcgcaacaagagugaaacucugucucaaaagaaaaaaaaagaaaagaaaagaaaaaaaaaguaugggauaagaauucaugggucaugaucaagagaaaaaguuauuuggcuaguucaugaaguaaacauugcauccggcaaagaagggagaacucugaaugccugaaaguguuugaaaucuguucuguaagcaauagggagccacugaaaccuucaggcaggaugacagagccaaagcuguccuuuaacugucucuuacaagauucuaacucaaaugugccuaaauucugcaagguuauuuaucugaggagacaguucauaauauuagugcaaaaaggucgcaacagcaaaacaggacccuuuauuugauuaaauaauuuaguucuaacaccugggcagagagaauuccaguauagauguuacugugcacucugaagccagacugcgugaguucuaauuccagcucugucauuuacugcaucuuugggccuguaacuuaaaucacucuacgugccauuuccuuaccuauaaaauggcggggguggggagauaauuauaccaccuacaucucagaguuuuguaagaacucaagugagugaauccauguagacugcugagaacagugccuggcacagagaagcagccuucaaauuaugcugacacaaccacuucuaugccauacccuuugacaucugauaaauguuacuguaacauuucauauaaaguaucagaauauggauucugccuuuguagggggugugugugggaagggagacgagggaggagucagauuuuucuguuccuauccuucaaaaccacaagcuaaaagcuauacaccuaggugaacacuuuccauuuccaauaggccuuguccauuuuucccuucucgaugguuuaaaaugguucccaggcacacguguaauuaaauucauuaucuuaaaaaacugcuucaggaaaugcagcaaucaaaucugccaccaucuguuuuuuauagauagauauaauuacaaccuaauaggcaucauuuaaucaagacuuaacaauuagguucuuaaauccaaaacuugaucauuuucuuccuugauauguguacaaaauuuucucccaggugguggucauguaaagugaaggauggaagaacuauuaaaacccuuaucauaauggccuuccuaaagugcuaauuauuacacaauuaagacagacauaauaugacuagaaagccuaagaaaaucuaaugcaaucucacagaagcuuuuuaaaauuuuuuuccaucucuaucuccaaacuaccuaccaaaaaacccaaaauacaaaggaguaccucucgccuaugacuucuuaacaagcgaagucaggaguagcaccaaaccuuccccugguucuaacaucaccuagucagaucuuuagaggagaaaagcaauccuaucuguuaccuuguuucccaucccgcauuuuaagagauaagaaacccaggaccugaaaagugaguauuuuccuaaggcacucagggugaaaccuggacuagaaccuagaugucccuccauaaaaaacaagauuuuguacucuuacuccaccccaccacgugaguggggaaaagcagaguuuugagggccuacaauccucaagucugaucacugggucucucacaucuaauuacaauauccagccccauuuccaacuuaauaagauuaauucuuugucacugaugcucaauaguaacucuugcuacucccagcagccaacacccuaguuugaaagacaugcaggucaccagugcaucuucuauugagagccccuaauugccuuaccacacccaaggugcuuccugcuagacuaagcuucuuuacagaccuaacacaccaaauaagagaccacaguugggcaagaaaucuauuaagaauuagaaaacccugaaagggcucuauuuaccacugaaaagaaaaaucuuaagcccuuuguaguuucccauucucuuuccuuucccaaaagcuuuaagaggucucccagcaaaccuaaaccaagcccucacuuuuaaacacagcuguccaaggacucugugggugggugcaggggacagaccuaaucuuucccuaugcaagauuugaagaguauuagagaaacaaagcauuaaagaaacaaaagccuuaaaguccaauauuucuccuaaaauaaccucauuaaggcaaguuuucuuuggucuuccaaagaaucccaauucaaaaaugagaaaagaaaguagcuaauaaugagggcuucaccauaaagcaucacaaucaaccuuucauuauucccauucuguaggucagacaucgaaggcuuggauagguggagugacuuugaauagggaccccaaauucugaacuggagguguaacaaucaaguccuaaaacaguagaguuccuauuccucuucucagcuuauuuuaacaccaaauguguaacccaggguaucugcucaugcaggggccuaagugcacccuucacaacccgggaugguagugcccaagagcagcucuacuaagccagaaugagcaaauggcaccaugcuuacaugaggagaaggaccucacaagcugcagaacauguccagccuagcccccuucccucuuauucaaggaugaagugaaaugcacuacagcccuauaugcuuaagauaucagauggaaauuuuaagaauucuuucaaagaacauaggucauuauccccaacuuuggaaaacuacuucagauuacuugguuuuggggaguagagaaucaguauagaaugcuucucaagcaaaugaaucuacaaaauuagaaaauuugacuuacuuaaaauaacuuacaguaaaaguuuaaaacuaaacuuuaaauuuaguuugggaaaacagaugacguaugaaauuuuuuauucaaauacgaauuuagaucuaucuucaucugauacgggugccuucaagggcaaugagccgcuuuuuaaaucuccucagaggauccuauucacauuaaacagaagccacaggaaaacuggcauuaacauuuccuuccugcuuguuggaaagcaaggcaccuuauuugagggcuuuccagaucaagaacacauuuuauaccaauaaacuuuacagcugggcccagcagagaucuacaaauuaaggcuaauugugaacuguacagcaacuguccuucgucuuccauuuuuauauuuuauuucaauuuggagcuaccuaacagacacagaagcccuccagacuauuucucaaaacuuucuguuuggaaguagguacacgcacccaggaauacugaaguaugaaauaaauauuaagagccuagaacaaaauacaaaaacauuacuggaaauaggcucaauauguuuuaaaauaacauuuaaaacuuaacugcugcuuuauuucuuuuaaacucaaagaaauuuucucagguagaagauuuuuuaaagcuacaagggauuucaaaaugaaaaacuaauauuucuucucuugaauguugugcuugaaaggaaaaguuauacugucauucauucaauaaauauuaagcucuacguacaggagcuauuggaauauaaagugugucuuugccuucaagggcuacucaguuuucagacaaguaaauuucuugcaagcagaaaucccagaguaucaaugaucucaccaacagaaguguccuagcuaagggacuuuaguuuuaaacagaaaucaacaucauuaagaaugcuagaugucacuguuacugacauuucuugauccaguuaggguguauaaaggucaacaucugacaacagaauguucacgcauuaguuauccaaacuaaaaugcagaaaaugucuaaaucagcacauuugaaacuagaaagaaauuaauucuauuacaauauuaaauguggaaucauacacagaaaaauaaaugggcacccuucacuaccaacaccccauuuugcauuuuaaagggggaagggacucccacagaguuuucuucuaacaagcgcugcaaauaggaauugacagguggagcccugauugacaauggugguuuuagaugacaccucaccucccuccuccuuacccaccuaaucucacgacuaaugcgggaagcugaaauaaauacaguggaagauuguuuaucuguuucguuuuguuuuuuuaagugcagauguguuccacaauugaagaaagagguuaagauucuauacacauccuggguaccauuuagucaaugucuacuugagcaacaaacuaggacaaugaaaccaauacaggaagaagaaaaugcauggagcaggugaacuacuccgaggugcauuuuuagcucaugugaccuuccaacgugcuccaaguauguuguauguagaugugugggcauguauuuauagaaagggucaagagcgcuauaaaaaauacauuaauaauguuagugcuacaagggacuuccaaacgcuagcccacagccucaauuuuuagacagagaaagcaagccccaagacuuggccaaacuuucuagugauagaauuugcuagugauagaaucuggucauagcauucaaguuuucaacuccugaagacaaucuuaccuccaaaguacuccaauuccacagcuuuauucuuaaauuuaccccuccccuagaaagaugacugcccacuccucccuacaauacagauuccaaguuuuaagacucagaugggccuagcccugccuuccaagaauccauuaggcuaauccagugguucucaaagcauagccugggaaccuaagaguccucugagacuuccucauacauccgggaagucaagagaaugccuuuuccucucauaaauguacaguagagcuuucuaaagguuauaugugacacuugcuucugcauucagucuguugcaaugagaauacaguugacuagaucuauuaagccagacguuaaagaaauguaaaauguaaaacuaugccagccuuacuuuuuaaaaauauacauauuccucacuuuaaaaauauuuuuuaauauguaauggguuugcuauuuaaacagguuuuuaaacuuucucaucuuaauuucuuauacaguaaauauuuauacacauaacaaacaaaagguccugggguccucaauaauuuaaguguacaaagggauccucugaucaagaacuuugagaauuacuggucuaauucacugcuacauaagcaugccuuuauggugaaucccuuuagcccauauagauaaaccuuagaacagcuuccaacuacucuccuuaccuucaaagggauguuccuccagcucugggacuauguaaacuacuucucaugcccaguacuacccugauuuauaagaaaaaaacgugaaucaucucaacugccuuuaauguaaaauuuuuacauaaacauugucggggaaacaugaauauaacuguauauucugguucucagaaaagaugcuuuauaaagcauaacaagcuauuacauguuucauguugcauacuuacacugguuuagaaaaaugcuugaguaucuuaugagucucuccuacacaauacaaagcaugccagaagcaguuuuucacuuucauuuggggguuuacacccuagucaggaagccaugcaugcuccaucuuccucucaaagcccuggugcguuccuccucaaggccccuuuagccacaucagcccaugucuuuugcuucaguuuuccucacacuaagccauccuguaaaauugucccaaggcuggcucucucaaacaaaauaagagaaauguuccuguauggauuucaguguccucuagaaacccacccauguuccaauaaucaaaacuuuuuccuuacaugcuaggaguacaccacacuuaauccucuucuccugggggguugcgggugggguggggggacaagucccccuaucuguauaaaagagcuucacaagugcuacuacaucuaccugguuucaggaaccuuuucccaauguuugcagcagaccucaccaaacucccauaaacucacguuuucuuccucuggacugucaaccagacuuggagaacuugagaguggcauccacauccuaguguuucugagcacccaacgaccaugcacaacgcucagcucaaggcaggcacugaaugcuaacaaacagcucauauguaggaaaagugcaaaucuauuaaaaugcucugaaaagcccaagggggaucagcuuuugaaguaauuaguaauucuauuauaauaauuugugcaaauuaaaaaauauauauuugaugcaaaaagauaaccacagaacuguuuaaaagauggauuuauuauuuauuuauuuauuuauuuuuuuuuugagacggcgucucgcucugucgcccaggcaggagugcaauggcaugaucucggcucacagcaaccuccaccuccuggguucaagcaauaaaagacagaaauauuuaauuucuucaaaucuacaccugagagguuaacaauuucaugaacacuuugaacacuuucaaagaaaauacaaacauguaauggcacaggugaggaaaaguaaauacuuaauacauagaucuuuuugaaugcucucugaaccuugcuuuuuacauuucaagaucagcacauacucuuuauuuacagauacuauauaauagagauauauacccugauuaauuuaaccaauccccuacugaugaacauuccaagguuuugcuauuucaaacagugcuuacaauagauaccuuauacaguaaagcaaaaauguaaauuuaaagauagaaauugcugguuuguagucuauuugcauuuuuaauuacgcuagucacugccaaaaaaaacuucugaaaacuuaucaguuugcagucccaccaaagcauaaccuacauuuuuaaaaaggaaauaaugcagcaguguagagagggcacugggggaaguaaaggcaagucgggaaccagccacaaggucacagucaccaaccacaaucauuauaccuaagacuuuagacaauacaucuuagcaucaguucugaauguauaugaaaugagacugcuguucaacacuauggguagggccuuuccagcucuaacauucucugauguccuugaacuuguuauauauaagaaauguacauuaaauaugaagacagaaugcuuauccucuuggacuacccaaggacaacaaauaaaugcugggaaagucagcugcaacacugggaacauaaaugcucugacaaaccccugcuaggaauuucaaaauggaagugaaauugagacugaagaaaaagaccaccuaauaggaaauauaaaaagccauuucaaaaaugauaaacaaaagaaagacguuaaucauuuggggauuuuccuaguuuaaaacaaaccacaucuccguaaaagaaauauggcuaaauggcuauaacaaguaagggccaaagcacccucauggcuacuaauaaauaaaacgguacaaacaucccuuucaagucuaccauuugagagaguggauacuaacaagagauaugauuugcuaagcuaaauaaaagccuucauuaacaagaagugacaggaucacaacccugcugcugauaaacugccaacauacccaaggucuucaaugaaggguugcccauuuaacauacugcagcuuuaaaaugaguugcuuuagaacgaacaguucuaugucaaggcaggccuacaacauacaaaacagauggagcugcuacuguaccuugggcuuguguguguacccaugcacgagcaugagcuuggcauauaccacaggagaaccuggcccaauaacgcuucuuaaaguuagccauccaugauuagagcaucuaccuuagaccucaacuucucuaucugcuuccaaagauacucaguguagagcagaaaacauucuucugauagccgaagaggguuccacauggcuauuaaaugacuggcccaguggucauccauggagaccccuccuuauuccuggcaaacacagucauuucaguccaaccuugaagcagccaauaucuuuucaauacagcacacuuugaagcgguauuaacaggucauaaauacauguaaaaagcauaguuucagcuuagucaaagugguuacagaagcaucauuguauauuuuuuucugggugguccaaguaaauuaaacucaccaacuagacugcaaacagauaccauaaauucuuaauuauucacagguauggaugaaaagaaauagcacuuuaauaaagucaucuuaaaauauuauucaguauccagcacuuaauuaccaucauauaguagugauaucuaaaaaacauagaaauguuugcuauaguuuaaauauuaacaauuuuuauuaacuccaauugguuaaauauguaaguuauacaacuucauagcaaccaaaauaccaaggccgaauacacaauuaaaagaaaaaaacuugcauguaacauuuaccuucagcauauauaauuuuaaucuucauuuuaaagacauaggaccuauuagauucaagaaaucagacuagccaggugagguggcucaggucuguaaucccagcacuuuggaaguccaaagcagaaggaucccuugagcccaggauuucaagacaagccuggguaagauggugagaccccaucucuacaaaaaaauuuaaaaauuagccaguugcaguaaagcaugccuauagacccaacuacucaggaggcugaugcuggaggaucccuaaaagcccaggaauucaaaguuacaguuaacuaugaucaugccacugcagugagacuaaaucucuuaaaaaaaaaaaucaguaauaagacaauaagacccacuauauucagaaaacaaaguuauaagaaucacugacaucaaagagcuuccaauguaguugaaaguaacauuuaaguugugcccugaaaauuuaaaccaauauaaaaagcuauuaaggagagaccagacaccaaaggcaaugggaaguuguuaccccaagugcccauuccguaacagcuccuuaacucucauaccugcugucccuguaaugccagaaguaaaauuaaaauucuccucuccugaacuaaaacuugguuuacuucucuccaaauuccaucaagaguagagguuacugucuauauuuucaguagcuuccuucugcaccuaaggaaaaggggcugaaaucuaaaagcugugaugaaauaauauccaccuacaaaaaaaugcuauauccauguuaaaucaaacaauuauaaaugguauaagcuaaaaggcaugcaaaguuuuuauuaucuuccuaaagaccagcuuauauuaaaaauaaaacuguuugccagaguccaccucucugaggaaacuaagagccuagucaaguaagcuuaauaaucuaauaagguggucagaaagacacuauuuuaaaauaucauauccuugccaugcauucacuguacuguuuaggucuggugaucugugugaaugaggaaacuagccagauggaaaauucacuuccucauuuuccuuaaccuuuuuuccgugucuuuuccaauugcuuagaguaauuucccauauucuacccaucucuuacgaacauaccuagcccuuuaggauuaaggaacuccacagaagccacugacauuuuuuuaaaaaguauuuuucgacacucuuaaacaacaaaugucuuccaaaguuucuacaaaaaaaaaacugccuaagucucuuccacuccaacaaauauuuuaaaaacaauuccaauuaauaugguauuuccuuuuaguuauaauuuaaaugaauacuggaaggaacacaauaugguaaagcaauggggugaucugucaaagggauuaucuaaaaggucauucauaaacaaaccaaauaauccaaucaaugacaaaacacaacuguggaugaauuagugaaauucuaauuuccgccaagcaaaaagccuaacaaauauuccuaaguucuuacugcaucaauuaauacauuagaaaguguuauuuaaacaaauacugauaauauuucaaaauccaacacauuuucaaagccauggguaaagagaauaaaggauuuagacaaugcagaucucacugcugggcuuugcauucaccacauagcuuucagaguaaaaguugccaaauuacguuguccugcaaagaacauuaaaaucgguuucucguaaaaaauauaaaaagccagauccauggugggauagaagcuggguggcaggaaucagcucuaggacucaaaguucaccaucaauuuaucaaggagaauagaguuuaauuuuaggaccucugucuauccuuaugccuauaaaauuaaaaacuagucuguuuuuauguacaguaaaaauaagguagcuaggaaggaaaucaacaaaugaucuucacuaaucaccucccacacuguguuauaagccuuaaagguuauuuuccuucacagcacaaaucacaauuauauguaauaauuuguagaacuuuaacauaauaucuccuccaauaaacucuaaguuucauaucagcagggaguauacuguauucacuacuauagucuuaauaccuaagguaguauauguggcauauagcaagaucacaaauauuuacuaaacaaaugaaaaucugcacaggaaaccaagaaauguucacauguaaacuggcaaaauaauugcuuuuaaaguacuggggggcagaaaaggcuggaucagcaaaucaaaaacugaauagaaggacaaucaaaaagagcaaaaugccauucaugucaggaggccagacacaauaaaauaauaaaauguuaaaugcuaggaaaagagagauaaguuuaaaguuuuaaaguggcuacuaauaaaaacuuuagauguaaacauuucaaauauucauaggcuauuuaauaaacugucaucaaauugccacauuucuuugagacgauaacagagaauaaucacagggaaugagagagagaaagaaauguuagccauaaugaaaaauuccuuauggguaaaguuccagaaaauuccuuaaggagucugaacuauaacacccaaaacuuaacaaagucccuggaucucuuaaugcuucugaauuccauagggaacuggggagcuacaaagcauuuuacccaacaaaaucucugguagucuucgccaaauuuaaggaaacacaacaaaaauuaaagagaaaugauacguauuaaggucaaaguuuaagguuacuauguccuauaaaaugugaugaugaguaaaaugcuauugagcuuucacccucaacaauuaacuucugcuucauccugugauauucuaaauuacagcuaaccaguacggagcagccuugucaggaucccaccugacugcuuugugcauagccuguuggccaauuuuauaccagaggcaccugcuugaaauauguagagacaaucugaugaccuuauuuucucacguuuacaccagcuuuccauagcacaaggacaauauuuauacucuaggaagaguaaaauauuugcagagauaagaaaucagagaacauguuggcaugaagcuauuucagcuucucaauucuaagacauuuggacugaaagaugcacccacuaaccucacagcuuugggggacauagaaucaggacauuaaguaaacuuaagagacucaaaaguaauauaaaaauugcauaucuaagacaugagaaaacaugggauuaguuaaggcaguuuuugcaaaaauuucccuguagagauugaaauucuaguaagauuaccuaucauucaugauuuacuuacauaugcaaauaauuuucaauugauuaucagucucauguacuauauucuuucuuuaaauuauuaucucuauuccagacuuuugaguucugcuguuccagugaccuccacaaauuuuccugaauuucuccuaaaaacacacuaugugagagaucaaguaaugaaaaagagcacauggccucuuucuagggaagagcaaaaaggucauuuugaaucuguaauucuuugucauccacucccaaccaauuuuucugacaguaaaguuggagaaacaguaaaguuggagaaauacugaaaacuuacuggagaaaggugaaucaagaacaaucuuuacugggugaauauuuuguuuauuccaauuuggauaucaaacauccuauugaacacuugaccugccauuuuuuucucagaacaaaaaguaguauuucuaaaauccugccugauugggaacacauuuuuuuucauaaacuuaacaaguucaaaaaacagcccuuacagauuaucuacuacaaugagccaggguuaucucaaugucacuuucaccuuuuucuugauuuuaacagcauccuaaaaaaagccugaagacagugucuucauuuccuugcuuacagaaaauaaccaauccauacuuuguaugguuccaaaaaguaauccugcaagucaaggaugccagcuggcaucagaaagucaccagccugugauggaaaugccuccagaagucacccagucauggaccuaaaauaauccaaggucagaauccuggcccugaggaacaaguugugggcauacugcuaggagugcuacagggaccacagugaagcuuuaaaaaaaauuauaaaaauaaaaaauaauccugguacaacaaccccaccacuggggaaccaaacagccucuaaagcaauuuaauauggaggugagauacaauugcugcuggagucacaccauuuuauuucaaaacaccccuaagagaagcaauacauucucaaacaugaaaacugaguugcuucuuggaucugauuucagccaccuuaaacuacagccagcagaacuaccaaaaguagaaagaacaucauucugggauccauggaaagagguacagaacuaggagucugaccugauccuacuuccccacuugguuguauccuugggcaaaccaccugaccucugagcuucauuuuccucaccuauaaaacaucauucccagggagcuguggcaaguuucuauaaggacagaaaaacuugguguuaaucaccauuacuagaggaaaugcuccgugucuccugguuccaucaccuugugguaguucaccaucuucaauugccaacuccacguauuuuucuaucuuccuaaugguaagucaacaacuaaaaaguggcagaucccugcugccccaucccaauccacugcuaacuugacuguccaacacaaaauuucuuacuguugcauucucaagggagagucauuuggaaguuaccauagaaguuguacaaaaggaaaaccaaaacagaugucuucacucuuccugucuaggucacaaacuauuauucacucuaaaaccaaagauuucacccuaccauccacaaaacaauguuuauaagucagccaaacuguuugggaaaaaauuuuuucaaaaaguccaagaaacaagaacacaaauuauuccccgaacagccaguuccaacugaaggaaugagccucuccacuaaaucaaaaagguaacgcagcguacaagcuguucgaucaccuuucaaggaaaaaaaaaaaaacccacgaaacaguaaugcaaaugccauuaagggagaaaagcaguggccaggccucagaacaccaagcacuggcaugagaaagccauagucagcagcccagacaacacaugcuccuggaagacauggccuuagccaugaagaugacgcaaggagaaggcauagaucaaugcucugaaaagcaccccagcuucuguccuguuacuugcuucuugcuccugcaacuauauucccaaaagggaggaagucaaaaaaguuguaauuauuuugacuuuuuccuagguguuuugaaaaauaaauguuauacccagaggaggcugcuggcacauaauguugucaacagaauaaaacucugggggaaacacccagcuucauguaguuugaaacacaacgugccucagaucuacucuucugggacaacaguggaauuaagacagucacagcuugucucucucuagccacacccucaaacuugaguagguuuugcagaaauacuuuucaccugugacugagcuccuggcaaacuaggaaauaguuacucauaccauaaaagaaaaucaaagguaacaaaaacaauaugggaggaacgggggagggaaauaagacauaaaaagcaaaaaauagacaaaauggaccaagaaaagacacaguccugucccuaaagcaauaagcaacaaccuggccugaucccuugauucccagacaacagggauauaucucuuugcuuaauuccucaagcacucaguuucuacuauuaaaugcaagaguggggagugugugauuuuuuuuuaaguuaucauuuucugccucaucuccuuagguagagaccaaggaauaugagguaaagggcacuuuauacaagucucaacguucucaguauccagcacucaguaauuugugaugaaacaauaaguauuacacaaucuuccuggcuucugaacauaaucucaacacaaaaccuagaagaauauuuuuauugauccuucaacaaacucaaaaacaaaauuagauuaauuuggaaaagcccuaagcuucaaguuaacuagcagcccacauauaucaaagucauucuuauugcacaguagaagcuccacgggaaugacucccaaucuuuagggggauaaaacaugcuuguuuuuacugauauucaauuccccaccccaacccaguaacuaagccacccugaggugccgcaaugagaugcugcagggagcaucaaaaacaagcaacacguucaccuaaaagaaucauauaaucauagaauagaagaugcuugguaccaagaauuuuuaagugccucugaaaaauaaguuccaaauguaccuacaaugauuuuuuaaaaucauacacaguuaauucaaaauuaaguuuuuaagugagcauacacuuauacuaacacuccaaauaucaaaaaaaaaaaaaaaauuggcuggguuguagaguaagccaaugcuuaaaacugccaacauuaagcuauuauucugaaggguuuugcuaagauguucaauacaggggcacauucugauucaucguuauaacuggccuagcugaaguggcugccaggagagcaggguuuuaugggcauuguuccauccuaagaagcuacauuaaugcuggguugauacaacagaucuucauaucuauuuaccaggcugaacaaaaguuaacuagaaauguaagugcuuaaagucaccaaaaggaaggcuccacacugacauuuucuaccuacuuagcauucaacuauauucaucucacuagacauuaacacacaccaaaguugcucucugcuauucaaauugugcuauuaugcucaggaguagauuaauauuauccaccuuccuuauuguaaaauaaaauuacagcauugguccaaacaugacauguggagccucuuucuacuucugcuggugcaucagucugcucuacggcacacauaggagagggccuugcuaaggcugcccugcugcuucuggagugggggagaaaaggcugaagacugaaaaaaauaaaggggaaagggagagaaauaacacacacacauaaaccacacaccuggaagucucauaucggcuuuuuuuuuuuuuuuuuacaacaaucuuauaaaucuguugucauuuauaagcucacaacaucagcaaugagguuagcaggugggccacaggccucuuuuaaacagcucauaacauccuaucaguuuuuacagcaucaaguagcaauguugaccccaaagcaucugaauaaauagaagcaggcaacuggcagggagaaaucccuacucccaauggggacaguucuaaaaucccagggggggaggagagaaaagguaaguuaagcugagagaagcucauuuuauaaaaggagaaacuguuuuucaaccacggguuaaggaaggagagacccaagacaaaucuucucugaaguaaaggagacuauaagaucuaaauauguaaggagcaguuuaacaugauucaaacauuaucuguaaauacaagagaucaaacgaauauaaaaccuuuagaacuacugccuuugucuuuacacuuaacuuuuuaauucacguggcuuuaggaaguauagcauuagagacaccaaggccaggcaaacaaaccaaggucaaagugaaacaagccaugcuucauccuuaaggcgcagucgauaaauguggacuccauuguuguugcuccauccuuccaaguuuucaagaagcaauacauuuggcuccagaucuuuauauauuaccaaaccguaaaucaacaacucacaacuauuuaaaacacaguucagggcaaucaaaacaccuauaggccauaugaagcucacggaucacccuucaggaccuguggcacaaauaauuuguccacugauaccaacugcuccuucugguaucagugauucacuuggucacagaagauauucuucaguaaguaaaauguaacaaagugcauaagagccaaugcaaaagcccaagcaggauaagaaaauaaagggacaagugagcagguugcaccugaccccaaauuaccaggaccuggaacuaagcacaaggcuaaaaggauaaacaagggacagagggcaaguacagacgcaucccaaagaggggaggaaggcuguggguaguucaaauuccuugcggagacuauggagaagggaagagaugaaagucaaaagcacugaugaccucguauuugggaaaaguccaugggucauucagaggcacaggacagaaaagaccccaaggguuuuuaaacaaaauaagccagcaaucaguaaauagcaccuggggagaucaaaagugguguugaauaaacucaaauagaaauaggccuuaccugggaacagguuauaaaaucuugcucccucuauaauaaauguuguauauuuaacacauucuggauaccucugcaauaaagguggaugacccccucaccugccauaucaccuccaauaaagcaauaucaguauaacaagaaauucuuacuuuugaaaagcagcucagagaaaacaagaucaagugcuccagaaauauuuucccauccuuacccaauucacugaauuuauuuucagauacacugugauuugcuuuauucugauauacacaaaugaugccuaaagaauaaaaaaagugcuaaacauccuuuaaaagcugaacaagugagcaauuuccaauaacuuacuugacagggcauccaucaaugauguucacaccaucagcaaugaggggaaaaaaauguauuucuauguaaacuccauuuugugauguauaggaauggauccuugauaagagguuaaauaaaauucaaaucagagaaaacgcggacuauuuuaauauaaaugguuaaauuuaaaauuuugauuuuucacugaaaaaaauaugagaaauuuaaauuaagaaauuuauauuccuggaauguuagcuggcuaaauucucagucucauauguaaucuuuuagcauuauuuauauuuucaaggaaaaugcauuuuaaacuuuccaagucccaucaucauagguauaaauaugucuauuuccauacugaaauguccaaagucacaauucucccaaauccucccugcagucugggauuuuucuuuuacuucauggcagaaauaaacauaugaugguguauuauaaaaaaacaaaaucacuaaaaaugguucauaacacauugaaagccaaaaauauaaaacuaaucaagcaguaaccaccuacuaccaccuuuccaauucagucaaugucauuucauugucaaaaaaucuuguacuucaauaugcucaucuuuacgugguccuugagauggggaggguaagauuuuauacacaaucaaagguuaagaaaccaaggauauaaguaauuaaaccaaaccagaugcugaaaacuucagacuucuagccuacuauuuuccaccuggcugugcuaaauuaagaauuucaaccuaagugacaaaaccuacugagacaacucagcaaauuggccgcacgggcacggugaucacaagaccuuaugugugugauuauuuguuuacaaaaacagaauggauuuuaaaacaaacuaugagacaggaaagcuuagagucagucauccuucaaagaaugcuaaaggcccacaucacuaacucaacagcagacaagaaccucugaaugacuucacccaguucucacuaguauaagaagacaacucuaauugccaaaguccuauuucccaaauggaaccucauuuuaacacgcuuucuuccaaagugcaaaauacuaaaaacuguauggaaauuucuuauuuguauauauuucucuaggaagagacagcuacagcuuucuucaaaugcuuaaagagauucuagccccucaauauuaacaagaacuuccaauuuuacaaugacucuaaagaaaugcaggaaagcuaagaaucucaaaacaacuaucauucccuagucccauaaagagaugaaauuagucaagaaaguguguacuaaaagcuuucaguaaaaaaaaaaaaaaaaaaaaaaaaaaaaaggggauaaaaauccaucuugaaggaauaguuuauugcuuugauauuuauaaaagauuuuugugauauccuauuaacauagucuuuaaaguugcugaaauaaucuccaauaaugaacaacccacaaaaacaaaaugcuggaagaaaagaacauuuagaauauaaauuucccuuucaugauaaacuuuuuaagucaaaggaaaaacccaaggauuaaaucuaucacuacagaugguccccaauuuaugaugguucaaacuuacgauuuuucaacuguauggugauauaaaaguaacacacguuuaggagaaacuauauuuugaauuuugauccuuucccgggcuagcagucuaugguaagagacucucucgauauagggcaaugguagcaagccacagcucccacucaggcaauggaucaugagagugaaaaauggauacucuguguugccagaugauuuugcccaacuauaacauaaauguucugagcauguuuaagguaggcuagacuaagcucugauauucaguagguuaggcguauuaaauacauuuuuaacuuaaugccauuuucaacuugcaauggguuuaucaggagcaucuguauuagauuggccaacggaaaaauauacagguacaucaaacuguagauaacauaccugguucaaaauauaccagugcuaaagcaaaaccuucacugugucuuaaaaaaaaaaaccuaucauuuuacuguuacugucuuacaguaaguauaauuuuaaauuugucaaguuuuuuaaaauacauuuuuaaaagugggaaaggggauuuugcaugucagaccuuaucuccuauucauuuucagucagaaacugauguaauagauaucaguaauauaaauauauacuaagaaacugcaaguuuauuuaaaaaaaagacacuguaaggcauucuauaaacugguuuaguuuuauccccauuccaccuauucuuaugacuuucuggguuauuuuaccuauuuuacuccucaaagcccccauccuucucuucauaaagauuucuuacaacgaaaaccuguaucuguugucacacagaacuauucagcaauauucaaaaagguaccaugucauuaagcauaucaauucaguucacgcauugagagccuaacucaaagcucugagaaaagaaugcucguugcaaaaauaguuauuuuuauuaagaccaaucucuagaaacuuaacauugauauuaaagaugaagaugucuaugagaaugcauuuagcacagcguugcucacacaagaguuaccuuuuguuuuguuuugcacaauggaauacaagcuuagagauaaaaaaaauucuucccuugaaauaaaaaauucuucuagccuuacuaaaaugaaacauaugauacacaucacacaagcugaaagccaaaucuguuaaauuuacuagugaaaaauguccuaaguaccccacaaaaaucuaagauuuuauuacgcaaacuuugacuuuuaauucagacuccaaaaguuaucauuuaaaucauaauaaaacacuuaucuuuuaauauguaaaagccuuaaaauaagcacugccuuucaagcuuaagugucuucuguuuccacuuggcaaauuuacguuaugugaaauccuuaaauaauuaacuagcacuauaaaccgucuaguaucucgaaccaaauaaauauacaauaaauguucuucccaaauuagaacauacaaaaguguggauuuggcacugaacuacaauaugugggcucugugcguaaccagaaccggugaagacuucuacaccuguaaaaugaaaauggccaaagcaagaaaaaauuuuaugcauuuuauguccuccauagugaauuugauagucagguguggcaucacuagacauaaagccuucaaacaguucuauaauauaucaacaaagcagcaauacugacagcuaaauacuaacaagugggaaggcaacuaaccaggaaaagcuacguaaucugugggucccagugcaagaugaaaaugcaggguaaccuuguccaaaaauucuuaagaauuucaagauuggguaggaugugcaaccauaccgguuacaagcuggaaaagcaguccugcccauaacuaaguacucacgccaaaaauaaaauuaaccuccccccacacacacucaaaugugguagcuuacuaucauuuuugaccuguccagcugaguagccaagaaacaaagagcuggggguagacugagaugggcagguuuuccacaggguggcacaccaucuagcccccuuaaaaugucaacaaaaaaguaaccaaaccaagcuaaguaccacagauucuagccucucucaauuccaaauaaacauuaugagugauaaaaguggcaauaagaaugugacgaugugauagauuuaauaagacaucaaaugggagcgaaaauacugaugcuaccaugcagacaagucaucaaaaaggggaaugguaaagucagucuugauaagaagcuuaagaagcuauuucagaguaucuaguccuuuggggaaaaagaacaugaaggcuaauuugccacuguggugcucuugugcaaugccaauaaugccugaaaagcgucacagguuuuuuaaaaaaaugucuuucagcaaagaaagaggaaaagguugaucccagcuuaaaagucaggauauucuggaaggcuuugcuguguccuuaaagagaaccuaagacuugcuucuagaauagaagugggguggcaggaggggaggcacauuauuuuuaaaagauaagcagggaaggcuggaagagccaagagcgguugguuacaaggauucagcuagcagcaucugucuguguauaaauaaucaaaagguugauucaaggaaugaugguauaugacacucacagcaucauucucccuuaaccuaccaggagcugagucuuaacuaaaaccacugaaacugggacagaaaggcuuuguuuuucucuugugaagaggcgguaaccagaacaaaucaaccaaaaaaacuaaaucagagaggaucuauaaaaacacaucuuaggccuagaaaagaaaaaagguuccauaguaaccuuuugacacugagugucaaaagagugguagacacugaccagcaguggguacuugcucuaaacaagaagcauauccuauaacuaaaauuaucuugaaccacagggaaagugugugagcacugaauauagcugacuugauuguuccugaaagaagacacuacacaaugaaggaaacaccuacagauaaggaagagggaggggcuuaacaccuaaaguugucuuucaaaggaagaaaaaaacaacuaacucccugaaagguggcagcacaaaguuacccaaauaacaggcaacaaggggcugguuuuaaccacacaaaaauaaaaauacucucucaaaaaggaaaauuacaaaggaggaaucacagaaaauuuaauguaacauguuucuucauauucuaauuuuuccuaccccauucuggccuuuaucuuccagauguuuucuuccucuucuuucucuccccauaguuugcaagcgaacuucccguaaguauauccuccccacaaccuuaaguguuguuaccuuagcaucccuacaaaccuccuauaaagaaggccccuaccacaaaugcaguaacauucggguccacucagcaauacagucaccauuuauauauacccaaagguuacuaagacaagguagaugcaggacagcuuuuccacccgcucaccaaaauggaaacuccaggucagcuuccacaagaaaugggaaauucaagcgacucuggcgaaacgauucuugagaaaacucuucaagggcaacaaaacaauauuucaaacaaacagauuuuacuugagggaauggggacauuacacagcaauugauauucgaaugguuuuaaauggacugauucgccguaaguuuugaggcugagcuaaauuuuuaugaagaauuauuaggaauagggccacuagaaaauuaaguuuuaaaagcgcuuuuguccuugccgaagguauuacauuuuggcacuucuaagaaccguucuuugagggagggaauaaaggagaguggacaacucguagcaaauccuuuucccauguuuucagaaaauguagagacgauaggacuugaaaaucuuugucauaaagauggucuuuaaaaaugcacacaauucuaaaugaccaucugggcagcuacaacugcaugcucauagcucgcaucuagaggcaugguuuuacgcucuggcccugaaggauaacaaggaggcuuuuaaggaaaugccgugagaaagacugcuggcuaagcauugucacggccacuggaggagcaccugccagugaaccgacgcuggcucccccagucucaccagugcacgcacacuaguccgugcaccccggccgccgcuggcaggcccuaccagccaagcuggaggagcagcugccgcaaccacggcaagcgaacugaaaucccagagccggccucgcccggcagagcgcccgcgcuucccgcgcagcgcacgccucgcgcgcaaacccgagaugugaccgcgagcugcgaccucgcgcggcugcgacgggccucaccuaacgcgcacgaggggaucaucauugcuccugcccugggcgcccgcggcccuacaccaccuccgcacacaacgcggccgguguuaagucuccaaacgccccgagagcuccaaggaccgcgcgcgcgaaggcgccguagcaagugggcacacaccagacaccaccccggcguguuccgcgggagaagccagugcacacauccucccgcaaggcgggguugccagugcaacacaggaauccugcccuuuuucuagaaaagcccccucccccacuuucccuccaauacacucaccugcgucucaacaguuuccuucuugcgcuacacgcggccgcacccgggcacguccacgcccgugcacgcugccaggcgcgacuguccccgcucggcucccgccgcccccaaccugcuugugcccacgggaggggcggugccaccucccgaggcgcccaauucucucuacucccgccgcaacgggcugagcucuaggaacuucgcgggcacaaccuccgccgcccccaccaguguucccgcccagaguucggacuagggcgcaccaccccuacccugcuagacgcagcgggggcgcgcacagaccuuagccucggcguccaaaauggaccaggggcaaggcgcggacgccguccccgcccccacgcccccagcacuugccugcugugacucgaagcugcagcuacuacggcucgugccgcuggccgucagcacugccgcggaggagucgcucggggcgagcuccgcggagaggcgguggcggcggcggcggcgggaaaggggacuggaagccggcggaacccccgccccacccgcgccgcgccgcgccgcgccggcaaccgcccuccucacccggccggcuacugccucagugacgcccaggcgccgcggucccgccguuuguagcggggcgggaaggaggggcuugcuuggaagagcgccaggaggcggggccggcggcgaguucgcggcgccgcggccgccgccggcgcgugcccugcccgaccgcccuucggguccgugccggcagggagaugccgggcuucagcagcucagcuccgucccuccggacuuccgagucucaccaggcuuccccgacaagguuucucuggacucgguggagagcguugagcgcccagaggaggcugauuccaggugcaaguuugcaaaucccgaggcccggggcgcuaacggggagucagagcagcuaacguggggguuacuuuauguguucauaaauguauuuauaaauauauauaaguauacacacauaugugugucucuuuuaaaaauucucuuuuucccccuacuucgcagccaagggguccugucccuggacagaaaauaaaggcuuagcccccugcugccccucccugccucucuagagagaaccugacguuuaaauaagcccagaguaccugugcggggugcuguacucugcuucaaacgcaaaguaggaaauccugcacucgacuaugcaaacgcuugccgcuagccgcauccuucuaucgccccccaacucaagacccgaaauggccaacucuucaccgagggggcgucccaucgcugccuugccuuggcccgccccuucgccaagcucaaucccuuuuccccagaaaaaccugugccuguccucagacccggccccacggcuggaagucaaaacccaccccggagccacgcggcuggagcacguuuuuacaccugcucggccgcuuaauuacgagagcaccuguaguugggauuuuuuucauugcaaaggcaucgauuuuagcccuucuccuaaaauacuacauuuaaaaaaucaccugucauaccuaccugaaauuguaggagguaagagaaaggaaccgagcagugggcgacccagucgccgcaagaacgugaccgagguuacagcuucaagggcaugaugcagguuugaugcagcaagguccgcuaagggcguccagcgcuccccgcccccaugcgacgggcggagcgggguuggggggaagggaggggacucgucuaacccagggcgggugugggagaggcaaauuugcccucuugggcgaagucuaaucagcauagugaaguagggggcucaaccaaggucaaaagcgagauaggccaucccuuaauuugugcgacccagucuggggacaccggauacagcuaacugauucuauaucagcauuuccgugucaccccaaauccgauuugcaauuaaaugaccuuaauugacuuuguguggguuccugggaaaacugcucaaagcgccugcgccucuuugaccucucaguaaauaguuaauuauaauauucucaucccaggcacgcgggauugcuaaaaaugccuauuuccaaaacguuaggcgaaaaugggccuacuuaauuugucaauccaaaccuaaaacucuuagaaugcccuacgcccuacuuccugacgcugacuaaauuaugggagagcucucagaagaguuccccaagucuuccaaaccacuucuuccuacaaccguagcguuuuuugugaagagcuccagaacagguuagcuuuaugaagcggggugcccaagcacuugguuaaaagagggaacggggaagaagugccugcuguaagacacauucaggcaaugacagcaauaaguaagggcgagaguuaaaaaauaaaauguuaaccccauaacaacuucgaaacucucaacauauuuuuuugcgggcuuaucuguucauagucugacaaaucuuucagaugucccauuuaagaagccauuuuacaaggaagucuuaaggcccaaacacauuuccuacccuucuguuccccaaaacacgaacacccuuuuucugaccuuuagaaacugauuuucaauuuggaaaauaauuucuuuaguuacuauugucugcuguguacuuucuaaaaauuuucauuguaagucuacguuuuauagguugcaguuaauaguguaggccugggaaauaaaacauuaaucucccucccacccccagaggauggguauaauaaauaggggugcggagaacggcugaagguuuagaaucuuaaccaacuggaguguuuguacaugagagggggaagggacagaauccgugcauuucggggagaaaguacagagaccuccaucccuguccagcaguguuaacaguaaauacuaaaugguuggcuauuucucucacccucgccauaauaaaaccagaccugcagccgguaauuacgagaaaauacccagucucgccaucaguuuugcuaaccgguacuugaaaaugggaaacggggaacuuauccaaccuccaauuugucacaguuguauagcuuucguauuaauucuguacagacgugaaauagguggguacguagcaacgugcugggcauaaauuaagcaacaauggccacgcgaggucucguccgccgcggagcuccaguggugggcacugccaccuugccaucccuagcccccaccgcccuucgcagaguccaguccgggaggcugacggugcgcuggcuuucccagccgguagaguggguggggugaggagcaacgagacguuaaccccagccggcuuuguagcuuuuucccauccucugccucucgagcaccacaugagcgcucucacgcacacacucacccacacccccucgugccaauaauuuaaacuucucuuaggaaagccagcagcuuguuccaccaccaccaccccuuccgcccuccccggcccacgaacauccucccccuuucccacaucuacccuggauccucucuuuggcaguagaaagccaaaugauuucuccuaaacccugagaaaucacaaaaguuaaaaugaagcgugugccuaucugcccagcuugucauccccaaccaucuuucuccuggcgucaauuuaacaauagcuauucgaggaagugggggcgguaaggagggggugagggcuacguggccgaguuggcuccugggguggcugcgaagccucgcggcugcagagggguucccccucuccccgaaggcgaagucagccgcguaggaccaaggacagggcuuggaauccacuucccagcgcccagcacagcgaggcucccaagcagccggcacuucauagacacagcuccaaggaucuuauuuacgcuuuucugaacaaagggaaucucauauccgguacaggcuuaagaauucagccccaaauuggcuaucuucuuuuaaaacugaauuaugauaauuggaguccgugaaucagagcccgcauacaaugaugaguucugacagcuucuaacaacccuagccucagcccagccccagccccagcccucaggcggcauguacuuuuuucagucaacuacaacucgcugccuggugcagcaucuaaauuccaucuggcaaucccaucuccccagcacaugcuaucugguuaaugcaauuaagccugugguuuucgcuggucuaaucugccaguccaggcuucugauuccccuuaaugauuguaaagccucucccguccuuccguugcugagccaaaguagaggcaugcauccccaacacccaaguuaucacucucuccccacgaaaugaacuuccgaucucaaucuugaagcucacuccacaucuaaccucccauuguaccccuacuccccccuggccacauuuaccacuuaaguuucugccauggacauuuacgaauauucaguacgcuaagcaugcguccaccgucuuuuagucuagcucuuuaaaauuaaaaaagcagaacaguagcuuugaaaugagacaaacaugugcaauuaacuucauauucuguauuccgcucacuuacagguuuucuggguuugccagcgcaucgcugcaacuaaugauuaaagaaaccaaaccgaaacuuaccuuucucccuuaagguuuuuguguauguguguuuuuaaaguaacggugcaguucucccaauaaggaugagcaagaagcugcuggauaguucucuuaagacagcacgaaaccuaaacugugcucggcuuaaaagaagcaaauaaaaagaaacgcuuucgaccccaaaguccaaugcuaaaagaaauggcgaaaaaaaauaugaaaggggaggggaaacuuaaaaaagaguuuaaaaagacggagagacuacccuccuauug

SEQ ID NO: 192926 - RNA, 135961 nt, Homo sapiens
caauaggaggguagucucuccgucuuuuuaaacucuuuuuuaaguuuccccuccccuuucauauuuuuuuucgccauuucuuuuagcauuggacuuuggggucgaaagcguuucuuuuuauuugcuucuuuuaagccgagcacaguuuagguuucgugcugucuuaagagaacuauccagcagcuucuugcucauccuuauugggagaacugcaccguuacuuuaaaaacacacauacacaaaaaccuuaagggagaaagguaaguuucgguuugguuucuuuaaucauuaguugcagcgaugcgcuggcaaacccagaaaaccuguaagugagcggaauacagaauaugaaguuaauugcacauguuugucucauuucaaagcuacuguucugcuuuuuuaauuuuaaagagcuagacuaaaagacgguggacgcaugcuuagcguacugaauauucguaaauguccauggcagaaacuuaagugguaaauguggccaggggggaguagggguacaaugggagguuagauguggagugagcuucaagauugagaucggaaguucauuucguggggagagagugauaacuuggguguuggggaugcaugccucuacuuuggcucagcaacggaaggacgggagaggcuuuacaaucauuaaggggaaucagaagccuggacuggcagauuagaccagcgaaaaccacaggcuuaauugcauuaaccagauagcaugugcuggggagaugggauugccagauggaauuuagaugcugcaccaggcagcgaguuguaguugacugaaaaaaguacaugccgccugagggcuggggcuggggcugggcugaggcuaggguuguuagaagcugucagaacucaucauuguaugcgggcucugauucacggacuccaauuaucauaauucaguuuuaaaagaagauagccaauuuggggcugaauucuuaagccuguaccggauaugagauucccuuuguucagaaaagcguaaauaagauccuuggagcugugucuaugaagugccggcugcuugggagccucgcugugcugggcgcugggaaguggauuccaagcccuguccuugguccuacgcggcugacuucgccuucggggagagggggaaccccucugcagccgcgaggcuucgcagccaccccaggagccaacucggccacguagcccucacccccuccuuaccgcccccacuuccucgaauagcuauuguuaaauugacgccaggagaaagaugguuggggaugacaagcugggcagauaggcacacgcuucauuuuaacuuuugugauuucucaggguuuaggagaaaucauuuggcuuucuacugccaaagagaggauccaggguagaugugggaaagggggaggauguucgugggccggggagggcggaaggggugguggugguggaacaagcugcuggcuuuccuaagagaaguuuaaauuauuggcacgagggggugugggugagugugugcgugagagcgcucauguggugcucgagaggcagaggaugggaaaaagcuacaaagccggcugggguuaacgucucguugcuccucaccccacccacucuaccggcugggaaagccagcgcaccgucagccucccggacuggacucugcgaagggcggugggggcuagggauggcaagguggcagugcccaccacuggagcuccgcggcggacgagaccucgcguggccauuguugcuuaauuuaugcccagcacguugcuacguacccaccuauuucacgucuguacagaauuaauacgaaagcuauacaacugugacaaauuggagguuggauaaguuccccguuucccauuuucaaguaccgguuagcaaaacugauggcgagacuggguauuuucucguaauuaccggcugcaggucugguuuuauuauggcgagggugagagaaauagccaaccauuuaguauuuacuguuaacacugcuggacagggauggaggucucuguacuuucuccccgaaaugcacggauucugucccuucccccucucauguacaaacacuccaguugguuaagauucuaaaccuucagccguucuccgcaccccuauuuauuauacccauccucugggggugggagggagauuaauguuuuauuucccaggccuacacuauuaacugcaaccuauaaaacguagacuuacaaugaaaauuuuuagaaaguacacagcagacaauaguaacuaaagaaauuauuuuccaaauugaaaaucaguuucuaaaggucagaaaaaggguguucguguuuuggggaacagaaggguaggaaauguguuugggccuuaagacuuccuuguaaaauggcuucuuaaaugggacaucugaaagauuugucagacuaugaacagauaagcccgcaaaaaaauauguugagaguuucgaaguuguuaugggguuaacauuuuauuuuuuaacucucgcccuuacuuauugcugucauugccugaaugugucuuacagcaggcacuucuuccccguucccucuuuuaaccaagugcuugggcaccccgcuucauaaagcuaaccuguucuggagcucuucacaaaaaacgcuacgguuguaggaagaagugguuuggaagacuuggggaacucuucugagagcucucccauaauuuagucagcgucaggaaguagggcguagggcauucuaagaguuuuagguuuggauugacaaauuaaguaggcccauuuucgccuaacguuuuggaaauaggcauuuuuagcaaucccgcgugccugggaugagaauauuauaauuaacuauuuacugagaggucaaagaggcgcaggcgcuuugagcaguuuucccaggaacccacacaaagucaauuaaggucauuuaauugcaaaucggauuuggggugacacggaaaugcugauauagaaucaguuagcuguauccgguguccccagacugggucgcacaaauuaagggauggccuaucucgcuuuugaccuugguugagcccccuacuucacuaugcugauuagacuucgcccaagagggcaaauuugccucucccacacccgcccuggguuagacgaguccccucccuuccccccaaccccgcuccgcccgucgcaugggggcggggagcgcuggacgcccuuagcggaccuugcugcaucaaaccugcaucaugcccuugaagcuguaaccucggucacguucuugcggcgacugggucgcccacugcucgguuccuuucucuuaccuccuacaauuucagguagguaugacaggugauuuuuuaaauguaguauuuuaggagaagggcuaaaaucgaugccuuugcaaugaaaaaaaucccaacuacaggugcucucguaauuaagcggccgagcagguguaaaaacgugcuccagccgcguggcuccgggguggguuuugacuuccagccguggggccgggucugaggacaggcacagguuuuucuggggaaaagggauugagcuuggcgaaggggcgggccaaggcaaggcagcgaugggacgcccccucggugaagaguuggccauuucgggucuugaguuggggggcgauagaaggaugcggcuagcggcaagcguuugcauagucgagugcaggauuuccuacuuugcguuugaagcagaguacagcaccccgcacagguacucugggcuuauuuaaacgucagguucucucuagagaggcagggaggggcagcagggggcuaagccuuuauuuucuguccagggacaggaccccuuggcugcgaaguagggggaaaaagagaauuuuuaaaagagacacacauauguguguauacuuauauauauuuauaaauacauuuaugaacacauaaaguaacccccacguuagcugcucugacuccccguuagcgccccgggccucgggauuugcaaacuugcaccuggaaucagccuccucugggcgcucaacgcucuccaccgaguccagagaaaccuugucggggaagccuggugagacucggaaguccggagggacggagcugagcugcugaagcccggcaucucccugccggcacggacccgaagggcggucgggcagggcacgcgccggcggcggccgcggcgccgcgaacucgccgccggccccgccuccuggcgcucuuccaagcaagccccuccuucccgccccgcuacaaacggcgggaccgcggcgccugggcgucacugaggcaguagccggccgggugaggagggcgguugccggcgcggcgcggcgcggcgcggguggggcggggguuccgccggcuuccaguccccuuucccgccgccgccgccgccaccgccucuccgcggagcucgccccgagcgacuccuccgcggcagugcugacggccagcggcacgagccguaguagcugcagcuucgagucacagcaggcaagugcugggggcgugggggcggggacggcguccgcgccuugccccugguccauuuuggacgccgaggcuaaggucugugcgcgcccccgcugcgucuagcaggguagggguggugcgcccuaguccgaacucugggcgggaacacuggugggggcggcggagguugugcccgcgaaguuccuagagcucagcccguugcggcgggaguagagagaauugggcgccucgggagguggcaccgccccucccgugggcacaagcagguugggggcggcgggagccgagcggggacagucgcgccuggcagcgugcacgggcguggacgugcccgggugcggccgcguguagcgcaagaaggaaacuguugagacgcaggugaguguauuggagggaaagugggggagggggcuuuucuagaaaaagggcaggauuccuguguugcacuggcaaccccgccuugcgggaggaugugugcacuggcuucucccgcggaacacgccgggguggugucuggugugugcccacuugcuacggcgccuucgcgcgcgcgguccuuggagcucucggggcguuuggagacuuaacaccggccgcguugugugcggaggugguguagggccgcgggcgcccagggcaggagcaaugaugauccccucgugcgcguuaggugaggcccgucgcagccgcgcgaggucgcagcucgcggucacaucucggguuugcgcgcgaggcgugcgcugcgcgggaagcgcgggcgcucugccgggcgaggccggcucugggauuucaguucgcuugccgugguugcggcagcugcuccuccagcuuggcugguagggccugccagcggcggccggggugcacggacuagugugcgugcacuggugagacugggggagccagcgucgguucacuggcaggugcuccuccaguggccgugacaaugcuuagccagcagucuuucucacggcauuuccuuaaaagccuccuuguuauccuucagggccagagcguaaaaccaugccucuagaugcgagcuaugagcaugcaguuguagcugcccagauggucauuuagaauugugugcauuuuuaaagaccaucuuuaugacaaagauuuucaaguccuaucgucucuacauuuucugaaaacaugggaaaaggauuugcuacgaguuguccacucuccuuuauucccucccucaaagaacgguucuuagaagugccaaaauguaauaccuucggcaaggacaaaagcgcuuuuaaaacuuaauuuucuaguggcccuauuccuaauaauucuucauaaaaauuuagcucagccucaaaacuuacggcgaaucaguccauuuaaaaccauucgaauaucaauugcuguguaauguccccauucccucaaguaaaaucuguuuguuugaaauauuguuuuguugcccuugaagaguuuucucaagaaucguuucgccagagucgcuugaauuucccauuucuuguggaagcugaccuggaguuuccauuuuggugagcggguggaaaagcuguccugcaucuaccuugucuuaguaaccuuuggguauauauaaauggugacuguauugcugaguggacccgaauguuacugcauuugugguaggggccuucuuuauaggagguuuguagggaugcuaagguaacaacacuuaagguuguggggaggauauacuuacgggaaguucgcuugcaaacuauggggagagaaagaagaggaagaaaacaucuggaagauaaaggccagaaugggguaggaaaaauuagaauaugaagaaacauguuacauuaaauuuucugugauuccuccuuuguaauuuuccuuuuugagagaguauuuuuauuuuugugugguuaaaaccagccccuuguugccuguuauuuggguaacuuugugcugccaccuuucagggaguuaguuguuuuuuucuuccuuugaaagacaacuuuagguguuaagccccucccucuuccuuaucuguagguguuuccuucauuguguagugucuucuuucaggaacaaucaagucagcuauauucagugcucacacacuuucccugugguucaagauaauuuuaguuauaggauaugcuucuuguuuagagcaaguacccacugcuggucagugucuaccacucuuuugacacucagugucaaaagguuacuauggaaccuuuuuucuuuucuaggccuaagauguguuuuuauagauccucucugauuuaguuuuuuugguugauuuguucugguuaccgccucuucacaagagaaaaacaaagccuuucugucccaguuucagugguuuuaguuaagacucagcuccugguagguuaagggagaaugaugcugugagugucauauaccaucauuccuugaaucaaccuuuugauuauuuauacacagacagaugcugcuagcugaauccuuguaaccaaccgcucuuggcucuuccagccuucccugcuuaucuuuuaaaaauaaugugccuccccuccugccaccccacuucuauucuagaagcaagucuuagguucucuuuaaggacacagcaaagccuuccagaauauccugacuuuuaagcugggaucaaccuuuuccucuuucuuugcugaaagacauuuuuuuaaaaaaccugugacgcuuuucaggcauuauuggcauugcacaagagcaccacaguggcaaauuagccuucauguucuuuuuccccaaaggacuagauacucugaaauagcuucuuaagcuucuuaucaagacugacuuuaccauuccccuuuuugaugacuugucugcaugguagcaucaguauuuucgcucccauuugaugucuuauuaaaucuaucacaucgucacauucuuauugccacuuuuaucacucauaauguuuauuuggaauugagagaggcuagaaucugugguacuuagcuugguuugguuacuuuuuuguugacauuuuaagggggcuagauggugugccacccuguggaaaaccugcccaucucagucuacccccagcucuuuguuucuuggcuacucagcuggacaggucaaaaaugauaguaagcuaccacauuugaguguguguggggggagguuaauuuuauuuuuggcgugaguacuuaguuaugggcaggacugcuuuuccagcuuguaaccgguaugguugcacauccuacccaaucuugaaauucuuaagaauuuuuggacaagguuacccugcauuuucaucuugcacugggacccacagauuacguagcuuuuccugguuaguugccuucccacuuguuaguauuuagcugucaguauugcugcuuuguugauauauuauagaacuguuugaaggcuuuaugucuagugaugccacaccugacuaucaaauucacuauggaggacauaaaaugcauaaaauuuuuucuugcuuuggccauuuucauuuuacagguguagaagucuucaccgguucugguuacgcacagagcccacauauuguaguucagugccaaauccacacuuuuguauguucuaauuugggaagaacauuuauuguauauuuauuugguucgagauacuagacgguuuauagugcuaguuaauuauuuaaggauuucacauaacguaaauuugccaaguggaaacagaagacacuuaagcuugaaaggcagugcuuauuuuaaggcuuuuacauauuaaaagauaaguguuuuauuaugauuuaaaugauaacuuuuggagucugaauuaaaagucaaaguuugcguaauaaaaucuuagauuuuugugggguacuuaggacauuuuucacuaguaaauuuaacagauuuggcuuucagcuugugugauguguaucauauguuucauuuuaguaaggcuagaagaauuuuuuauuucaagggaagaauuuuuuuuaucucuaagcuuguauuccauugugcaaaacaaaacaaaagguaacucuugugugagcaacgcugugcuaaaugcauucucauagacaucuucaucuuuaauaucaauguuaaguuucuagagauuggucuuaauaaaaauaacuauuuuugcaacgagcauucuuuucucagagcuuugaguuaggcucucaaugcgugaacugaauugauaugcuuaaugacaugguaccuuuuugaauauugcugaauaguucugugugacaacagauacagguuuucguuguaagaaaucuuuaugaagagaaggaugggggcuuugaggaguaaaauagguaaaauaacccagaaagucauaagaauagguggaauggggauaaaacuaaaccaguuuauagaaugccuuacagugucuuuuuuuuaaauaaacuugcaguuucuuaguauauauuuauauuacugauaucuauuacaucaguuucugacugaaaaugaauaggagauaaggucugacaugcaaaauccccuuucccacuuuuaaaaauguauuuuaaaaaacuugacaaauuuaaaauuauacuuacuguaagacaguaacaguaaaaugauagguuuuuuuuuuuaagacacagugaagguuuugcuuuagcacugguauauuuugaaccagguauguuaucuacaguuugauguaccuguauauuuuuccguuggccaaucuaauacagaugcuccugauaaacccauugcaaguugaaaauggcauuaaguuaaaaauguauuuaauacgccuaaccuacugaauaucagagcuuagucuagccuaccuuaaacaugcucagaacauuuauguuauaguugggcaaaaucaucuggcaacacagaguauccauuuuucacucucaugauccauugccugagugggagcuguggcuugcuaccauugcccuauaucgagagagucucuuaccauagacugcuagcccgggaaaggaucaaaauucaaaauauaguuucuccuaaacguguguuacuuuuauaucaccauacaguugaaaaaucguaaguuugaaccaucauaaauuggggaccaucuguagugauagauuuaauccuuggguuuuuccuuugacuuaaaaaguuuaucaugaaagggaaauuuauauucuaaauguucuuuucuuccagcauuuuguuuuuguggguuguucauuauuggagauuauuucagcaacuuuaaagacuauguuaauaggauaucacaaaaaucuuuuauaaauaucaaagcaauaaacuauuccuucaagauggauuuuuauccccuuuuuuuuuuuuuuuuuuuuuuuuuuuuuacugaaagcuuuuaguacacacuuucuugacuaauuucaucucuuuaugggacuagggaaugauaguuguuuugagauucuuagcuuuccugcauuucuuuagagucauuguaaaauuggaaguucuuguuaauauugaggggcuagaaucucuuuaagcauuugaagaaagcuguagcugucucuuccuagagaaauauauacaaauaagaaauuuccauacaguuuuuaguauuuugcacuuuggaagaaagcguguuaaaaugagguuccauuugggaaauaggacuuuggcaauuagaguugucuucuuauacuagugagaacugggugaagucauucagagguucuugucugcuguugaguuagugaugugggccuuuagcauucuuugaaggaugacugacucuaagcuuuccugucucauaguuuguuuuaaaauccauucuguuuuuguaaacaaauaaucacacacauaaggucuugugaucaccgugcccgugcggccaauuugcugaguugucucaguagguuuugucacuuagguugaaauucuuaauuuagcacagccagguggaaaauaguaggcuagaagucugaaguuuucagcaucugguuugguuuaauuacuuauauccuugguuucuuaaccuuugauuguguauaaaaucuuacccuccccaucucaaggaccacguaaagaugagcauauugaaguacaagauuuuuugacaaugaaaugacauugacugaauuggaaaggugguaguaggugguuacugcuugauuaguuuuauauuuuuggcuuucaauguguuaugaaccauuuuuagugauuuuguuuuuuuauaauacaccaucauauguuuauuucugccaugaaguaaaagaaaaaucccagacugcagggaggauuugggagaauugugacuuuggacauuucaguauggaaauagacauauuuauaccuaugaugaugggacuuggaaaguuuaaaaugcauuuuccuugaaaauauaaauaaugcuaaaagauuacauaugagacugagaauuuagccagcuaacauuccaggaauauaaauuucuuaauuuaaauuucucauauuuuuuucagugaaaaaucaaaauuuuaaauuuaaccauuuauauuaaaauaguccgcguuuucucugauuugaauuuuauuuaaccucuuaucaaggauccauuccuauacaucacaaaauggaguuuacauagaaauacauuuuuuuccccucauugcugauggugugaacaucauugauggaugcccugucaaguaaguuauuggaaauugcucacuuguucagcuuuuaaaggauguuuagcacuuuuuuuauucuuuaggcaucauuuguguauaucagaauaaagcaaaucacaguguaucugaaaauaaauucagugaauuggguaaggaugggaaaauauuucuggagcacuugaucuuguuuucucugagcugcuuuucaaaaguaagaauuucuuguuauacugauauugcuuuauuggaggugauauggcaggugagggggucauccaccuuuauugcagagguauccagaauguguuaaauauacaacauuuauuauagagggagcaagauuuuauaaccuguucccagguaaggccuauuucuauuugaguuuauucaacaccacuuuugaucuccccaggugcuauuuacugauugcuggcuuauuuuguuuaaaaacccuuggggucuuuucuguccugugccucugaaugacccauggacuuuucccaaauacgaggucaucagugcuuuugacuuucaucucuucccuucuccauagucuccgcaaggaauuugaacuacccacagccuuccuccccucuuugggaugcgucuguacuugcccucugucccuuguuuauccuuuuagccuugugcuuaguuccagguccugguaauuuggggucaggugcaaccugcucacuugucccuuuauuuucuuauccugcuugggcuuuugcauuggcucuuaugcacuuuguuacauuuuacuuacugaagaauaucuucugugaccaagugaaucacugauaccagaaggagcaguugguaucaguggacaaauuauuugugccacagguccugaagggugauccgugagcuucauauggccuauagguguuuugauugcccugaacuguguuuuaaauaguugugaguuguugauuuacgguuugguaauauauaaagaucuggagccaaauguauugcuucuugaaaacuuggaaggauggagcaacaacaauggaguccacauuuaucgacugcgccuuaaggaugaagcauggcuuguuucacuuugaccuugguuuguuugccuggccuuggugucucuaaugcuauacuuccuaaagccacgugaauuaaaaaguuaaguguaaagacaaaggcaguaguucuaaagguuuuauauucguuugaucucuuguauuuacagauaauguuugaaucauguuaaacugcuccuuacauauuuagaucuuauagucuccuuuacuucagagaagauuugucuugggucucuccuuccuuaacccgugguugaaaaacaguuucuccuuuuauaaaaugagcuucucucagcuuaacuuaccuuuucucuccucccccccugggauuuuagaacuguccccauugggaguagggauuucucccugccaguugccugcuucuauuuauucagaugcuuuggggucaacauugcuacuugaugcuguaaaaacugauaggauguuaugagcuguuuaaaagaggccuguggcccaccugcuaaccucauugcugauguugugagcuuauaaaugacaacagauuuauaagauuguuguaaaaaaaaaaaaaaaaagccgauaugagacuuccaggugugugguuuauguguguguguuauuucucucccuuuccccuuuauuuuuuucagucuucagccuuuucucccccacuccagaagcagcagggcagccuuagcaaggcccucuccuaugugugccguagagcagacugaugcaccagcagaaguagaaagaggcuccacaugucauguuuggaccaaugcuguaauuuuauuuuacaauaaggaagguggauaauauuaaucuacuccugagcauaauagcacaauuugaauagcagagagcaacuuugguguguguuaaugucuagugagaugaauauaguugaaugcuaaguagguagaaaaugucaguguggagccuuccuuuuggugacuuuaagcacuuacauuucuaguuaacuuuuguucagccugguaaauagauaugaagaucuguuguaucaacccagcauuaauguagcuucuuaggauggaacaaugcccauaaaacccugcucuccuggcagccacuucagcuaggccaguuauaacgaugaaucagaaugugccccuguauugaacaucuuagcaaaacccuucagaauaauagcuuaauguuggcaguuuuaagcauuggcuuacucuacaacccagccaauuuuuuuuuuuuuuuugauauuuggaguguuaguauaaguguaugcucacuuaaaaacuuaauuuugaauuaacuguguaugauuuuaaaaaaucauuguagguacauuuggaacuuauuuuucagaggcacuuaaaaauucuugguaccaagcaucuucuauucuaugauuauaugauucuuuuaggugaacguguugcuuguuuuugaugcucccugcagcaucucauugcggcaccucaggguggcuuaguuacuggguugggguggggaauugaauaucaguaaaaacaagcauguuuuaucccccuaaagauugggagucauucccguggagcuucuacugugcaauaagaaugacuuugauauaugugggcugcuaguuaacuugaagcuuagggcuuuuccaaauuaaucuaauuuuguuuuugaguuuguugaaggaucaauaaaaauauucuucuagguuuuguguugagauuauguucagaagccaggaagauuguguaauacuuauuguuucaucacaaauuacugagugcuggauacugagaacguugagacuuguauaaagugcccuuuaccucauauuccuuggucucuaccuaaggagaugaggcagaaaaugauaacuuaaaaaaaaaucacacacuccccacucuugcauuuaauaguagaaacugagugcuugaggaauuaagcaaagagauauaucccuguugucugggaaucaagggaucaggccagguuguugcuuauugcuuuagggacaggacugugucuuuucuugguccauuuugucuauuuuuugcuuuuuaugucuuauuucccucccccguuccucccauauuguuuuuguuaccuuugauuuucuuuuaugguaugaguaacuauuuccuaguuugccaggagcucagucacaggugaaaaguauuucugcaaaaccuacucaaguuugaggguguggcuagagagagacaagcugugacugucuuaauuccacuguugucccagaagaguagaucugaggcacguuguguuucaaacuacaugaagcuggguguuucccccagaguuuuauucuguugacaacauuaugugccagcagccuccucuggguauaacauuuauuuuucaaaacaccuaggaaaaagucaaaauaauuacaacuuuuuugacuuccucccuuuugggaauauaguugcaggagcaagaagcaaguaacaggacagaagcuggggugcuuuucagagcauugaucuaugccuucuccuugcgucaucuucauggcuaaggccaugucuuccaggagcauguguugucugggcugcugacuauggcuuucucaugccagugcuugguguucugaggccuggccacugcuuuucucccuuaauggcauuugcauuacuguuucguggguuuuuuuuuuuuuccuugaaaggugaucgaacagcuuguacgcugcguuaccuuuuugauuuaguggagaggcucauuccuucaguuggaacuggcuguucggggaauaauuuguguucuuguuucuuggacuuuuugaaaaaauuuuuucccaaacaguuuggcugacuuauaaacauuguuuuguggaugguagggugaaaucuuugguuuuagagugaauaauaguuugugaccuagacaggaagagugaagacaucuguuuugguuuuccuuuuguacaacuucuaugguaacuuccaaaugacucucccuugagaaugcaacaguaagaaauuuuguguuggacagucaaguuagcaguggauugggauggggcagcagggaucugccacuuuuuaguuguugacuuaccauuaggaagauagaaaaauacguggaguuggcaauugaagauggugaacuaccacaaggugauggaaccaggagacacggagcauuuccucuaguaauggugauuaacaccaaguuuuucuguccuuauagaaacuugccacagcucccugggaaugauguuuuauaggugaggaaaaugaagcucagaggucaggugguuugcccaaggauacaaccaaguggggaaguaggaucaggucagacuccuaguucuguaccucuuuccauggaucccagaaugauguucuuucuacuuuugguaguucugcuggcuguaguuuaagguggcugaaaucagauccaagaagcaacucaguuuucauguuugagaauguauugcuucucuuagggguguuuugaaauaaaauggugugacuccagcagcaauuguaucucaccuccauauuaaauugcuuuagaggcuguuugguuccccaguggugggguuguuguaccaggauuauuuuuuauuuuuauaauuuuuuuuaaagcuucacuguggucccuguagcacuccuagcaguaugcccacaacuuguuccucagggccaggauucugaccuuggauuauuuuagguccaugacugggugacuucuggaggcauuuccaucacaggcuggugacuuucugaugccagcuggcauccuugacuugcaggauuacuuuuuggaaccauacaaaguauggauugguuauuuucuguaagcaaggaaaugaagacacugucuucaggcuuuuuuuaggaugcuguuaaaaucaagaaaaaggugaaagugacauugagauaacccuggcucauuguaguagauaaucuguaagggcuguuuuuugaacuuguuaaguuuaugaaaaaaaauguguucccaaucaggcaggauuuuagaaauacuacuuuuuguucugagaaaaaaauggcaggucaaguguucaauaggauguuugauauccaaauuggaauaaacaaaauauucacccaguaaagauuguucuugauucaccuuucuccaguaaguuuucaguauuucuccaacuuuacuguuucuccaacuuuacugucagaaaaauugguugggaguggaugacaaagaauuacagauucaaaaugaccuuuuugcucuucccuagaaagaggccaugugcucuuuuucauuacuugaucucucacauaguguguuuuuaggagaaauucaggaaaauuuguggaggucacuggaacagcagaacucaaaagucuggaauagagauaauaauuuaaagaaagaauauaguacaugagacugauaaucaauugaaaauuauuugcauauguaaguaaaucaugaaugauagguaaucuuacuagaauuucaaucucuacagggaaauuuuugcaaaaacugccuuaacuaaucccauguuuucucaugucuuagauaugcaauuuuuauauuacuuuugagucucuuaaguuuacuuaauguccugauucuaugucccccaaagcugugagguuagugggugcaucuuucaguccaaaugucuuagaauugagaagcugaaauagcuucaugccaacauguucucugauuucuuaucucugcaaauauuuuacucuuccuagaguauaaauauuguccuugugcuauggaaagcugguguaaacgugagaaaauaaggucaucagauugucucuacauauuucaagcaggugccucugguauaaaauuggccaacaggcuaugcacaaagcagucaggugggauccugacaaggcugcuccguacugguuagcuguaauuuagaauaucacaggaugaagcagaaguuaauuguugagggugaaagcucaauagcauuuuacucaucaucacauuuuauaggacauaguaaccuuaaacuuugaccuuaauacguaucauuucucuuuaauuuuuguuguguuuccuuaaauuuggcgaagacuaccagagauuuuguuggguaaaaugcuuuguagcuccccaguucccuauggaauucagaagcauuaagagauccagggacuuuguuaaguuuuggguguuauaguucagacuccuuaaggaauuuucuggaacuuuacccauaaggaauuuuucauuauggcuaacauuucuuucucucucucauucccugugauuauucucuguuaucgucucaaagaaauguggcaauuugaugacaguuuauuaaauagccuaugaauauuugaaauguuuacaucuaaaguuuuuauuaguagccacuuuaaaacuuuaaacuuaucucucuuuuccuagcauuuaacauuuuauuauuuuauugugucuggccuccugacaugaauggcauuuugcucuuuuugauuguccuucuauucaguuuuugauuugcugauccagccuuuucugccccccaguacuuuaaaagcaauuauuuugccaguuuacaugugaacauuucuugguuuccugugcagauuuucauuuguuuaguaaauauuugugaucuugcuauaugccacauauacuaccuuagguauuaagacuauaguagugaauacaguauacucccugcugauaugaaacuuagaguuuauuggaggagauauuauguuaaaguucuacaaauuauuacauauaauugugauuugugcugugaaggaaaauaaccuuuaaggcuuauaacacagugugggaggugauuagugaagaucauuuguugauuuccuuccuagcuaccuuauuuuuacuguacauaaaaacagacuaguuuuuaauuuuauaggcauaaggauagacagagguccuaaaauuaaacucuauucuccuugauaaauugauggugaacuuugaguccuagagcugauuccugccacccagcuucuaucccaccauggaucuggcuuuuuauauuuuuuacgagaaaccgauuuuaauguucuuugcaggacaacguaauuuggcaacuuuuacucugaaagcuauguggugaaugcaaagcccagcagugagaucugcauugucuaaauccuuuauucucuuuacccauggcuuugaaaauguguuggauuuugaaauauuaucaguauuuguuuaaauaacacuuucuaauguauuaauugaugcaguaagaacuuaggaauauuuguuaggcuuuuugcuuggcggaaauuagaauuucacuaauucauccacaguuguguuuugucauugauuggauuauuugguuuguuuaugaaugaccuuuuagauaaucccuuugacagaucaccccauugcuuuaccauauuguguuccuuccaguauucauuuaaauuauaacuaaaaggaaauaccauauuaauuggaauuguuuuuaaaauauuuguuggaguggaagagacuuaggcaguuuuuuuuuuguagaaacuuuggaagacauuuguuguuuaagagugucgaaaaauacuuuuuaaaaaaaugucaguggcuucuguggaguuccuuaauccuaaagggcuagguauguucguaagagauggguagaauaugggaaauuacucuaagcaauuggaaaagacacggaaaaaagguuaaggaaaaugaggaagugaauuuuccaucuggcuaguuuccucauucacacagaucaccagaccuaaacaguacagugaaugcauggcaaggauaugauauuuuaaaauagugucuuucugaccaccuuauuagauuauuaagcuuacuugacuaggcucuuaguuuccucagagagguggacucuggcaaacaguuuuauuuuuaauauaagcuggucuuuaggaagauaauaaaaacuuugcaugccuuuuagcuuauaccauuuauaauuguuugauuuaacauggauauagcauuuuuuuguagguggauauuauuucaucacagcuuuuagauuucagccccuuuuccuuaggugcagaaggaagcuacugaaaauauagacaguaaccucuacucuugauggaauuuggagagaaguaaaccaaguuuuaguucaggagaggagaauuuuaauuuuacuucuggcauuacagggacagcagguaugagaguuaaggagcuguuacggaaugggcacuugggguaacaacuucccauugccuuuggugucuggucucuccuuaauagcuuuuuauauugguuuaaauuuucagggcacaacuuaaauguuacuuucaacuacauuggaagcucuuugaugucagugauucuuauaacuuuguuuucugaauauagugggucuuauugucuuauuacugauuuuuuuuuuuaagagauuuagucucacugcaguggcaugaucauaguuaacuguaacuuugaauuccugggcuuuuagggauccuccagcaucagccuccugaguaguugggucuauaggcaugcuuuacugcaacuggcuaauuuuuaaauuuuuuuguagagauggggucucaccaucuuacccaggcuugucuugaaauccugggcucaagggauccuucugcuuuggacuuccaaagugcugggauuacagaccugagccaccucaccuggcuagucugauuucuugaaucuaauagguccuaugucuuuaaaaugaagauuaaaauuauauaugcugaagguaaauguuacaugcaaguuuuuuucuuuuaauuguguauucggccuugguauuuugguugcuaugaaguuguauaacuuacauauuuaaccaauuggaguuaauaaaaauuguuaauauuuaaacuauagcaaacauuucuauguuuuuuagauaucacuacuauaugaugguaauuaagugcuggauacugaauaauauuuuaagaugacuuuauuaaagugcuauuucuuuucauccauaccugugaauaauuaagaauuuaugguaucuguuugcagucuaguuggugaguuuaauuuacuuggaccacccagaaaaaaauauacaaugaugcuucuguaaccacuuugacuaagcugaaacuaugcuuuuuacauguauuuaugaccuguuaauaccgcuucaaagugugcuguauugaaaagauauuggcugcuucaagguuggacugaaaugacuguguuugccaggaauaaggaggggucuccauggaugaccacugggccagucauuuaauagccauguggaacccucuucggcuaucagaagaauguuuucugcucuacacugaguaucuuuggaagcagauagagaaguugaggucuaagguagaugcucuaaucauggauggcuaacuuuaagaagcguuauugggccagguucuccugugguauaugccaagcucaugcucgugcauggguacacacacaagcccaagguacaguagcagcuccaucuguuuuguauguuguaggccugccuugacauagaacuguucguucuaaagcaacucauuuuaaagcugcaguauguuaaaugggcaacccuucauugaagaccuuggguauguuggcaguuuaucagcagcaggguugugauccugucacuucuuguuaaugaaggcuuuuauuuagcuuagcaaaucauaucucuuguuaguauccacucucucaaaugguagacuugaaagggauguuuguaccguuuuauuuauuaguagccaugagggugcuuuggcccuuacuuguuauagccauuuagccauauuucuuuuacggagaugugguuuguuuuaaacuaggaaaauccccaaaugauuaacgucuuucuuuuguuuaucauuuuugaaauggcuuuuuauauuuccuauuagguggucuuuuucuucagucucaauuucacuuccauuuugaaauuccuagcagggguuugucagagcauuuauguucccaguguugcagcugacuuucccagcauuuauuuguuguccuuggguaguccaagaggauaagcauucugucuucauauuuaauguacauuucuuauauauaacaaguucaaggacaucagagaauguuagagcuggaaaggcccuacccauaguguugaacagcagucucauuucauauacauucagaacugaugcuaagauguauugucuaaagucuuagguauaaugauugugguuggugacugugaccuuguggcugguucccgacuugccuuuacuucccccagugcccucucuacacugcugcauuauuuccuuuuuaaaaauguagguuaugcuuuggugggacugcaaacugauaaguuuucagaaguuuuuuuuggcagugacuagcguaauuaaaaaugcaaauagacuacaaaccagcaauuucuaucuuuaaauuuacauuuuugcuuuacuguauaagguaucuauuguaagcacuguuugaaauagcaaaaccuuggaauguucaucaguaggggauugguuaaauuaaucaggguauauaucucuauuauauaguaucuguaaauaaagaguaugugcugaucuugaaauguaaaaagcaagguucagagagcauucaaaaagaucuauguauuaaguauuuacuuuuccucaccugugccauuacauguuuguauuuucuuugaaaguguucaaaguguucaugaaauuguuaaccucucagguguagauuugaagaaauuaaauauuucugucuuuuauugcuugaacccaggagguggagguugcugugagccgagaucaugccauugcacuccugccugggcgacagagcgagacgccgucucaaaaaaaaaauaaauaaauaaauaaauaauaaauccaucuuuuaaacaguucugugguuaucuuuuugcaucaaauauauauuuuuuaauuugcacaaauuauuauaauagaauuacuaauuacuucaaaagcugaucccccuugggcuuuucagagcauuuuaauagauuugcacuuuuccuacauaugagcuguuuguuagcauucagugccugccuugagcugagcguugugcauggucguugggugcucagaaacacuaggauguggaugccacucucaaguucuccaagucugguugacaguccagaggaagaaaacgugaguuuaugggaguuuggugaggucugcugcaaacauugggaaaagguuccugaaaccagguagauguaguagcacuugugaagcucuuuuauacagauagggggacuuguccccccaccccacccgcaaccccccaggagaagaggauuaagugugguguacuccuagcauguaaggaaaaaguuuugauuauuggaacauggguggguuucuagaggacacugaaauccauacaggaacauuucucuuauuuuguuugagagagccagccuugggacaauuuuacaggauggcuuagugugaggaaaacugaagcaaaagacaugggcugauguggcuaaaggggccuugaggaggaacgcaccagggcuuugagaggaagauggagcaugcauggcuuccugacuaggguguaaacccccaaaugaaagugaaaaacugcuucuggcaugcuuuguauuguguaggagagacucauaagauacucaagcauuuuucuaaaccaguguaaguaugcaacaugaaacauguaauagcuuguuaugcuuuauaaagcaucuuuucugagaaccagaauauacaguuauauucauguuuccccgacaauguuuauguaaaaauuuuacauuaaaggcaguugagaugauucacguuuuuuucuuauaaaucaggguaguacugggcaugagaaguaguuuacauagucccagagcuggaggaacaucccuuugaagguaaggagaguaguuggaagcuguucuaagguuuaucuauaugggcuaaagggauucaccauaaaggcaugcuuauguagcagugaauuagaccaguaauucucaaaguucuugaucagaggaucccuuuguacacuuaaauuauugaggaccccaggaccuuuuguuuguuauguguauaaauauuuacuguauaagaaauuaagaugagaaaguuuaaaaaccuguuuaaauagcaaacccauuacauauuaaaaaauauuuuuaaagugaggaauauguauauuuuuaaaaaguaaggcuggcauaguuuuacauuuuacauuucuuuaacgucuggcuuaauagaucuagucaacuguauucucauugcaacagacugaaugcagaagcaagugucacauauaaccuuuagaaagcucuacuguacauuuaugagaggaaaaggcauucucuugacuucccggauguaugaggaagucucagaggacucuuagguucccaggcuaugcuuugagaaccacuggauuagccuaauggauucuuggaaggcagggcuaggcccaucugagucuuaaaacuuggaaucuguauuguagggaggagugggcagucaucuuucuaggggagggguaaauuuaagaauaaagcuguggaauuggaguacuuuggagguaagauugucuucaggaguugaaaacuugaaugcuaugaccagauucuaucacuagcaaauucuaucacuagaaaguuuggccaagucuuggggcuugcuuucucugucuaaaaauugaggcugugggcuagcguuuggaagucccuuguagcacuaacauuauuaauguauuuuuuauagcgcucuugacccuuucuauaaauacaugcccacacaucuacauacaacauacuuggagcacguuggaaggucacaugagcuaaaaaugcaccucggaguaguucaccugcuccaugcauuuucuucuuccuguauugguuucauuguccuaguuuguugcucaaguagacauugacuaaaugguacccaggauguguauagaaucuuaaccucuuucuucaauuguggaacacaucugcacuuaaaaaaacaaaacgaaacagauaaacaaucuuccacuguauuuauuucagcuucccgcauuagucgugagauuagguggguaaggaggagggaggugaggugucaucuaaaaccaccauugucaaucagggcuccaccugucaauuccuauuugcagcgcuuguuagaagaaaacucugugggagucccuucccccuuuaaaaugcaaaaugggguguugguagugaagggugcccauuuauuuuucuguguaugauuccacauuuaauauuguaauagaauuaauuucuuucuaguuucaaaugugcugauuuagacauuuucugcauuuuaguuuggauaacuaaugcgugaacauucuguugucagauguugaccuuuauacacccuaacuggaucaagaaaugucaguaacagugacaucuagcauucuuaaugauguugauuucuguuuaaaacuaaagucccuuagcuaggacacuucuguuggugagaucauugauacucugggauuucugcuugcaagaaauuuacuugucugaaaacugaguagcccuugaaggcaaagacacacuuuauauuccaauagcuccuguacguagagcuuaauauuuauugaaugaaugacaguauaacuuuuccuuucaagcacaacauucaagagaagaaauauuaguuuuucauuuugaaaucccuuguagcuuuaaaaaaucuucuaccugagaaaauuucuuugaguuuaaaagaaauaaagcagcaguuaaguuuuaaauguuauuuuaaaacauauugagccuauuuccaguaauguuuuuguauuuuguucuaggcucuuaauauuuauuucauacuucaguauuccugggugcguguaccuacuuccaaacagaaaguuuugagaaauagucuggagggcuucugugucuguuagguagcuccaaauugaaauaaaauauaaaaauggaagacgaaggacaguugcuguacaguucacaauuagccuuaauuuguagaucucugcugggcccagcuguaaaguuuauugguauaaaauguguucuugaucuggaaagcccucaaauaaggugccuugcuuuccaacaagcaggaaggaaauguuaaugccaguuuuccuguggcuucuguuuaaugugaauaggauccucugaggagauuuaaaaagcggcucauugcccuugaaggcacccguaucagaugaagauagaucuaaauucguauuugaauaaaaaauuucauacgucaucuguuuucccaaacuaaauuuaaaguuuaguuuuaaacuuuuacuguaaguuauuuuaaguaagucaaauuuucuaauuuuguagauucauuugcuugagaagcauucuauacugauucucuacuccccaaaaccaaguaaucugaaguaguuuuccaaaguuggggauaaugaccuauguucuuugaaagaauucuuaaaauuuccaucugauaucuuaagcauauagggcuguagugcauuucacuucauccuugaauaagagggaagggggcuaggcuggacauguucugcagcuugugagguccuucuccucauguaagcauggugccauuugcucauucuggcuuaguagagcugcucuugggcacuaccaucccggguugugaagggugcacuuaggccccugcaugagcagauacccuggguuacacauuugguguuaaaauaagcugagaagaggaauaggaacucuacuguuuuaggacuugauuguuacaccuccaguucagaauuuggggucccuauucaaagucacuccaccuauccaagccuucgaugucugaccuacagaaugggaauaaugaaagguugauugugaugcuuuauggugaagcccucauuauuagcuacuuucuuuucucauuuuugaauugggauucuuuggaagaccaaagaaaacuugccuuaaugagguuauuuuaggagaaauauuggacuuuaaggcuuuuguuucuuuaaugcuuuguuucucuaauacucuucaaaucuugcauagggaaagauuaggucuguccccugcacccacccacagaguccuuggacagcuguguuuaaaagugagggcuugguuuagguuugcugggagaccucuuaaagcuuuugggaaaggaaagagaaugggaaacuacaaagggcuuaagauuuuucuuuucagugguaaauagagcccuuucaggguuuucuaauucuuaauagauuucuugcccaacuguggucucuuauuugguguguuaggucuguaaagaagcuuagucuagcaggaagcaccuugggugugguaaggcaauuaggggcucucaauagaagaugcacuggugaccugcaugucuuucaaacuaggguguuggcugcugggaguagcaagaguuacuauugagcaucagugacaaagaauuaaucuuauuaaguuggaaauggggcuggauauuguaauuagaugugagagacccagugaucagacuugaggauuguaggcccucaaaacucugcuuuuccccacucacguggugggguggaguaagaguacaaaaucuuguuuuuuauggagggacaucuagguucuaguccagguuucacccugagugccuuaggaaaauacucacuuuucagguccuggguuucuuaucucuuaaaaugcgggaugggaaacaagguaacagauaggauugcuuuucuccucuaaagaucugacuaggugauguuagaaccaggggaagguuuggugcuacuccugacuucgcuuguuaagaagucauaggcgagagguacuccuuuguauuuuggguuuuuugguagguaguuuggagauagagauggaaaaaaauuuuaaaaagcuucugugagauugcauuagauuuucuuaggcuuucuagucauauuaugucugucuuaauuguguaauaauuagcacuuuaggaaggccauuaugauaaggguuuuaauaguucuuccauccuucacuuuacaugaccaccaccugggagaaaauuuuguacacauaucaaggaagaaaaugaucaaguuuuggauuuaagaaccuaauuguuaagucuugauuaaaugaugccuauuagguuguaauuauaucuaucuauaaaaaacagaugguggcagauuugauugcugcauuuccugaagcaguuuuuuaagauaaugaauuuaauuacacgugugccugggaaccauuuuaaaccaucgagaagggaaaaauggacaaggccuauuggaaauggaaaguguucaccuagguguauagcuuuuagcuugugguuuugaaggauaggaacagaaaaaucugacuccucccucgucucccuucccacacacacccccuacaaaggcagaauccauauucugauacuuuauaugaaauguuacaguaacauuuaucagaugucaaaggguauggcauagaagugguugugucagcauaauuugaaggcugcuucucugugccaggcacuguucucagcagucuacauggauucacucacuugaguucuuacaaaacucugagauguaggugguauaauuaucuccccacccccgccauuuuauagguaaggaaauggcacguagagugauuuaaguuacaggcccaaagaugcaguaaaugacagagcuggaauuagaacucacgcagucuggcuucagagugcacaguaacaucuauacuggaauucucucugcccagguguuagaacuaaauuauuuaaucaaauaaaggguccuguuuugcuguugcgaccuuuuugcacuaauauuaugaacugucuccucagauaaauaaccuugcagaauuuaggcacauuugaguuagaaucuuguaagagacaguuaaaggacagcuuuggcucugucauccugccugaagguuucaguggcucccuauugcuuacagaacagauuucaaacacuuucaggcauucagaguucucccuucuuugccggaugcaauguuuacuucaugaacuagccaaauaacuuuuucucuugaucaugacccaugaauucuuaucccauacuuuuuuuuucuuuucuuuucuuuuuuuuucuuuugagacagaguuucacucuuguugcgcaagcuggagugcaauggcgugauuucagcuuaccgcaaccuccgcuucccagguucaagagauucuccugccucagccacccgaguagcucggauuacaggcaugcgccaccacgcccaccuaauuuuguauuuuuagcagaggcgggguuuucuccauguuggucagauuggucucaaacuccagaccucagaugauccaccugccucagccucccaaaguacugggauuacaggcguaagccaccacgcccgcaucccauacuuuuuauucacucaaguauaucauuauggcaaaccuaaaucguacaccugguguccuuuaaaaaaucuccucucagucccuaccuuuaauuauuucugucauuaucuaccacccaugccccuccugcuaccaagcacccuuucuguuuuaaauucccaauagcuggccuuugggauuuuauugaaguguaucauacaugagauuuaccagauaacaugaagaugacuuacacauuucuucauuuaguuuguguuuauauuuacacuguuccugugaugugcuagggacuuagcaugcauuacaauuuaagaucaguuuaaugauauuuagaaagccgugcuguuuuuguagugccuuuacugguuguauuuuuuugaaaacgccuguguuuuucuuuuaaacagaggauagagguucacuuuugggcuuaaguagaauuaguaggauucauucuggauuuugguucauuuuugucucgaaucuuaaacucuucaaauccuguuguuagcugcucaggacucagcugggcagaugguagcuauuguacaaauuaggacauugaagcauaaaggucagguuaauucaaccuguguccauuuagcuaaauuggcuaccaugucaugcuugugaguuggacucugcaucaaccagcuuugcaguccauugucccuguccucauucuuuauaguuagcuaucucucaaaugcauccuuacuauuuggaaugaggaaaaugggguuaaaaugaagagauaagcaagucagaaucuauuuucucuaguauauuccaugacugauauugaaucaguagaauaaccuauacaaaggacgaagggcaagggcaauuguucucaggauaucuuuuacauauuugggauauuacucuguuuugaaaaaaaauuauagagcuauaauuaaauaucuucuugugcagggaacuaacucuacguauagauuuggcaauaauagugucaaggcucuccguaaggaugguguaaacucuagauaucuuacuuauagacagccauugcccuagugaggcaagucaugcaucuuuggaucauaaugacuaagcagcagaauuuuaaucuggcaauuuuguggguuuaccguuagagugugaagcuguuuuugccuuuuggcaguauuuugcuuuccucgagaugaucucagcuuucauuaagauuucaucugacugaaaagauugauuuuugaguaggugagaguccuuuuaugugaugucucaaaggacagaguaugggucaaaucgcucuucaaauggacaguaauugugaggaagaggcuuuuuaaauggagauugcaaguuacccaaagguuauuagaaguaagagcuuuuauauguaauaagcuuccacauuuguaaauaacaagaacuguaauaacccagugaaagccccauaaccagggcuugaaccagaguuguauguuaacaaugaucacccuucuaacucuaguguuuuauaguaggaccuagaaaguucaucauuugucuuuugguuuaauucuucuuuggauugcagaaguauauuacuguucaaauuuuuguuucucauaaaaauuaagaaacaauugaagguccaaggaccaaaauggguacacuucguuuucauaauauuccaaaaucuggugggaaacaauauugaucaagaaaguaauuuaaacauccacuuaugcauuuuucccccgguuuguaagaaggugguggugcugcagagcgggcugugaagaggagucaauauuaaaaaugauuguuuagcucuuagaaauuauuuccuggaaaugcuaaauagcaauaaaaucaacuuucagggaggagacacauugccauuaaaugucuuguuuuugucucagcuuugugaugaacaaaggaauauucguucuuaaauauguggaaucuugagauuuuaaauuccauuuuaauaguggcaacuuaaaauuucuucucuguaagagguucuguauuuuaugacaguccuauuuuuugagacauuuuauauaucaaugacuauggacguaguauuuuccaguacuuacaauguuguuuuccccauuuauuuuuuauuuuuauuuuuuugagauggagucuugcucugucucgcucaggcuggacagcaguggcgugaucucggcucacugcagccuccgccucccagguucaagcgauucuccugucacagccucgcgaguagcugggacuacagccauguaccaccacacgaagcuaauuuuguauuuuuaguagagaugggauuuuaccauguuggccacgcuguucucgaacuccugaccucaggugacccacccaccucagccucccaaagugcugggauuacaggcaugagccaccacgcccaacauuuucuccauuucuuaaauagacacuggcaggaucuuagguucuuagggaaucuuauauaaaauauaaacaaacuacccacuuaauuauaaugagccuguggucuauaaagauaaggacuuaauuuuucaaaguuguugacuuugaaaauauugcuuagaaauguguuuuuuaaugucugaagagcaguaauauuauuuuacuccuuuaguuuguuuugauagcaguugaucaaaagcuauuauaaggcauguauacagauguuuuguaggugugcauaagauaaaauaaggugggaaauuugguuaaagaaguguucaucuucuuuagcuuuaguuaaauuuuauuuuucuaggagcuguauauaccuaauuuguaugguccuggcucucuacuuauuauuaaaacaagagaagauggaaggauuaaugcauacucugccauauuuuaucuguauuccauuggucaggaaaucuucccagauuguagggagcauugccaagugguugguguacuggaucugaaaagauuagacugguuuccccacacaaauuuuuucaugauuuuccuaaacauuaaggauugauuuguacaagcuuuguguaauuuuaauaauuagucugguuugacuaauguaguuauuugauguaaaaaugguugauacuuuggaauucucaaauucuaggaauguuuaaaacugaauguaucuuauucagccuugaauuugaaaaaugggggcugucuauccaguauggauuaggguauauauuuucacucccuaagaaaaauuguuguccucagaagcuuuuaggaacucuggcaggacagcuugccuuuucuccugcaagaggccugcuguacguguguuuaacagucaaucuguuguagaaagugggugguucuuuuccccucuuuaggggaagcugauggcccagcccuuuugggcacucaguguucuaggaaagugucacugaagucccugaauguuacacuaucaguuugcuuuugauuccaggcccugauuguagaugucauuggugucauuucuuugcccuaccaacccugaaguuagaaggggaaagauaagcucaugaagcagcuugaaugcuguugguaugcuagucagugacauuggaguaucucugggugcugcugacugcagugcccuuugauuuagaucacaaugaugaaagaacuaaagcucuucuagaauuuuaugucuccauucugguuggguuucuauauaaagaugaccacauacagguggagucauugauggggccuuacaaauggcuguaugauauagugcaugcuaaguuaccaggaaagagcucuuggaggacuguuuuuaaagggguaagcaaaauuuauuagagaagaucagcaaagcuuauaaugaagagcaugcguguaaauuggaaccaguagggagaagaucaugaguggagaaaauaguuauaaaaguuuggagguggaaaguccacugagugggacagaggcuauuuugggggcauguaaaaaucaagagccagguauucagguuguuggaaaucuuaguauauuacuguguuuugucacucacaugaugaaaaucaauaaggauccaguauagguuacgaagcucaggcucucauaaagagaguguugaagaggcuuguuaugauguucuuuggaggaaugauaggggaggggaucguugaaaauugggaaaaucugagagacucuauuaguuuuguugcugggauuuaggugauagcuuuagaaaaaaaguugaggguuugagagaagaacugauugagcucagaucaaaucuauaugugugucucauggucucuagaccuuacuuaggaugauaauacuuagggggagaugagagccucugaaaacucugaauuucauuugugucagaucuucccauuuucuauuuauguggagcugaaauugguaccaucuuucagauauuguguaaguaccuggcaugauuugguggagguaaaagccuauuugaauaaaaucaguauguggcagagcagcaguugaggguagaagguuuugccauaacaagccccuugugauuguguaauguucuucagaacuucuuucuuccagcugccauuuagaaaggaaauaagcagagaggacauuccaaauugucacaacaauaggaauaaaagcaaggaaacaggccaggcaguggugccucacuccuguaaucccagcacuuugggaggccuugcggggagggauugcuugaggccaggaguucaagaccagucucaacaacauagugaggacccugugucuacaaaaaguaaaaaauaaaaaauaacuggguguggugaugcaugccuguagucccagauacuuggaaggccgacgggggaggauagcaugauucuaggaguuggaggccaccgugagcugugaccacaccgcuguacuccauccugggcgacagaguaagaacuugugucuaaaaaauaaaagaaaaauaugaaaaaaggaaguaaauaaaauaaugcaacagauucagaggaugguuaugggucauuuugaccuuaugcaggguuuuggcuugagaaguugggagaaaacauuagggauggauuagaaaguuaaaaaggcccuuaaaugaaggucuguauguauacaauugaugguauuugagcaagugauagcaugagauguuuuugggaaguugaagcuagccauuauauaaagaugagcauguuggaggaggagacagauuugaagcaguguauaugaugauaaaggcuugcccuggucucaugggaauuggaggaugagggguagauauugguagacacucauuuuagugaagguaaauuagcaguuauggauagaugacaguguugauucaaaagcgagggggcaugguucaguggcuacaagaaggugcucugacuuaugauggggcuuauguccugauaaacccaucuuuaaguuaaguugaagaugucauaaguagaaaauacauuuaacauacuuaaccugcuuaacaucauagcuuucgccuagccugccuuaaaucugcuuagaacacuugcauuagccuauaauugggcaaaaccaucuaacacaaagccuguuuuauaauaaaaguguugaauguuucauguaauuuacugaauacugacagugaaaaauagaaugaugguguaguuacuugaagugcuguuucuacugaauguguaucgaucuugcaccauuacaaaguuuagaaacuguuaagucaaaccauguaaguuggggacuauuugcauaccuaagguucagauuccaggaaaagauuggguggcagcaaugagaggaaaagacaacugagagauuaagaauugguguggggguuguauuaguuugcuuaggcugccauaacagaauaccauagccuggguagcaaaaacaauagaaauuuauuuucucaugguucuggaggcuggaagaccaagaucaagguuuugguaguguugguuucuggcaagaccacuguuucaggcuugcagaaggccaccuucucacuguguccucacuuagcuuuuacucuggguauguaaagaaggagaaaucauuggugucucuuccuuuucuuauauggacaccaauccuauuggauuagggccccauacuugugaccucauuuauucuuaauuauuuacacuuaugaccucauuuagccuuauuuccugaaauaauuaaggaaauagagugaaaaacagagugguuguguaguuacuugaaguaccguuucuacugaaacuacugaacuacacaacccuguuuucaaauauagucacguuggagauuaugguuucaacauguuaauuuugggagauacacuucaguucucuaacagggguaaggguauuuaauuucucgaggcaugaacagaaaugauucuuuuccccugaauuucugaucuacaguuuuaguuuuucauuccagaagggaaaugcuuucucaucuuuacgauuggucaagacuccuugcucccaccccugcgauuagcauuugccguuuucaaccuggagauuucuuuuccauuuacccugucuguacaguaguuugugaccaccucugccuuuuaaaguugaguuuugacaauugauauacaauugauuucuucucuaaccucuucaguuuuauaguuugaccucuuguuacaaacugcuuuuaaaggcaccaugcuuaugcuuuaaaagccacuuaaacagaacauauauuuagaagacaggauguuuuugccacagaugucaagagggucuuggcaguguuuucacagaaugucugcuggugucugugcagcucugagacucuaggcacucuguacuuagagaacauguagagguuaaguguucaucaggagaccugcgauguuuguguuggaaauacuaagagaugugagguuuaggauguuuuguguuguguugcucugugugcucguccagagcagacauccucaagucagaacuuaaugagguaugcggaaaaucaccaggggaaccguaauauauaaaacauaaaauuaaagcucugggaugaauggcuaaugccuaguuacauuagauagucaguuuauaguuauuugcuccagccuaauuuggcugucuauucaagguaaucagcagagagucaaaccuuuaacuuuuucuugagggacugcagugagccuuuuagcuuucuuuacguugagcuuuauggugacagaugagaugaaggauacuauuucacuuccuucaaguuuuuaguguggccucauuauauuugaaagugaauucccagagcagccgauaugccuguaacuaauccuaaguagaaaaucuauuccaaagcagaaaauauauuuuggcuuuaccugugcagucacagacugggaaagcggguauuggggugucuaauaauguggauuuaaaugguuugguuagaauaucuacucuccuuucauccaaccaggcauuuccauauauuuuuguauucccucucuuuuuuucuaccacagaaguuuaauuucaagauuuucugucucaucucucucugguauucauuacaccuguuacaucuguuuuguuuccaguacaaaacagcacucggaccugccucuuuuacauugguccucuaaccaaagaaugauuuaggagaaaauuugucauuuguugaaagguuguuuuuuuuuuuuccccuuuuuuaccaucaaccugucauuuuguguaucuuaauggauuauucaagcauuuauagcccuuugaaaacuuugguuucaggcauuagaaauuaauguaauuuaggaacaugguuaccccuuaccuuaccucugaguguccuaccuguauacauucaggaaaggguuuaaaaagcauagaacacuuaaaaacuucaaauauguuuucucauuuauaagugacauuuaguaaagucuugaaagauauaagaagcuaacuguuuugcaaccauacuguuuuccucugggcugucuuuaagaauguuuauuuacuuuucuggggaagggagauaugugauagcuuguauaauacgauacauuauuuaggaagcaauuucuugccauucagauuguggguuucggaucauuuagcuaaaagauuacccugcugagugcguggaaaucaucuuaagacaaaauaagguuugugaaaaugaaaguugaauaggaaguugugcagaugaccaagcuuuaucauucagcaggugucagauuuuaaguuguguggauucuuuugagaaauaauuaaaaguuuuaccgaauuguauuacuauuuugaacuguuuccucaauacuaugccucaagaauucaguugaggacacauaugcauuuuaauacguaauuuuguauguagcauaaauuuaauaaaucacuuaauauauaaauucacuauuugugaaaugacggucacuucaguaggguuaggggacauacauuccaccuuaccauuuaggaaaacuugcauuucuuguggcugcgucuagugucugggcacuggccuagacugauauagagggucacugacccucuguauagggacugaauaagcagucccucuauauagggacuaauaggaacugaauaagcaggccaaacuucuauuccccauuuacugagucuuuaacaaggccaucuaaaguuguaaugguaagaaggaaaaaauugggggacuauauucuuacacugcccucuauaagaauacagaagccguuggucucuuuucuuuugcuuggauggcaguaguuccuccuuacccacaguuucgcuuuccaugauuuccguuaccugcagucaacugugguucacaaauauuaaauggaaaauuccaggcauaaacaauucacaaguuuuacacugcguguacuucugaauagugugauguacccucaugcugaccagucaggaugugaauccucccuuugucuaguguauccaugcuguuagucccuuaguauagccaucucaguuauaagauugacuuucgagguauugcacugcucguguucaaguagcccuucuuuuacuuucagcggccccaaagcacaagaguagugaugcuggcaguucugacaugccaaagagaggauguuaaagugcuccauguucccuuuaaguaaaaaggugaaaguucucgacuuaaagaaaacuaaauacgcugagagaucacauauacauaacuuuuauuacaguguacuguuacagcaguucuuaguuauuguuaaugucuuacugggcccaguuuagaaauuaaauuuuaucauagguauguguaggaaaaaacaugguaggggucaguucuaucugaaguuucaggcaucuauuggggcuuuugagugccugguaaaaaggggacugccauaucucauauauuuauuccaauaacugaaugagaugauaggauuauuuucuccauuuccuaaaugaggaaaucaagacuuaggauggcaaaugcuagaagggaucaccguagaguuaacaguuguaacuacuaggcuauauccgauugcucagcaagcucuguuuauugucacucacuuguuauauuuuauauccugguccauuggcuuuagguuagucaacuguuauuuuuuccuuauuuuccuaaaauucauacccauugguuacauuagcuguaaaagucauuuugugcucccuucuuaccuacagucuuaaaaguaaaaauuuucuaaccuguaguucauucucucagcaaaaugauuccaaccugguuuuuugcgccuuuuuaaucacugcuuggacuaaagccuguguucagacuuucccugaaguuagucuggaucagcucugccucagcaccuccacuguuuuugaacuucuguuugcccucuaaaagcuggaugaauuccccagucucugauuauuugacucuuguuuguuuggcacuaccuagcugauaguccacuugucuuacaaaagucuuuuacagugguucucauccuugcuugcagauuagaaucaaaucgggugcugauaaaaaugccaguaucugggcccuuaggagagauucuuauuuaauuggucuggggugaagcaagauauugguuauuuuagcugcuucauugauguguggugcaaagagcaugggcucuggaguuuguuagacccacauuggcagguuuugugaguucuggaaaaguuaaucuuuuuuuuuuguuuuuuuaagccuauuuccucauuugaaaaauagggaugaggccaggcgugguggcucaugccuguaaucccagcacuuuaggaggcugaggcgguuggaucaccugagguuaggaguucgagaccagccuggccaacaugguggaaacccaucucuauuaaaaauagaaaaauuagcugggcaugguggcgggugccuguaauccuagcuacucuggaggcugaggcaguuugcagugagcuaagaucaugccauugcacuccagccugggagacaagagcgaaacuccgucucaaaaaaaaaaaaaauggggaugaaaugacccauuuuauuaaguuauuaggaucacagggggguaaugcccuuuaaaacggcuuagagcauggccuagcauauccuaaauuaaauuaauagcugucauccuacccuguccaacaauguugucuuccuuuuccaaaugcucauauucuuucucacauuugccguauauauaucuguugcccuuuccucauguuugaauucuugucuuucccauuaaaauuuauuuacagguccaaguuccucagugauguuuuauuccauugugugcuuaaauaaaaguguaccuuuuaucuuuugcaauauauuggacaugaaaaacuuccaaagagaaauagagaaacagcaucagaacuucuuugaauagaaaaguaaacugggucaugugggugucacuuuaaaauuccaguggcuuagauuuuuaaaaggcuuuccuuucucucucucucuuuuuuuuuuuuuuuuuuuuuugccacuaaaaucuguuacugagacuacugcagguuuccugcuuauauacuuuuugaacauuaaugucuucguuuucugucuuaacaggcuccugguccuaucuguaccuugaaguuuaauauuuuccuccaagcuucuuauagcuucaggguaacuuucugagugauacagucuaucuccaguaauaaagggcagaucaacaccaguugaaagggauaacugucuuucuauuuuuaauagguacauuuuuauugagcugcauuuuuuuuuuaaagugugaaagagacucucgcccucaaguuucauuguuauucuucugauaugucaguaaucaccuuuggguuguugucauuucaguagcucagggucaauauauauugcuaagucauucauguccuguaaauuucaguaugaaauaagcauuuacugguuccuugccugaauagucugagccuauauaguuuaucucaauauaaauuagaucuuuguugcuuacaucauuuugaugaaauuagguauuaugguuauaauuuuuuuaaaguucuccuugacuuuccugguauguuaaacagcuuuucuauguuacuuuuuaaaaaauagugcacacgaugugggcuuucacagcaauucuucuggaaggugacuuuucuucauuguuaacagagauaaauacucugcauuuaucacaaauguuucaaauguccuuggauagacuuagaagucucucaaguucagcuagcuugagacagaguacaaaauagaauguagcaucagugaagaccagucaggcuguucuugcaguagaucacuaugccaggugaccucauagugaccuucaaguaccgaaaagucugggauucuuacuuauuuuacaaucuauucuuugggaauguaaauucagugaaaaaguugagauacuuuauuuuugagugggacccagugucucuuccucuaucaaaccgaucaacuacuuuucccauuguguguccucuccaguuuugaucuguuauucugcucagacuggagcuggucauaugcuuuggaaauaccuguuuacagauugaugcagaccuggagcagcugcucauugacagaauaggucuagauuucuaugucgugacugauucguacucauacugggaguuuuggguuaacagacgugagacagugaggauugagcuauaguggcuucaauuugaaggggauuguuuccucccuuguuauuuuuguuuucacacuauccuuaaaguaaugcaaaauuugggagauaucugauuaaaaauguuucauuuugccuauauuugacuuguaggugcagcugugauaacuaaaagauccuaaguccuuuuuuguccuccaggacacuaaguuaaauucaucaaaauucucauuuuauaauaugcuuuggucuaugugugggcucuuacuuggcugcugaagaacauugaauugugugaacuuguaugacuuuaucuucauaucuuucuuguucaucuuccuugauaaacacuuuguuuucauuucuugugcuuugaugaacagugcugcugugaacucugggaguggcucccucuacugccucaacccucauugugacaguuguuccuugauauauguacuucucagggaaguacaauaagaaguaaaacuguacauugugggaggggaauaauagguuugucaacucuguuuugccaaggaaaggcauuuaagaccaucugacacauuaucuauuaucacugucauuuccugguuugcuuagaugccccaaaguaggaugcacguaacuucacaagagaaauugaauauauuucacuuuacaaaaaacucauuacauuucuuauuuugccuggaaccaaauaagauuuuucccacaaugucuagugaaguacuuggcauuuaggcccaagucuacuuauuuuucccuacggauauuaaguguuucuuguacaugaucaauuuacugaauucugacauuccacauaaauucugauuaaaaaguuaauuggcagugugauguaaugggaguuacagguugugccccaccucugcaccuaccuaguucagaaacacugagccagccucuggguuucauuuccuucauuugauaaaaaggaaugguugaggauagauggguuucaagaucucuguagcuuaaguuuuauccauaauuguaaaacucugccugcuggguuccacauauuggauguaauugcaucccuaggaugacauuccucaggguacaaauuaugucuuauucaccagucccacugcccccaacacuaccuaguauguguguggcaccauccuuuaccuuccaaagaccaaguauuacauauauguagucauguuuaucuuuagaucucagcuuaaaugucacuuaaucugcagaaggcuuuucuucugaucacugucccaguuuuauucccacagcauccuuuuuuccuucauggcaugaacugcaauucuaaacauuagcuuuauucuuuggcuuguuuaauaugucucucccacuaaguucccuuaguaccugucuuguuuaugcuauagucucugugcccagcauuuuuguuuuuguuuuuugagacggagucuugcucuguggccccaggcuggagugucguggcgcaaucucggcucacagcaagcucugccucccagguucacgccauucuccugucucagccuccucaguagcugggauuacaggcgcccgccaccaugcccggcuaauuuuuuuguauuuuuuuuaguagagacgggguuucaccguguuagccaggauggucucgaucuccugaccucgugauccacgcgccucagccucccaaagugcugggauuacaggugugagccaccgcgcccggccugugcccagcauuuuaaaaaugauugcaacuauguguacuuugcccuuuauuugaaccuaugacaacagagagccuagugcacauggcuuuucucuguucugagccugauuuuuuuuuuucaucugucauccagauacaaucucuccuucucacacuuaccagauugcguccuguguugugguucugcauguguucccuucuuugcuuagacaguaagugggaacuccuuaucugagucaucuugguuauccagcacagugcccugcacauaggauuugcauguuagaaugaaugcagaugucuguccuucaaauguguugauauuugaggcauaucuguuuucuucuguguccuuuuaguggugacuaaagccuuauuugaaagcuccaucuccaagaauuccugaugccuuuauucaauaaugaaccucguuguuuucagguuagugcauggccacuuuguaguugugcagaauuguaccaguuuuucaugcucucugaaguuacauguuuuucuucaguuuaacuuucgguuuuccuuggaguuacuccauuuaaguggcuucagacugugagcugagugagaucuugcugucuuccagucuuggcaccuugaauauuuacuuuuguuuacaagcuaguuucucuuuggcuguuuuuaauuuggaggacuaaaguguaacaaaugagguaaggauaauucugcuuauuaaugucuuaucuggaaguaugaugacuucacgccuccggagaguagaguuuggcuaccuuucacagguauuggaguaaauuccagguaugcuuauugcccuuuugagauaagaguuuguuggaugcauagaaaaugaagugggcucucacucuagccaaauaguuaccaguuaguaucuugggauaucugcagacucagcugagcucucaaaugggagaggggaugaaggcacaaugagcaacugagaugggaagcugggauuggaaagagaagaggcuaucaaagaaauuugucuuccuuccugguuucacuucagcucacuucuugugccccggggucuccauccuuagcuaugcuuccacaucgggcccaagucuguuuaccaaaccuugguggucaagcaggcugguaaauaguuuauuaauaaauucagguagaaucgccucauuggcagaauauaccaagaaguauuugagcauauaaagugguuuucuugguaugggauggaacguacgcuaauugucuucaggcuaaaucuuaguucaugguugcagcucuuuaaaauggcuuaagcucuugcaugguuuuuuguuuugguuugguuucuuuucguuuguuuguuuguuuuuuggagacagucuugcucugucacccagucuggagugugguggcaggaucuuggcucauugcaaccucugccucccagauucaagugauucuccugccucagccuccugaguagcugggauuacaggugugcacuaccacacgccuguaauuuuuuuuuuuguauuuuuaauuuuuuguauuuuuaauuuuuguauuuuuaguagagcugggguuucaccauguuggccaggcuggucuugcauguuuuugagaaugcuaagacucugcguuaagcacuaugcuagccucugagcaaaugcuuacgauguacuuugauuuugaauuuuucaggaauagcuauagcgugugauucuuaaauugccaacuaaaacaucaccgucugcuguucaguaauaaaaguguuuugacuugguuaucugcuuggacauuuuuauguuaaagaaacuucuuggucgggcaugguggcucacgccuguaauucuagcacuuugagaggcugaggugggaggauccuuugaaccuaggaguuugagaccagccugagcaacauggcaaaaccucgucuccacaaaagauuuuaaaaaauuagccaggcgcgguggcucacgccuguaaucccagcacuuugggaggccgaggcgggcggcucacgaggucaggagaucgagaccauccugacuaacacgcugaaaccccgucucuacuaaaaauacaaaaaauuagccgggcgugguggcgguugccggcuacucaggaggcugaggcaggagaauggugugaacccgggaggcagaguuugcggugagcagagaaucccgccacugcacuccagccuggguugcagagcaagacuccaucucaaaaaacaaacaaaaaaagauuuaaaaaauuagcgggguguggugguguguaccuguggucccagcuacucaagaggcugagguaggaggaucccuugagcccaggaggcugcagugagcugugaucacaccacuguacuccagccugguuggugacagaauuagaaccuaucuucaaaaaaaaaaaaaaaaggaaagaaaaaaaagaaacuuuucuuaaauaugcuauucugcuguauguuuugguggcuuaaauauuugguacuuggaacguaguauauuguagaauuccugaucuguuuggugaaaacaugaccuuuugagggaaagaagaaagcaaagccuggaguguguguguuuauguguaucuuugaccauuaauuugaauuucucagguugcagugauaauggcaguuugaccuuaccauaaauuaaagauguguuuuuaggagagcaugaaagcagaaaacaauucucaagaagguuagugccuugagaacaauacccuacuuuguauagugccugaaauuuuuuauaagccauucuuuuaucuguaauuuguuauaacuuauuucuuuuaauaacccuguucgcuagcagagugagaaaaaucuguucuuaauagaugagggaaguuaugaacauaacaaacuuguugagggucacagaaucauuaagaaauagauuuaggaccagcagugauugucuuuggacuuuauguaggcuuuuaccuucguucuagucuuuuuuuccauaucccuguuaguuuguuagccugggacuugggaaugagauaauugcuucucugaggccacuccuaacccugacuguuuuaugugaaagcuuaaauuugcuccaaauuuccugaaugcuacauaguguugugacuugcccuuuuuuggccuuaauuuaccuggccaugucuuaacucuccugaagagcugaacuaaaaucuucauuuugguauaaauggaugccuuagguucugauguuuuaguuauggaaaauagugcuuauguuuugggugcugcuguguguuacacaugaucauuugauuugaguuuagaccaaauacucuuauuucuuuaaccuugaccauuaaugaagaauauaagaagaauguugguauaagccaacauaguuauggaugugagcuaagagguguguuuaaguuuuacgaaggucacaggaaauugaccacaaauuuucuaagaaaauaauuauaaaaagacucauaggauucaauauuauaaacuuucaacaaauugaaaauaugcuuaaaaagccauuuuccaaguuuauuaaguuggaaauuuaucuuaagaguuaauaacaauugaauguccagggggaacccuaaacacuuuuuaguguuuauauuugaauaaaugugagagcuucacauucuguuuagaaaauucucuguuguuagacugcuuucuuauuuuugaaucucaugcaugagauuaggaaacaaguguaaaaugauuauuauaauuuacuauuaauaccaacuguugaucuguucucaguucaaaauguuuuauaauacaguccuggaaaagagaaucaaccuaaguuaugugugagguuuuguagaauagaugauauucucugcagauuuaggaacccauacuuuacuuugcaauagagauuggacuuggaaguucaugaaguuuuuuuuuuuuuuuuuuuuuuuuuuuuuuuuuuuuuuuuuuuuuuuuuuuuuuuaaggaacacuaucaccgauucuggggaaaaaaaagaaaaagccaauagcauuaacauaauacucugcaaccuuaaagguuugcaguugauaaggaauaauuuaaugugcccuauaaaacccacaguuuuggaauugcuccagcuuuuuauuuuuagcuguggcuuuuaguuaaugagaagaggugaaaaguauaguuucuccuggucucugcuugaaaucacagaaacuuuccgcgcugugaaaguucaggggauuuugggagaccauccuuaugaauuggaugguggugucuccuccucuuuguucaggccucuuuuucuagagaauagcaaagaauggugaguugauuaccuucagauuuuaaccaaacuguaauugcucugauauugucaaaugcaccuagggacaguguugcaguauuuugaaaccuuacacaggaaacaaaauagcagcuuuggaggcagggaagaaugcauuaguuucugagucuaaggaagccagaaggaagcccgcccacccacucucuagcuuucauauucccucagccaccucccagaucuuccauugcugugcuauaaauagccaguguuuaggcagggcguugcuuucuucccuugccuuugaagacuuucugcaggcccuggaauugccuuuguuccucugucugcccacuuugccagugugaagcagguuuucaugggauucuacugggguaaaccaaaagcagcagaaaaagugugaaguaagaccucuuauuuacccuucaguuccuuccccacuuaccuccuguuuuaccuccaaaauacaauuugugguuugucaugagacaguuuuuagagcguuaaccuggaaauuuaauguuaauucaagggcuucugguguagugccaggugauuuuuaucuuuuuugugugcugcccuacucacugccucauccuggggauaaagcacuucauuggccccuccucuucuuucucauagcaaaauauuugauuagguuugaauuaacugucucaaacucagcccccagaagggacaggauauaccuaauucuuuguggacaggaugacuuucuaauccaaauccauaguaguauaaacaggccaaaaugaguuauuuagagugcuuugaaugucuguggcagucauauuaggauguuuagugacacagacuugaugcuuuuuugccucauuuuuuguuaugcauauucauuagaauauuuucacagaugauuaggucuacaauuaaagauccucaguuuagaugaccuuggaaaacccccucccucccccaguacucugacauucugaaccucuccaucaugguagaaaagcauauacucuuuagcacauuugacauuuaggcuaugauacucuuuuacuuaaaauccagcccuugcaggggccggaacauuaaggcuguauugggagagcuggaaagaaggcaccccauuuauagggcaaccugcuggcuaguagcucugggaauauggacucuugccaaacuuuauuuauuaagcgaaaucagaaauauaguuuuaugaaugugaaauuguuacauuggugaaauuuuaaauguugaacacuacuguuuuuguuuguguuuuguuuuguuuuuaaggacguuggagaaaccacguaacauguuuucaggcuaaaucuacccgcuagcugccaguccgaacuuuggccuggagguugaggagaguuacagaaucugcuuguuuuugucuaucccuugccacuuuuccuuuguccuucuuuucaaccucgcacgugauuuauuuaagcagaguccauuguuggcuuuuuauuuuuuguuuuugcaagcuggcccucggauucugccauuuauuugaaugcuuaauacuuuaaguagacuuuugacucccauccccucaauguuuucuuccugcuggucauagccacucugggggguuuuguucaccaugcccuuagguauaugauguacuuuguaucaggaagaauguucagaguaggccaccuggcugcugcuguuuauguuggccauguuuauuagaauaggucuuaguuaauguguagucaaccuugguggauaaaaaagauucacuuguuuccauuuugguuauuuguaauguaggaggccagcugucuuuauucuuggcaaguaaaaguaugggucauuuuccaguuagagcaagaaguuacuuaagagaacuaacugcugucuugguagccagcgaugcagagcaguuguucuuccuuaauugauggcaggcaaauuuggucuaauuacuguuccagugcaguggaaguuuucuucaguuuuaauuuaccguucuugcuucuaccucaugauaccccccguuucccacuuuugcucuuuagaaauggagaauaaagaauaguguccugaugacucaacucaauuccaaggccugcagucuccagaucuuuguugugaauccuggguuuuagccugacaaaggauggauguaaaaagcaugcuuggguggggcagaaggguauagaaagggcacguuucuaaaccaucuauuucccuuauagugauucucaacuagagacuggcacucagaaucgucaaggaacucuuuaaaauagucuaagauagagcgauagaguggcauuugaguagaucuacacucuucacagaagaauugaaaaauuuggguucagggucaugguucccuuuagaagagugguuuaaggaucuuuuuguucauacccaucucagauuaaaguaguggaugauagcgagaauuucuuuuuagcucgaucugaaagagauugcaguccuaacugcuguagacuauauugccugguacuuaguagguacuuccugaaaguuuuaucaacaguuaaagacuauuuacugcuaagcaauuuacauguuaaaucuacucuacugagaguucuuuuaaagaaacuuguacuuuacauaggaugaaguuguaacaggaaauggguaccuggaaaacucucugagcaauucuaaaucaggaaaacuucagccugcucuucuuuauaauuuaaaauuuucuuagugaggcagaaguccacuuuaauguucaguaucaaugcugugcacagucuccuguuguuuagcacuuuaaacacugggaagcaaaaugccucauuucuucucaaauacguguccacacucaaauauugaaguuagaagugguaguuuccauagcagcagugauuuugccaucuuuuuuuuuuuuuuuuuuuuuuugauagcaaacuauuuagcauaggucagguagagaagggauuauuucuggcugcggguucuuaaagguuuccuugugugcguuugacuucuuuggacaccuucuuaggacacagguguguuuuggagaaguuccgugagggguggaaugagugggguuuuguacaucuuuguuuucccagcaucugagcacagcgcuugguacaugcaguagaucaggaauguugcuuuucuagccuuggggaguuucuuuacuccucuuuuugguauucuacacaccagaccuuggcuguguuggggagagaguauaaacuucagguuuccucuugauuuuacacauuggugaugagauuggcuuauuuugaacugugagauggugacaauggaacacaccugucccugguuccucccugagguuuauauuguuuuaacaaaggcuuguagcuaggaauuaaaaaaugcugauuccacuugaaguuugagcuuacaauauggaauuaguagcuauaugcggaaagagauguguguguuagugguaggacuugacagccuacuuuccccuuuuuccccuugacagucuaccuuccucuuuauaaacaaccugagaugacuuuggcugcuccuccagcuauacaggguugcaauggaaauuuuucccacuuggcagggaacauaaaaccacauggauaaguaaggggguuguuuuuuacuugccaccuugaaucacaauucauggcauucauucucuuuauggaucugucuugauauuuuuuacuggggagauaaaggugagucaggcauauaggagcacacagaguuaucugguccaacugagugguucacagaaggcuuccucgagguuugucugcucucuuccggugcugaggauguuuccaugaggcaggagaagaaagguaggcuguugcagguggagaaaacagguugggugacacuggaaaacacugggagugggaagaacuacugggagcuuguuagagcuuguguauaugaugcgggggugcugggcauguggaugaagagguaggagcucggucaagucagcugccucacuagggagcugagauguuacuucauaggcaacguggagugagcagagcuuuaaaagagauaguaguggagugcugcccauuauuuuaguuagauccccacagccguggaauggaggaaggauuggagaaaggggcaagccuggaaauagagagaucagcuaggaagcucuagauggggucucagcacugauuucaaaucccaguuucucacuuaauacuugugugaacucuugaaguuuugaaauucucauuuguaaauugaagagaauguaauauagcuuauagugcauaagauuuguuuuggagacauggucuugcucugccacccaagcuggagugcagugguguccuccagccuuccaaaguguuggaauuacaagcgugagucaccuugcccgcuccacaagaggauuaaauaagauuuuguuuguaaauaucuagcuugagacuggcauggaaagaggaaucaauaauugcuaguuucuuucccuugccauuuauuuuuacuuuuaguuguaggauucguuggauucuccagaaggcagggagaucaucugaacuucuuuacuguagcaaaagauacucaaaucccacggaaaguuccuuuucuauuuuucuuguaauuaaaugugauuuuaaagccacaguuuaaauucaggucauuuuugaagaucaugauaggagaaagaugauaggagaguguaugauuuuguaugaauguagauacauggaucauuugccugauccauuaauuguggaaacuugaucccaugugaucucauaauguacacauuauuaaucuagauucuaggguauaaucguggauuagauuucuacacucuuguuuucucuguauuguaaaucugaauauaaguacaagaugccuggaucaucuuuggaguucuuagccagaauaaggagguagcaauuucuaaucuuauuaaaauuccaagagccugagcauaagcaggcucaaagaggaugggagauguguauuuuuauggggaguuggggaggggggugggggucacacacuuuuaaaaauaagguaaauuaaaauaggcaaggcuguaauucuaaugugaaguacuugggcuguuaguacucuguauauuuaaacauagucuuuggaggucugggguuaaaaauugcagcauugcaaguaaaaauuuuuaacuuccuuagucaccguuugugacugugcuaaauguaguuuaacauagcaucugcuucagcaguccaggacaggaauuaacagucaugauuaggaaaagucugcauacuguacuuucuguccacagucuuuccuuuccauguuaaaaggcucccaacacgacucugcagccuugcuguccauuuagauguggggggaagaaaaacugacaggcuuaauccaaaagacagauaagcaaauuuucuuucuuucuuucuuucuuuuuuuuuuuuuuuuuuuuuuuuugagauggagucucucgcacuuuugcccaggcuuggggugcaguggugcgaucuagacucacugcaagcucugccuccuggguucaugccauuguccugccucagccucccguguagcugggacuacaggcgcccgccaccaaguccggcuaauuuuuuguauuuuuaauagagaugggguuucaccguguuagccaggguggucucgauauccugaccucgugaucugcccgccucggccucccaaagugcagggauuagaagugugagccacugcgccaggcccagauaagcaaauuuucuaugcuaacauuuuaagagacaucuuguuuuguccagcaauaaugauaauacccucuguucacuuggcaccuuagaguuuguaaagugcuuugacauuaucagacaaaauauguauauguaauuaaagcuuuuaaagagaacagaccccuuuaccugcucuuuuccuuccuagaguggaaauaauucaaaggcuaaugcuuuugugauuugagucuuaagaauaauuuccuguuaaaauguagccuguaauugcguaugugcucccuucuccucuucagccugugggggauagauguuucucaucaacacuugggaauauguguguauaauguauauacagguuauacauauacauauaugcucauacacuugcuucauuuuucaucuguaacauggggguacuugccccaccuacuuuuugagauccuuaagcguucguuucaaaugugcuuuacuugaaugauacuaagacaacuugcaaagcgggaagucugacaaaaguaggaguaagaggaagcucuaugcugggugagauggugaggucaucaaucuaagcauauugaccccuuucucuguuaggggguuguucgaaauuggguguaugugccugauguggauauaaguggauaaggucugaggcuaagaagggccuuaccuguucuauagugucuagcauuaacuuuuuugaaaaacauuauuaacucuuauauacauucuuauguagcagauuaacaagacauuuccuugagauacuucucgcccuuagcaacccuuuccucacuuuggaaucacugaauaaaaauaacacuugcauugaauguaaauucucccccucccccacuuuuuuuucuugaaauguaguaaauaaccaggaacuuaauuaccauaaaaagucacagauguaccuagguguguuuuguucuagcugggaugucgguuuuuaaagaaagcugucuuugggggagcaagaggcagagguggaccaaaggaaauaaaguuacuaucuuagggugugaaucuuguuuuuuuaagaugccucaaauuuccauaguaaauaaaacauaguugugucucuaaaucacaaguauacaugucuugggaaucucaggacguuacacaucaacagaaaagaaaaacacauuucauaggugaauaccaguaauugagaugauccacaguucagagcagaaggaagcugucuguauugaucaagguuuuuagacuccuuguuuugcucuccacaauacaucaaugaauucuaagauauuuaugugcccugggauggcaucccuuuauuuguagccuccuaauguuacuaaggaaauaaaucuuguugguugacauuuuagaugccuuuuuuuuuuuuuuuuuuuuuuugguguaagcugcuugagguuaaacaguguagcauuugguuuucuaucucuaaguccugcuaaauaacagugaaaaauaaaauguuaaccucacuggccaggaggaguguuguggccuuuauaacauuugugaguuaaaaaacauuauuuuuguccauaaaccuuccuugucuuuuauuuucccuuuaagauuagucauucuuucugcuuuggaguuuguacaugacagaguauuuuagugucuguauccaacagaggagcuauguuuuuaaccuaccuaaugaaaacacucaacuacugggauuaauuugaggauuuccaaucagccuuucacaauuuguacuacccugaggggguuccugauagcugugacuuuuguagaagaaugugaaguuaauccaauuucuguguugauuacuauguuaacugucuuaauuuagcaauucagauuaaucugccuauaccaaacaaaaccucugccacaaaacugagggaguaguugauuuuauucuuguuguacucauaucccuuuuuagauucuauugccaaauaauggcauggaaauuaauuggguccacuuagguuggaaugaaagaaugggguuggaaugauucaucaccagaagguaaugauuuaguguauuccagccuauaaccaagacagaguuaucucauggcuuaaccuuuacuauuguagagguauauaaaugacccuguugaaaaauacagauuuuaaaguuuacucccauuuuacaaaaugugacuuaaucuaaucuucauccacuuuguuuuuaaacuuuuggggagagcuuugagcuauuuuacuuugaauucugaaaguuuuaagggggcucacauagauuacaaaucaauuuucugauauacuauguuuaguaguaguugcauguuuuaagcuacugauuugugauuuuauauuugcuccuaaaugaaucaguugauucuuuaagaagcuggcaguggauucauuuaguagcaaauauaaagugaauagugaauauccaaccauaaagugaauaacucuggauuuaauauuuauaaagucaaaauuuuuguauguuggguuuccuauauauaucuauauauagauuuauauauauauccuuauuuucuuuuaaggcacaacuguccauaaaaucucuuccuuugcuuauucaucuuguguucuuaguguccagagcauaguaaauguuuuggugguuuguaggaaugugagcaguuaguaucuaaaccaguuuuuugacaauggauuucaacaguguacugauguaauuaaaauguagcaccuuaauaauguguuuucuucuggguauauccagaaucugaugacuucuccccaacuucacccuggugggagucacugucauccugcaccugaauugcugcaguugcuucuugacuggucuguuuccaaacucacugagucuuccugcacacccacacacaauuuauuuucacaguagccacaugcuacucuuuugcugaaaaccuuuuauaguuuccuuuuuuguuaugguggccuucaaggcccuauguguuccggccucauuaccucuuagacucaucuccuccuacucucccuguuaucuccuugucauucugcacagcagacaagcuuugcacuggcaggucucugccuagaaucuuuucuucuagauaucuccaugggggcugucuuuacuuccuguuagaccucuaacaaauuacuuuaaauuuacuggcuuaaaacaauacaagauuuauugucuuaaaauuccgaagaacaucagaaguccaaagugguucucagugggcuaagauuaaaguguuggcagggcugcauuccucccagagucuuuaugagagauuguuuccuugccuuuugcagcuccuagaggcugcuuauauuccuuggcugguggccccauuuaaagccagcaauguccuuucgauuucuucucaugcuucaucacccugacagucucaccuuccucuuucacuuauaaggaaccuuguaauuaccuuaggcccaccucaguaaccaaggauaaucucccuuucucaaggugagcugauuagcagcuuuaauucuacaaucuuaauucccccuugucauguaacauaacauauucacacuucugggaguaggauguagacauugaggggaaggggauuuuucuuccuaucacagcagccagcccauaucuccuucaaaccuugguucaaagcucaccuuuucauugaggccugcuuguuuaaugcuggaaacuacccgucuucaucuccacauuuucaaccccccuuauucuucucuauauguauuccacagcacucuuacuuauugcugauguacuguuuucuucuauguguucauacuuguauauguucugcacacaccauccacagcaaaucagcacuccaagaugcuucuucauugcuguaccucaggacucuccugaauucgugggagcugcauggagauguucguugaauggaugaaugaacaaaacaugaaacuuaagcagaucuuuuucgccagaucuuuacuuucccauugcucaaacuggauaccuguaauggacuuagacugaagagaaggacuugggacccuaaacucauuaucuuaccucucuaaccucaaagcuuuugaaccugccagcucugaaacuacaaaaccucagaaagacuggcaugaaggagacuguguacuuuguccguagaagucauaaagggccaagagacagaaaaacguuaguguuugcugccaaagaacauucuccuuaugacgcgugcagcuguucagugcauugucucugcaaguucuugggccguuguuagccccaaggcugaaaauguggguuugaggaauucguagagcuagugagacagcuaacaugguaugugggugggcuggagaauugacaaggauucuagauugaauaaauccuuugacauuuaaagcuacaaaccuuuauuuuaggaaucacaaagcaaagagaguuaaagaaaacaaacuaauggcuuguuccuguaacugacauuguuagccuugugauuuuagcacuugguugacuauucucuugcuuaauuaagugaaaccacaaacauauccugaaaauaccacuuagugauuugaaugggaaagauaaagcauuugcuauaggaauggugugugucgggcagaugaucccuuugacugccuacccagcugucaucuauaagcucauaugacuuauuucaccaauuuuggagugcuuuugucccugcugcaaguuccccaaaggauggugugguaaagguugugaugccugguuuuguuuuuuguuuguuuguuuguguuuuguauguuuggcucuaaaacuuuagagacaaaugucuucuguucaucuguaacuuggcauuuagggagagguuugauguggucagaaggaaggccuuuguacugggcugauucuguccuggugugcuguguuugaauacucaggguauucaaagcuucuaguugcaaauaaguguagagaccaaguucacucuguuuaggcuggaccuuuccagccugagagauaagcuugucuuugccucuagccaugauucuuuuaagagauguuaucguuucuguuugccuaaacuuuucuaguuaguaugaagaucacuggugauccacgacuuaaucaugaugugcuucuaaaugccuucuucaagaucuguuuaauuuuccugcauuuaccuuugauuuugccauuuuccugaaguuggacccaaauuccacaugcccauauccauaacccugcuggccagaggcuuggauuugucuugucuuccaggguuuuguaguuagugugauagauuguugaaauaaaaauacacaacuuuucacaaagguagaugguuuccuuuuaccauauaauaggaauuuagauuucagugggugaggguggcugauggagugcgucaaaacuugaaaauaugcuuucauaauuacuucugguuugaaauacuuggugggauagaaaaacaaguuagagccacucaugauuauuuguguuuccaauuuauaguuuaaauguauuuguaaaaaguaaaaaaaaaaaaaaaaguuaccuaguuuguacacauuuagggagggauuugcucuuucagucuccaauuuuuaagaaacuguucuugcccuuugcuuuuucaaugcuuaguuuguacaaaccccugaaauggagaugggguggguuuggauggagccuugaauaagggagaugggacugcauaaacaaagcuagaagagugaagguacuggacuguuugagggacaaggaguaguucagaucuuaaggugcuugaauaagugggcugauaaaaguaguuguacaggauuucuguugauaccuaguaguuuacacuucauuugauaggcagcagggagcugugggaggguuuagaaagucuaccugggaacauuguuaagguagauuaggaugaggagagagggaccuuuuggaggcuuuaauuugcugguccugaagaagaugagagcccaggucaggauguugaccauggcaauggaguggcuggagcaacaggcgcagccucaccaggggucauuguauuggcccuuucagcagcccugcuaugacuuuaacccgcagaagucuggucccuaaaucaggugguuucuaggcuauggaaccuuuuucccuccucgcaacauuauacugagugaacuuaauaacaacucucagaauauaguuaggauauauuuauuuacuuauuuuggagacagagucucucacugucacccaggauggagugaaguggugugaucucugcugacugcaaccucccccuccuggguucaagccauucuccugccucagcguccugaguagcugggacuacagaccacgcccagcuaauauuuuguauuuuuaguagaggugggguuucaccauguugcccaggcuggucuugaacuucugaccucaagugguccaccuaccucagccucccaaagugcugggauuacagacgugagccgccgagucuggccuauuuaagaugcuuuugauuaacuaccugguuuaguggcugucugcaagagguuugaaaauagugaagaagcugauuaccuuaguuugcagaauuuuuuaauuguaagauuagaaaauauagacugcuuuucucucaugugaccaggaaacuauuggaucaguuugacuucucaaauucuuaacucuucccagauaugagauauaaagcauuuauuuucuaaauuccacuauugugaaaacaguagauguuaaaauucauaaaggauuauuuaaauaaaaaguuuagaagucuuuauggcuuuuuggaaguaccuguguguauaaaaguagagacaaucuucuauuucccaauaaaaccuacgcuuucaccauaguaacagccauuuuaccuuggagcccagugaaaguuuagaauauucuagauucaucuaugcuaaagugccuuuucguaaauuauuacuuggauaauaacaggaggaaaagcagucugaauuggcacaagugaugucuaaauuaagaggagaauauauauugaaacauuauuuuuuuaagccuuaaaauuaauggcucuguuucacuggaauauggccuuuuuuuucuuuccgaagaguuucagagccaguggaaucuauaaauaguacacagcccaguugucugugguagauugaguagagcagaauugccuguccuuaagugaaggggaaguagcuuuacauuuuuaguaacugaauuguuggccagcauaaagguaagggccaugugagcaacuuauuuauaacuucccauaaagguaugugucugccucaagcggagaagacugucuggggugcuugaaauguaaaagugcaguagaaucauuuuccauacacagccuuccuaucuaguuggugcaauaaagugauuguucaccucccuggggcuuucagaaagaggggugucaauagauuagcucauuaguguccaccuccuaugaaauagaagggacugaggcaguuaaauuaaaaucuguuuuauguagugagcaauguuuagauugaacuccugaagguauucaggacauacauuuaugccugcuuuacccugcugggugugguccugcucauguagucuuaacuacaguuggguucuuaugaaaaaucuuucauggguguaaagcacuuuuucacagguucaguuaaacuauaaguaguuuuuugaaaaauaacauagggucagaccaaaaucucuuguuacagugggagaacggaagaagaguaaaauauuuucauggcuuccuguaaaaaaguauguuaauccuuuuugauagaugccagaaaguggaauccaucguuacuggcggcauugcuaauaucaagaguaaaucacagccaggauugccucucaggauaaaauuuuuauaauuaucaauaaguaaaagacauuuuuggaccucuucuguuauucacugucuauuuuuagaaacuaaguuuucugauuauauugaccauuugaagcaucugcauauauggcaaaaaaaguaaacuuuggcuuuugugccaauaucauggcucuguuugguauuugggcaaguuucaauaagugguaaauggcccauuaacuauauuggaggccucauagcagcacuaauuucaaaucgugcuggguuuacaauuuacauauuaaaaaauguucacuugauuucguucagggacaaagcugacauccuaugcgagcauuacuccaaacaauccuauuuaucgguccaauuauuucaauugaaagaugcugguuuacugccucuuaguauaugugagcaauucucauugaaacuguuagaaaccguuugacuguaguggcaaaauaaccucacaggguuucgauucacuuuuaauuuuaagucccaggauuaaggaucauuuauaguauaauguaacagugugggcaaauauagcuucucuuaaugucuuucugauauuuuggggaaagagugcuuuuaugcaaaccaaucacuuaggaauugcaugaugacuuuuucccacuauaaaauuucauucacauuuccucccuucucccacauccuuaagagauaagacagccugcaguauuuugcuuuauuuuacuuuauuuuuuaaauuuuugaggugugguuuacauuaguucuucagaauagaugccaagauaacuaguuaauacuguuuuaaaaucaggcucuuaauuaaaaaugcuuauauuugugcaagaaaacuacauguugaaaugaauuuggaaagauuagauuggaauugccucaauuucaauuaagccacacugcauggacgugcugggaauaucaauacaaucacuguaaauuuuguacaaacugauuuguugcauuaucuugcucaucuaacauacgguacuuuuuguguccauauugcagacggcaacuccaaacuaacauggcagucagacugugugauguggcuucucugcuuagaagugguucgugggcagcagagccuuggaccggggucugugggauuuuucuuaaauucuguaggcuacuuuuuuuuagcauguuggaggagugcugaggccauaccaaacacuugaaucuuucauuuggcauacuaauuauucuuacauuuaaccuauugugguauggccaucauuaggacuuaaagcacauugcaauuuuaacuguagugguguauguagcaucagaaccaugcucucguauguaauuuuuuuacaaucuaaauuaggauuuagcgcagacucaaaagagugacaagcuuuuuuaaaaaaacaaaaaaaguuuugguauggucugaauacuaaguuaccguaauucuauacauucuguuuacuauguauuuuuuugguuacuaaauuuugaaguuauuuacaauucuuuaugcuccaaaaaaaaaguugaaauuguaaaucuggcugaaaauuauuugcccaguaacuguugaaagaguuugcauucugugaacaguuguguugagccuaucaauggaauaugcauuauuuguaaaauauagcacauuaguaucauuuuauucugagcagaugguccuauagcagagagaugcuguaauuuucagcgcacacagccuacugcagcuguucacuugaauguuggcuuaggagcucauucuugccaccugaacauggaaauaaaugugcaauuaagugaggaguguuuguuguccuuucuaaaucuugcugauuucagucaaugaacacuuuguauuucaaaugcuaucccaaugagcuuuaguccgaaucucccauucgggucucuuguaguuucuacacccauccaaacuuuucaguagugauuuaagugucuuuggccacuuuaaucuuguagcucauuguuuccauaacugcugggcaaggguuaaccccagaagaauuuuugcugugaaaagagugacccacagcuaauauucuacaaaccagaacaguuauguuuaauuaggaaaucugaaacuucccuuuucaaauucaaauagauuugcuaauuauaauaaaacccauaucuugaauuauuuaagauuuuuaaauacagauuuccaaagguuuauuuuccuucaucccuuuaaguauucccugagaaaacuuagcuuacguagagaaacagcuugcagcuuguagaauaaauucccacuucuuugacaaggaaaugaagucacagagggguuacagguuguuggauauuucaaaagcuauucuggauuuugccucauguuuuuuuaucaugacagcacugauucuuguucagucugaccagucucaauauguccaacacugccuucuuuuguaaacaucuccuggcaguagagauuucuuccuauauguuuaucugcuaaugugcccuuuuauuuuucuuaggcaauauguguuuuaaaagacaguuuuuucucuuuccuuguaacccucuuucccuuuacuuugcuuuuuuucuuugccucaaguucuuugccuuuucuauguuaaagcuucccuaaaacuagcaucccgucaauucagaauugucaguuuugagaagcaguucuuuguggaggugagagauguaugcaauaugaaggauaauccuuucagugaugcguugauuuuuagauuccaccacagucuuggcuguccaaagauagguaguuaguggaaaaugauuuuggaaaauuuggggcugugguuugugacucuuuugcauaggauugguuuuaggaaacuagauuuaauacugcuuaauaagugauuuguagaguagccugaacaguuugaggccauuuuccccaauucuguucuuuaucugguguuuggaguuuauagauacccuauuacuugcauuuucaacaggcuuaugugcucagacgagaauuccuugggcuggucuguuugcaaaaguugauauauuuacauuguuguuuucauugacuggauagguuuucuuuuuucucauuaaaaagcagagucaaggagaaacaccauaucgaaguguuuggggauuuuauuuugauguuguagaucagucaccuuguugguaauuuuuagcugccaagguugacaggaguguccuauuagauucuaccaguuagacaaaguauucauagcucauucccaaguuaccuuacaguuaguuccuuuccacucccuaaaauauagcaucuguuuuuuucuuaccaaugguagagauaagauauuguccaucaaaaacguuuucaauauguaaccaaaacaguacauguugacaaauuuauauuuuuaaaaguacucuugcucuuugauuuuuaaguuaauggcuaucugucaguuuuagaauauugaaccucuuaggauaacugaaaaucucuucagaguuagguaggucauuuuuuuguucauuuuuguagcauguuaagcacuuuuauuuucuaguaugauuuuuaguuaggguucaauucugugcccuuugguacuugauuuucucaucuguggacacugcaggugaguaaggauaugugaauagacccagaaugugauucuagaaaauguuuaagauuuaaauugugcuuauaugcauguauggaauauguaugugaaaauauaguuguaaccuuaagaugaauagguuaauaugaagugaaaauuaguguagguauuacacuuuuuguugaagcauuguuguaauuucauuagaacgacuuguguuuagugacaaguguuuaaauucuuggauggagucucuaauagguugugaaauaugaauucugacauuucuuguuuucucuguuuuuagcagguaauugcugccauggaaacacaacugucuaaugggccaacuugcaauaacacagccaaugguccaaccaccauaaacaacaacuguucgucaccaguugacucugggaacacagaagacagcaagaccaacuuaauagucaacuaccuuccucagaacaugacacaggaggaacuaaagagucucuuugggagcauuggugaaauagaguccuguaagcuuguaagagacaaaauaacagguaagcaguuuuauguagaugauuuauauuuaacggaucgugucucaagauaggagaaaauaauaagauuacugcuuguaaauaauucacugcugcaauuuuacauaucuagauuuucucucuguuauuacaucagcaauaugaaacuuaguuuaaaauuuucuuuuuaaaucauaaacuauuuugggggcaguauauauuuuaacuggacuuuaauguacucugaucuggacaggaucuuuggaaaaucuucuaaaaguauauguaucugggauagccagugucauguuaacuuuuaucuuuuaguacccugaguguauuuaaguuagcauuucaacagugagauacaauauguguuugggagaggggaaaaaaucuuaaaauguguuuuccuuauguuaauauaaucauuuugcuuauauaugauaaaauaaaugguaauguucacauugucaguguauaaacauuuucacugauauaauaccaagcgugaugagaucuuauguuccguuccuuaacaaggaaaggacaugguauaugauuguccuucuuguuauaaagauaaagccuuaauuauaguacauuuugaauauuaggugaaaaucuccuuaguauuuuuuaagauuugacuaaauuuuuagaguaaaccaaaaccuaauuuaaagagcacguucuugggauagaaggguuaaugcuuccugcaggaguuguuuucaaacacuaaaaauacaugaaguuagacauacauaugaaguuaaacacuaaaaauauacgaagguagacagacucuguggacuuuucauguuaauuaaauuugauugauaguguauaccaaauugcuuuacaaagcuuauaaccaaaaauauaaaauggaauauuugaaaugaguaaaagauacuuaaaggcagugugaagaaugagaccaggagucugaacucucaccuagucaugugacauuggauaagucagcccuagacuucugguuuccauuggcaaaauaagguaaaaggcagagaaaaaggggguaacacugggccauuucuaaguucacuuuugacuuuuucauacaugggacuuugagcuauuccguuaaucguuagggcucauucucuccaagaucugcaagugaguucuagagccagccccuggacuuggcucauaaucauauuuccucaagcuacagauugagauucacagagacaacuuacugaaaucaaguuaaaaagcuaaguacaaacugauugucauugauccauagcaaacggccauuauauuuuaauuauguugcuuaaauguucacuaugauauuaggaaggugguucuuauguuucugaacacugauaaucagauggaugagauuuuucaauuucuuuuccaaaaugagugugauaagcauaugugaaauuuauaguguuuuuaauaaguugaaaaaggugaagaacaaaaggcugcucuuacgucucugucgugauguuuuuaaacaucuuuuuaacauguuuuaaacauguuaucuuuuguuuuuaaaguaaaacaacaccccugacauguggauuuugcaaccuuuuuaauauaaaagauaaaaauaugauaaaugacuugagggcuaugacacaaaugaugcaauuucugauugcuuaguagagcuccccuuacuauuaaaaagaaagaugcaugaacagagcacaaaagucauguuuuguuaugaaacuguuacgaaaugauacauuuuaucauuuuauaagaugaaaauauuagacaaaucauacaucuuucauauuaggcaucugccacaggagacaucuuacagauccucacgucucaccucuagucaaucuugaauuaaucuuacucuuuugugaaucuuuagagcuguuauguggcaaaaugggauaaauuugaguucuuuaucuucaccuccuuugccucucuaacuuuagugugguagacggugguaauagaagcacaacacauggguauucuuuaauacauaccuagauacuaaaaaacuguguaaauauuucucauccauuuccuucaccucugaccccugccuguugucuuuucaguggcuugaggggaaggauguaauggagauuuccacugugguaaaauuucuauuaaaaauauuugguaagcaaguagaguccccaagaaauuccacaauggucaugaguauugaaagauguuucuaaagauguaagacguuucuauacauuauauauauauauauauauauauauauauauauauaauacuauauaugauguauacacauauauauuacguguacacuacuauauauaguauauauuuguauauaguuaacacauaauugaacaaauuuguggaguacagugagauguuuugaugcuauauacauuguguaaugaucaagcaggguauuauagcauuuccaaaucucaaacauucauaauuucuuugagaguguucaaaauccucucuucuagcuauuuggaaguauacuauacaauauugcuaaccauagucacccuucuguggaauagcacaccagaacuuauuucuuuuaacagugacccuguacucauuaaccaucuggcccccuccuuccuuccuccucucuucuccacccucugguacccacuauucugcucucgccuccaaugagaucagcauuuuucgauucuaccuaugagaucgugugguauuuggcugucucaccucacuuaacauaguguccucuaaguugacccauguuucuggaaaugacagaauuucauucuuuuuuguggcugaaugguauuucauuuuguauauauagcauauuuucuuuauccauuuauugguugauggacauuuggguugaguccauauuuuggcuguuguaaacauugcugcaauaaauauggauaugcgugcaucccuuuugacaaauugauuucauuucuuuuggguuaacaugcaguaguggggaugcuggaucauacgguaguucuguuuuuaauuuuuugaggaacuuucauaccauuuuucauaguguauuugguguauuaauuugccuucccacgauaguguguauaagauugaaagauguuuuucaaccuucauuuggugagauacuaguaauuauuucuuaacauaaguauuauauugacagacaaguuuaggaagugcugcacucuguaguucuuuauuuaagauccauacucgauaaucacuguauuaagaacuaugaaaaauccagcaguaaagaaaaccuguuugaauuauaguuccccggccuuauuugaucauagagccuauuuggggacugugggaagagugaguaucucucccugacaguagauuacacugaacauggugcuauaaaagcuuuugaaaucauuuguuguuaacugguuaucagaccaguuuaaccuguucacaucaauaacauaugagcaugauuccuaaaagaaacauauaugauaauaaauucaaaaguggaguagguaaaucugaacacuaggcaucucaacuucugguaaucuugguuugauuuggaccacugacauauuuguaauauggguuaaaauggcuuuuagaaggaucucacucauuuaacuuaagcauaaacugcuuuaggauauuuuuuuuucugaguuucuuacugaauacuucuauugaguaaaauagucuagaaaaugguaguaucuaaaucuggguucugagugguuguacuuugaaaaguaggcauacuucguaagagguaguacuaauguaucucuagcaagguuuugaaagaauuuguggagcuuuggacccuguccugugguguguagcauuacccgucuugugcaguuucucaguacguauuuuagggacagaccagaguucuuugguccuucucuaauuauccagcuuauucuaccuccugggaagcaguugggacccauuucuguauuccgauuuuguaggagcaugugcguuaauuggguuacaggaaaacucuggagucacucuacaggaagauuugaaaucuuuccuuuucccuuuucuuaaaucuuucuuaaugcugaaucaggaaacuauaucuaaggaacaaaaauaucuaguuaggaaagugugugcuucuuaaguccuugaagagaguguauaacuuuuagacugugucaguguuagcaaauuaaugucacuauuuugaucgagugaggauuagggaaguacauuaagaaaugucuucaguagcaaauacaauaaucuucucucuagacuaaguucuauuuauuauguuauuugucagguccgucucuuugggcuucugcccagcuguaugcuucagccuguuuccuaucuauaggcauucaucaugagaagcuucugcugcuuguacagcuuagcugacuuuaguccaucccuuugcguuuuuaaaugcacuugggaguccuugacaccugcugaugcugcauucuagaugaacgaaauggauuuuaugaugcaaggaaugaguaauaaaguguuacagucagaaaagcccuagaggugaccuuaaccaacccucucccuucuuugccccaaacaucauaggugaugagaggcccagguuugugaaaugacuaguucaaggccacagagcuauuaagcgguagaguagggaccagaauucugauuaucuuaugcuuuaccuggauguuuccucuuugccacuuguuggaggcaagagcucacucuuuaaagaugaagcaaauggccaacugaugaauuuauagagagaugugugauuuuuacagaguuauccagagggcaucuucuggcgagugugucuucucuggaaggagaauggaagguuuuugacaguaaggacugacgaauacaccaaaugaacaagaacaucugugcuucucuagaaacauuauaaucuaugguugugaacuugauauucuagcccggugguacccaaauuuggcucuacauccucaccuacucaccuaagggaguuuuggaaucuguugucagagagcuucccaggugaucuugaagcccaaaaaaguuuugggaaucagacugugucucaugaaguauggucacaggauucccgcauuggaaucacuuguaaugagugcuagaaaugcacgguccugggcucuguccaggccuacugaaucagaaucuguaguggggaccuggaagguacucguuagcuaggaguuaucaaugucuuaaacauuuuguagggagauugaaccagggauuuccagguuuaccugaauucuagauuuagggcguuauggaagagguguuaacaauugcaguacuuaauucuuuggaaaguuuaaguuuaaagugcuguccccucuucagcauuggucucugaguuaauuccuagcuuucagaacuagacauguugaguuuacgucacuaggcuguguccuuacugaucugauauguugcugaaagcacgugugcgagcauguguguguguguguguuuaaguguaauuagguuuuugaaacuccaggguagauuguucuuucacuguuauuuuuccuuucuucuaaaagaauggcuagaggaguaguugguggaagaccucagguaaugaguauuucaccauuacucucaguuguuugagguaggucuuguacugaccucaucagcugcuaacuagaaacuuugacaaaaggggaaaaaacaaaaacccaaauauaaauuccagagggcccaaagagauguugauuaccucugaguagguagugccuugcaugauaaggcuccugccaugccccagcacgccuuagggcuaguaucuuaaaauauuuuuuauuaauaugaguguucuuagcuagguuuaucuugugucucugcuugcugagaauuuuacagcuaguuuugauccuucuuuauucuaucaaaauaaugugauuuccaaacuauuuuaauggcauaggauucucuucuuuuuaaacaaauacaaucuuagcuccucaggauugaaacagauaagugguauuuuauuagacuaaugggaaccuucaaauuuaauagcacuuauuuccuaugagucaaucacagugaacacaaagcuguuuugaugaacauuaauuugaaaaugugauuuuguaugucaguuacaguuguacagugagcaugugaaauguccauaguaucaagagaucaagaauucugauucuugcagaccaguaguuggaaacagcagggugguugggugggugguaacuuaauaaacaccucacuuugcaaacucuguaugcuauuuaauuagaaagauggcagaaagguuguguguguucuuaggucuguaggaaaggagaugccugcacagggguaaaugcuuugguccgcagugcguuaacuguggaauacaguacauuugaaucuauuuuuagauuuuagugcccaaguuuguauaaaaugaaauuugugucaaguuuguggaaccucuauuuuuggaacaucucucauaggcaaaagguaauggagaaacuuuauuuauaucuucauugauguaucuuuaaacuuaauuauuuuuucauuauaucuuguuucuuugccaaaggucuugcagucauuuaaaaaauuugguguuaucacuguagaagcuucauauaaaauuuuggagaaagucuuuaacauuuauucuucuagguucacuuuuuacuugaaccuggguauuuuuauagaacaauuuucagugucagccuugauuaguuuaguggaaagauuacaggaugaugaaacuagaaauuuguaacauuuuaagaaaucaaauacaguacaguucuuuaucauuguuaggaaaaacaacuucuguccucuuuuguuuaguaccuggggacuuggaaauuaauuggagaaauggcacacaauuuuugcucguauuuuguguuugggaguugacagaaaaguauuauaaaacuaaaguggucaggguuggggggcuuauauaccauuuuaacaaaggaaagguuuggacuuugcggaauaggaaaucauggggaagcguucagaaaauauguagggguaaguaaugacaagauaagggcacuuuuaacaagguugguuuauacagaacuguaugcauaaacaaucugauguugacugucucaaguaaugagucgcuuacuucugaacugguacaggacagagagacaucuucccaugggaaauuuauacucugcuuuuagggagaaaaggggagggcagagaacucaucuugcaucuguugacuucuuauuuuccucagccuaaaauaauacuugaugccagccaggcgcagugauucaugccuguauucucagcacuuuggaaggccaaugcaggcgaaucaccggaggucaggaauucaagaccaaccauggccaacauggugaaacccugauuguacugaaaauagaaaaauuagccaggugugguggugcugcacgccuguagucccagguacucacaaggcugaggugggagaauugcuugaacccaggaggcagagguugcagugaacugagaucgugccaccgcacuugcauuucagccugugugacagagcaagacuccauuucacaaaaaaauaauaaaaaaaaaaaacuuaaugccaaaguggaauauuuugggguggcaaaucuggaccuuuucaccauucaguaaguuaauucccaguuaacaucucuucauaaaucaaagagcugcuucuuuagauaaccugugguaaugaagccuuuaauggcuaguugcuaggaugaagaaacaucuauuugaggauacagaaaaguaugaaacaauauucuucucuaguaauucauuaaucauccagauuuguuucucugauuuccugauauugauauuuguguuacuugguauuuuguuccguuagaauaaaauguaaaaaaaaauaugugucacucccacgagacaguuauacaguuuuccaacagcugucuuagaguguuuacugggaaaauaaaguugaaccuaugguguaaaugagguuuaggaguuuugauuuugugcuuuccuagcccuuaucagaggaacuuuuagaauagccguauuugccuuaccaguagauuaggaauagucuucaguaaccuuucucuuuguugcuuugcugguuugauagaaaacacaaacuuuguaaacauauucaaauucauagaaaauaaaauuacaguugaaauucucuuguaacauuugccccuuuauaauucagcauaagagugcacgugugcuguuugcuauuccagaccuuuucugggggguagucuuuguuuacuuugcaucaggagauuggugguauagaagagacaccauucucaauuuaagcgcuugucguaggaaugauggaaaaugucgaugaggaagauggugaacuaaaauggaaauaguucaguuagaagauaaaaaacaguuaaauugugauaugaacuuguugcuucuuuuuuuuguaguuuauagaauuuuaaaauucuguuucuuugguaugaaaaugauuuauaccccccauuuuuaugauguaguacaaaaucaaccuguuuuugacaguuuucauucuauuucacuaccuuaacuaugacacagcuuuggccaccagccuuuuauuuuuuuuuuaacuuuguuuaaauucagaauagaccgaagcacuuuuauucuguaccuguuggaacauuuccuuucaaauauuccugaacagaauaguugauuauuggagcuaaaacugugcuucaaaauuugccaacuucuuuugagcuuguucuaaguuaauugacuuucagcugaguacacugcugcuacugaacguugagagcuguggaaacccucagagugugcuuuuccagcucaaaaggucaacuuuaacagauauuuucuggcauuuuauuugagugucauucgauuugucaggucuauacaguggcuuaauuagcauguuuuaguccuuaagguauuuguuuuggcucuuuaaaguuuuagauugucaauauuucaaaacccuuggaugccccuuuuauugguguugggaaauguaaucaaauauuuuuugaggggcuguaaaucacagaguagcauuugcugcucuaaguguugugaagaaacagauucgcaguuaaaaccaucuuuucagacuccacucaguaauuucugacaccauauaucaucuuuauguaaucgaggggugaucauucuguauuguucuaaauuagaacaaagauuuaccuuaugccuccuuuaagggggaaaaaagcaagacagaaguauuuaagcuguguuuauaagaguuccuuggcuggguaugguggcucaugccuguaauuccagcacuuugggaggccaaggugggcagaucaucugacaucaggagaucaaggccagccuggccaacauggugaaaccccgucucuacuaaaaauacaaaaauuagcuagacuuggugcugggugccuguaaucccagcucuucaggaggcugagacaggagaaucgcuucaacccgggaggcggagguugcagugagccacugcacuccagccuggaugacagagggagacucuaucucaaaaaaaaaaaacaaaaaaaaguuucuuaagugguaguaggauuuacuaaaccccuguguacacuagguuuguuacuuaguuugggaucaaguucuugggauuaaguuugaaucaaaauaccuuugcuuccuccugcuagggagguggccuacuggacacuaaucuuagagcuuuuagcuuagaacauuguuacacuuggguuccaauuccagccuagccacucaauuuguguuguguccugugugugcuuuuugacucugaacgucaguuucuuucauaaaguaccuagcacacagggguacugucucucuuuccuguccucuucuuaccaguuaauacccauucaguuacgugacaguugcagacuuuuguuuuuccccccauagguaaaaaguaguuuuugaaaaacaucuugaaguagaucuguuguccuagauuucuuggaguuugucaugaugugggaagaaugcaaagcucauccuccauccuuugcuuucuaggugauuugaccaacauaauugauuuuccagggguggaacaaaguaagaauagaaagugcgaggcaggacuugggagcccagaaugaugauuaaugauauuacaccagccuuuaugaacuagagcaccggaguguggaauuauugcucuaugugguauugugugaauguuucagaaugaauuagcuugacuuaaaauaugaaggugcucucaagugagcuuuccagugagcuauuacugggcuuucgaaggucagcaaguuguuaaauugagccaugaaguguugguuagauaaaaaccaacugcggcuuauuuuuacuuuuauugacaucaucuuccuuaagaugaguauccguuuaauauaaaacguaaauacuauacuaaauagucucauuuuaucaaagaugauguucaagucuagauauacagagaccuguguuuugggauguucaaaaaccuaauauuccugcaguguuagcagaucagaaggcugaggaaaaaaauuacuaucccuuuguuuucuuuuccauugaaauauucauugaaaacaucuaaagcauuucuucauucagucaucacagacuuuacagauuucaguuuguguguaugggggagggggcaguuuccaugaggguaugguuaacuuagcagaugcaauuuuacaucuuguuuuccuuuuuuguuaaauccuuaugcauauugugaauuagaguuuauuuuuagcucuuaaugaguucuuuucucaucauuguacuuuuuguuggaacucuguuuuguacauacugcuuugauuuuguagggaaaauguguauggcguacaaguccuguauccaccacccccaacucccauccucuagcucaacaaaaauuugcauuucuuggugagggaugauagacuugaauguuuauuaccuuguagaguagaucugauggggcccuugacucuuuacaaccuguuugaccuuuggacuuaauacugagaaagucaaauccuccuuuuaaaguaaaguuuaagggaggcauagcuguguguaaacugguaaaucagaaucacugcacuguuuuuaaggucacuggagccugagagaacaguuuuauuuccucacauuuuaaugcuuuaaauccagucuuaaggaguugccuccaaggguacugucguacgaauccuuuuuccuaacccugguacuaaguaagccaugggagcuuuuuucauuccauuuaaaugaauuguaguuugcucuuauucuacuuuaaauguaucuaaacauuuugaauauaaaugagagacugaugguguaucaaaucaauugacaucuucucauguagacaagggcucuccuaaaugacuucccaaauccugccucuaaaauugucuuuuuuuucuuuugugaaccugaguauuagguuagcucuuuuuaaacauggugccaagugauuuugccauuauauggugcagacaguguacuaccuucucaaguagaaugauuugggaucuaauaucuuaaaaucuaacaauguuauaccagguuuguuuuuagaccuuuauauucuuuauuauuuguuguccuuuuuuuauggggguaagcccuuuuauacauauuggaauaggauuaaaauacagaauuguuaauaccgauuuguuacuguguuuuauaucaauauguguauuuuuuuaagugcuggaaauugggagccuuugcaaaaaggcgugauaacauuccauuauauccccagcucuagaacauacaaagcuaguccugaugugcuacuuaaaaguagaauauggaaucuucugggguuaguuucuuacucuauuugauauuuuaguucucugaaugcuuauagaaaacaauauauuuggauauagccaucaaaguaaggaggaugucuaauauucuuuccuagccuuuauaguuggacaaccgacuuuuaaagagucuuuuuuuuuuuuuuccuuuuuuaagacaguacccuuggaggccacuguguucaugaccagugacuccuugagacuggguuuauuaaauggaccuguuaguauagugaauaacagcucuuagguaauuuugcguaguuguuaguaggcaccaaaggaggaagggugagcguuaguugcucuauagauuauaaugaaagaaggucucaggccagaucccaccacacauagaaaccucuaucuagcaagcaggaccaaauugauggagaagccuuuucugaaagcuugguaaagucccacuucucucuucuuuuuuaagugcuuugaacacacuuuaaaugaaauguucaccggaggcuaacaauaucccaaaagucacguucugcacccucacuuugcaucaugcaaaaagaaaucccuuuaaacaaagacugaaacccaggaccauuuaacauuuagggguucucuccauaaagauauaaccaccuuggauuaugccaccuuggauuuugugcccuguuuauacgaaggugggaagugucucuaaacuaauuuagcccaucugcguaucuugaacuccuuuaauuuuaccgguaagacuccauuucuaacacucguuaugcuaauuaacaaauaacuggcuuacagaacaaaacccuauuuugacauccauuaggugaaucagcagagaauugguuguugauuuagguauggauaguauguaggcuuacacuagucacuugaauuuuagccuacuuguauuauacuaguuaacuaauccuggauugugcauuaaugauaguauguuagaugaccacccagaauuaaagcuuaaauggcuggugcacacgugucaucagauuaauucuaaacuuuaaaaagaaauguuuuuauuguggcaaaauauaacauaaaauuuaucauuugaaccuuuucaaguuuacaguucagugacauuaagcacauucacaguauuaugcagccgucacccuuauccauuuccaguaccuugucaucaucccagauagaaacucuguaaccaucaaacaguaacuccucacccaccuccuuugcucccagccuuugguaaccauuauauuuucugugucucuaugaauuugccuauucucgguaccccauauaaaugaaaucauacaacauuugauauaccaaaguauuuugaaaguaaauuaugauaauuguuuucaggagauacuaguuuuuuuccccuugggcuguagacucuucuguauguuuuauuucucuuccucuccaaguggcuuuagggaccaaccccucccccugaaauaaguagccuggcuucaaauuuaguucaugccacauuccccguaaaagaaacguccaauuaaaauacugaauuugugcaauauuuugccagauugcugacuacuugcagggacuucaucuuacccccuuugcaguuguucugccugguuucaagcuuguuuuauucuuuugaaaauugccuucaaucucuuaucacuccccaucuuggcaaguuaccuggaggaagaggcaguugguguauguacagugggucagaaagaagaacccaaguaguuuugcucccuggaagucuucucugccuucauacuuuucuacucuuuucucccagagagucagagcauccagggacaaacauccguguggggucuugggacacaggacacaguguguaacauccccagacuacuucucguuaccucacuucauucucugcugagcacuugaaggaaaucuuggcagaaagccauuccucaaucagagucaaagagcgacgaguuagaaauucucuucuguaguuuuaguucuuccauuuuuuucucccccuucccuaguacucuuucccccuaccccucaaggaagccccccaucaauauaacagucaaccacccaaccagaaacccacaggacagagccauuucuuuuuuuuagaccacuggaacaauuauuguaguuagagaaaacuuaaauaucuuucugaagcaaccuugggagacagaugcugauguauguugaagcuagagaggcaggugguuuguggccuauuucugccuuugcauuauuucagauucuguuacugaguagaacaguccuuuuuuuaaaaaaaaaaauuuaggucuuauaucuuggccuccugccuucucuguuggcaucagccaaaugcauguuggcugcaaguacaucauuccacacuuagugacuggauuuauuuucagacguuggcuauugacaacugaaaagcaauuuccuguguuggggcuuaacagaaagccuccccuggguuguaagaguuuaaaauaaugaaaaaggugaauacuucauggguaagucuuaaugcaagcuuuguguagacuuauccccacugccuacuuugcacucauguuuguagggaguuuccaaaagccucugauugagaugaggaaggucuucuaccucuggagcuguaaggucuugucuugauuaaagaugacucaagcuuaaccaguuguucaguagucuuugucugagcuuugggugugcuggagaauaucagccaguguuaaguucuugauuucaaguggugacuaucuguugaagagagccugugccaugaaauaccguaguccucccauuaucaacaguuucgcuuucugcaguuuaguuaacugguggucaaccauaguguuaaaauauuaaauggaaaaucccagaaauaaacaauccauaaguuuugaguugcucaccauucagaguaucgugauuaaauuuugcaccuuccugcccaggaugugaaucaucccuuuguccacauuauccauggcugguacauguucccuguccuuuaaucacuuagaauccaucuuaacagaucggaaaaaaaaaaguaguguauauuauguuggauucaguacuaucugugguuucaguuauccacugagggucuuguaacccccaaggauaagguaggggguggaggacuacuguacucggcuaguggaacuucuugugguauaccucaugguucaagggagguagagaaggagggaauugucauacugugaagguggaaugcaggauguucuaaauuggugcuuguuuuguugagcgaagauguaaaguauagucugguccacuaaugauuuguugauuauuucauuugaugauuaauauuggaugcagucauuuauuugaacagaaaugagagaggcuuuuuuuuuuuuuuuucuuuuucaguuuacauggaaagacuucuaaggauguucguggauccaagacaaacuugucucagucuuacauuucauuaggguccuucuguauuggggaauucucuuucuuaguauauugcugaugggaaaaagcuaauuccagaagccaguuggguggguccucucucuuucugccugccuauaggcaagcagccaguaaggaaccgaaguaaagucaauuaggcauuuuaucucaggaccuagggucucaaggaagugauagaaggauaagauggugaugaugacucaccucucuguucugagguggggguaguuuuacuuccuacuacuuaacuccuugaagucugguucccagcccuuacucauucugaaaacgcucugugacucuuccaguguguuucuuugugccaguuagguagagucaguguacaaucuagaacuccauugaaacaauauuuauguaauucauauuuuuuaucuuuuucuaucaguguuuuuuaacucaaaaguaagcuuauuaauuuuguauuggucucaauuugaccuauaagagaauaacuuuuguaauugguuagaagccccuguugugaacuugccauagcuauugguaaaggaguuuguuuugagagguguguauguauguaugcauauuuuguaaauaaagucacuugucagugccuuucaaacaauuuacucauauuugugucacuuuguuaguguuggaggaaagcaaaguuugaauuuaauuuugaaaauaguaggugcagugaagauaccgauccucccuuccaagucaucucuugugacuuccucccccuuuugauuauguuucuugggcacuacuuugcucacugagugugagcaagaacaaccugaagaaugacugagaugacuacuagcaguagcauucacacagcaggucuuuuugaauguuucaucucuagcuuuuagucuucagaggucaguaauguuuggugacucccauugcuuuuaguagcuaaggagagccauauaucuugugguaaaacagauuugccucugaaugaccuacauuuaucuccucugcuuauuuaguggucauuucuuuaaaacccuucaguuaacgcuuuugguuuccagccauguagggacauguguaugcuuacaggcauuauauuucuguguccuaugggauaaguaguauaugucaucauuagguuuuuggacagucuuugguucuccuugaaaagaugcaagucuaguuuuaccuuuauuacaguauguuuuuuuucccagcaaguaagucauugauggugaauuguaaauguaauuguucaaaaaagaaucuagucaauuuuguguucuucuuugcaaccuauuaagauguuuguguacaccuaaaggauuugaaugggauaucuguucagguagcuuaaagugaaaagauggugguggguagggcaggggaaugaccuggccaagauaauaccagguuauagaggauuacacagaaaaucuuuguauaauaucuuaauuuggcuguagauuauacauucagaaaacauucuucuuuggggauuguaaaaaucuaccauaguuccugguuauuugauuuguauuuuauuuguuucuugagacagagucuugcucugucacugcccaggauggagugugguggugugaucacagcucacugaagccucaagcucccaagcucaagugaucuucccaccuuggccucccgaguagcugggaccgcagacaugugccauuaugcccagcuaauuuauauauuuuguagagacagguucucccuauuguugccuaggcuagucuugagcuccugagcuuaagugauccucuagccucagacucccgaagugcugguauuugggagccacugugcccagccuguuuuuuugguuuguuuauuuuuaaaagaauuuuuuugcuucauuuucuuuaagucauagauuacaaugacagagagugcaaaugaaggaacaaauuagcuuuguagggaauaaugagguaaaaguucuaauuccuuuacuauuagauuuaauuauuauuuuuauuuuuauuuuuuuucguggggggugcgcgagaaggauaaagaagcccaaaauaguauaguaggcuuuuguguuaagauccauuucaguauauauauguuuucuugcuagaaaguacucuugcuugagaaaaauaaaguuuauaaucuaaguagaauccuuaauaauguuguugucaauuaggauaacuagaauaagcacuuaauagguuauauucuguuuggguacaggggcuaguaagugaucuggcagcauacauauuuaaaguuuuucccugaauaaaggagauuaguuuauaauauauaacuauuuuauuccuucauuagaaauagcaaggaagaaguuuucagcaacaaaauaggaaaacucuugacagcauaggcuauugaauauuggaaugagcugaaaaacuaguuauuuaguaaaacauucauuucuucgagugguguacuuguaauugaauaccuaacauuuuguauggcauucuacauuguaggaaccucuuuuaacaagagugauucuaacacgcacaucagaaucuauuugugaaacuuaagguggagacgguagaauaauaggugggggcgagcaucagagaguaccuuuagugcaguuucuuuucccacagaugagaucccaaucucaaauucauaaggcuaguuagcuggaggccuuaaacuccuaaccuccuuuuccuuagggaccccuuugugguaauaagauggauucuucugauccacuugucuuagccuuaaucuuaaaauguguuugccaagugggcauguaauguggcccaaauagcugagaagcucuguguauagaaguuacuucccacaucagaugguccuucauauuguuuaaucuggugccauaaaaacauagcgccuuccccaagagugggucucagauaugugaauaagcaaaucgaguaacuucaguaacagcagauuaaagaaagcaucacauuaaaaguuuuuaagaugaauuaaaauugaaguguuguugaauaagauuuuuuuaacccucuacccuguuauacauuuaagaguacuugagaugauaaaaugguaauauguuaaaauuauuuuuguguuuagguuuuuccuguuucauaggaaagauguauccagaauuagcagcaauggucagauguacuaaguugcuggguauaugauuuagauaguucguuuuuaauauacuuuaaagucagugguaaaagacaagacaagccucugugcucugcucauucggcaggauaaugcguuuacuauaccaugcugauguggauggugccacauuacuuuuguguccuaaugaaucauugucuagguaaaaucuuuuuagcaaaaucuuccucaaaguauccgugaauuuuaaauuuggaggauuacaauagcuaaucacuucaacuuuuggaugaggugauuugggaagaaaugcuuaugugugauaugaauguggcaaucguaggagcugcaccauuuuguacuucucuuuaggagccaucuguuaauuggugggcaaguugcccuguggucucagagugguuugcuguagcauaagcugucccugagcaaaaacaaaauugauacuuauuucugucaggguaccucuuugacuuaauucguagccaugguucccaucugacccauagccuuuacaacuuuaaccauguacagcucaauuuccucuggggacuguguuccauuaggauuccuuuucuuuauugcuucagagagaguguucuugagguuugugaagcugugucuguaguauuuaaauagguuuccuuuauacucagcauuuauacccccaccagcccaaacaccaucagucuguuuuggaauuuuuccuaagcauguaaaaaucagugcugugugugacuauuuuaaguuuagaggaaagaaagaaaaauguuccuccuacccucuugauuaacuaccucuucauuaacuauaaacuaagcaacauguccuguacaaagagaagaaaaaucacguuauuuauacuuaauccuugugucgacuggggacgauggauguccuuuggaaauuuacuuccuuugucuuugcuaaaaauaccucuaauuuaauucugcucuuucuuuuugauauaaaaggaauuacaguggacauuuuccccccgguggaaggguuguacauaucggucuauagcagauacuuuaugaucaguacacauaaggugaaauauguuuuuauugaaacaccugaucaugugaugcuacccaauauucccuucuuaaugacucagcuucccucccucuuucacuccuuuucuaacuugaugucaccauauuguaugcgaaggacguagguauguacgugcauucacaaggcauguguaauuuugcaguugcuacucaguuaaaaauaagguuuguuaacacuugcaguaguuuuuccccauuuacugugguaguuauuaacacuuuguccacucauaauagcagcuuagcuuggucggggggcagaaagaggauugagguacuuguuuuuacagcuguguaaaggaggucucagaaaaucguaagcccugccugauguagucaucuuggguuuagcuuuuuggugguugggguuauccauaucuguuaguuuuauagugcaagaauacuuucaaggcugcugaguugguguguuguauuaaucucuggguauuaugguucaaaagguuucuugcccuucuaguuacuuuuacaaaggccagauguuaucaugccaaggaaguauggauccuccugggacacaaggaguugcuagguuucaauccuggccauuacucuagaaggccuguaaccgaacccagguucagcugcuugccacuugaaagccagaacacaagaggcaaggauugguggaaggaaaagcauuuuuaaugggagccagcaaacugagaagauggcaaacuaguauucuaaaguaccaucuucaauuuaaaaauuuaccguagggcuuucaaagggagaaagguaugggagacgugcagaaguggugcaggaucugugugucuuguucaguggcucucucaggugucugaaggucuaauuggcauuaucuugacuuuggcucaguggugguggacuaauuaugacuccuccuaaucaugaggauuuugcaguggggacucuguuccugguuuguuucaagauuagccugugggauuucuuaagagccuaaguagauaagcauggauugccuaagggggagugucuagagagggaaggaauaaagaguugagaggggagggaagaaggaaaaagaaugugggugauuucuaacacugaggucccuaguuacagucuuacaucugcaucugcucagugauuauaccaggccacuaaggugacugucccugggucccucgugugccuccuuccucauugugccucagugcuuggugcauccugcaguuugucugcuguaaaccuucacaugggccagucuugcuuccaggauggggggucgguuugcuuaccucuacauagaugccuuacguucagcguaguaugcuuuuggcuugucucuuuuauacuucuuuacaaauuuguucuucuccauguuccuauuaccuuaauuuguuugucaggaaacaccugaauuucaucuucucuguuuugacacacuaaagaguucucuuuuucaagcugguccugguuaagccugaaaccccugcgaugcacuuuauguauuucauguucauuaggugccugccucucucccuuguuuacuguguugggcuuaaaauuuuugagcaucuuagagggcagagaccaugugguauugaucccaucuuuuuuccaccgcuaugaaaucaugcuaugcguaugaaagcauuuuaaugcaaucugcugaggagagaaaugucuugugugggagaccguuuuggcaguagcaaacauguuuggcuuuagccauaagaacugcuuucugaguuuggaaaaggaguauguaaaucaaggcccauuuuaaauggaucuuuuuauaaugcagauaccucucaucuaucuguuuuguaaugauggauuuguuuugggggcuuaagugguuugugcaccugcaggauguccuuccuuuucuuucaggucauuuuuuuuuucuuucacagauagucucuuggauggauuaagaaagaauugaaguuccagucaauuuauuucaugacaaagaacaagaaaaaaauacagauguauuuggagauuauaaauauucugauuggaaaguuguaaacuuuggauguacaggauucugccacaaaguaauuuccacacauggccaaaggcaacaaaguguacacuuuugaaagacugaguuuggaaagguugauuguaguguggaaacccagcugcuccuuugagcuagcugugugugcccuugagcaaguuaacuuagcaucuuugaaccuccaacuuuauguccguaaaauggauacagauguauuuacauguagccuuguggugagaauuaaaugugauauauguaauguaaggauccuaguugcuugauaguuuaguuuggcagugguacuguugacugccagacagguagacauagcauuuauggggcagugggaaugggcauuuuuccccgacaaacuuacugacuuuuucauacuggaagguuugggcuggugaaccuuuaacuuuugggugagagagugauuuuuuuaagaaaaauguguucaagaagaaaauuuaucucuaacgagaauuuuuguuucacauggacuuggugaguuuguuagagucuaauuuuauaguuucccguucuugacaaaauggggagcucuccauggugguuugcagggacucugacauaguuucaaaacagggccuuuaaauuuuuuguuucuugugguaucugaguuaaaaaaugaucuuguacagagagaaaaacacauuaagaagcuguacugccucuugauggacugcuuaguggggggggugugugcgugugugugugcaggcacaggcaagagugcauguuugugaagauugacaccagcuggucgcacaagcaacagcagaugcccuuuuuacuaccacaguuaacuuguuuuccucuaccacaauacuauuuugaggaauacaguuccuuugccuucaucccaaaugguauauacuugaacaacuccauugucuuuuaaguaaacacaagauaaagcagauaauauaagacuguuaguguguguggggguggggguaggggcgguggcggaucuguguagaauuaauuauaauuaacaaagaaaugagaaaguugcagcauacccaaacuuuuaauugaaaguagauuggacuagccuagaguuguuaauguccuaaccuuuuuugaacugucagguaugacuuucaggcuaucugaagguauuuuggcauuugcucuauccugguggcagcuccaguguuugaagguagaacugcugaccuaucuuuuagagaaacuaccuauaucaauaagugaugagaaccgccuuuuguuuucauuguggugcugagcgugcuacacuaucucagucacuuucuuucaggcuggagaaccugcuuucagguagagucucauccuguggguuguagaggaauugguuuauuuuccuacugcacauaauuuuuccucaucuuccuggucuuggaugcaagauaucuuuguguacccgguguaauacuuggcaagaauuuagaggauuuaauaugcuguuucuguucucaauagucuaagacugaauugugugggaguucuuaauguugucugaaaaugugauauauuaagaacccacaguaucgccaacuuaagcagggucaugccgcauugccagcagauucauaauuacugggacuggaacuacaggaaaauagagcucuaccaguugcauaaucaggggacagauauggcuauuaaaauuaacuugaagggaaaaugcccuggugcugaggacauuaaccgcucucucuagaauuaggcugcuuagguaauauuuaccaaaugaucacuauuugcagcuuugauuucagcagaaaaguuaugauuuaaacucuucuauauuagcuccauguaucuguaaaguccugaaaaucauuuagaaacuuuggggccuuucagucucaggccagcuuuauuagcauuuggguggaagaugagucuucgagugagccaucuguuuucuguauuaugugagugucuagguugaauucuccauccuugugauaaucccugguaauguccuuugggaagcugguagaaaugcucccagcuuucaggaaggcuggcuuggacuguaguaauaggaucucaccaguccuccaucucacaauuugaucuuacucauuagagggcagcaaggaagaccuguuuaacuugacccaccuuaacuugaguguuuaaauggaaggaccugcugcaucuggcaugcuacauuugaggagacucaggcuaagucaggaauuaaaauguggagaaaaacgugacuagagagaacugcaucccucuguucugagauucucucaaaccuuuucccugcugugugguacccacaugguuuugcuguguaucagaucugagauauuaagaaagcuccuuugugaagucuggugcgaguugcuuuggugccagaguugcagugcacagccugucugaacagacacacauaaugagugcccaagaacaguaaguccaucugaagaaauacaauauauuugcaacuuuauuguguguuugagggaggagagagaaggauaucaggaggcaacagggucuuuauuaaaaacaaaaauuuucccccuuuguaacgaaaacuuguuuuugcaaaucaaauuauuugcuuuuuuuugucguuaaggcaugcaguuuuaugcaagagcuguguuuggaggaagcgaaucuuuccauuuugcuuuuuaaaaguauugcauuauuaaaccucagguugcaagucuuccuugacagagaggaccauagugaccuguuucugcuaacugugggauuugaaaaagauucacacggcuuuuauucuuuuauuucauaaaacauuacuacugcuguaaauggaauaauagauacacaucaaucaguguagucaccuuuuauuguugauucaacuaccagguuuuuacagaauucacucugcauuuuauuugacuuguacaugaauagucucagcagacuuaauuauauuagugaaaaaguacuuucaacaaaauuauaugcugacaucccauaauucauacuuaccgauuuguggaacagauuuauguaaaucuaucaaauuacucuagaugacacuuuuuaaaauugagacuucaucuuaaugguauuuguagaaauuuuucguaugaacaauuuuacaugaacuauuuaaaacucguaugacuuccuuaugaaggcagaauuacuauaacauuugagcaucuugucuccacaaguucuguaauccaucugguacaauguagggacaugaggaacauguuuauaagggcaacuaucuccuaaaccacaggcuccuggaaggcagaugcugcugcuccuucauuuguuuuucauucagucauucacagaacauuuaaugaucugucuuaggguccuccuugucaggaacuauguucugcuugcccuugcucagcagucuagugagggagcauccaaauggaccccagacacacauaacaaagauaacggaauaauauaagaagcugugggaggacuagucgagaggagcacuguacagugugcacuggggauggggcaaguuguggcaggaaaugacuucagagagucucaaaggauacaugggaguuggcuaguuggagagcuguguuccagacauagagaacugaaugugcauuuuaggguguauguguaggagugguggaagaugagcgaaaguagaagugagcaaaaaacugacagugacuggaaaccagaguaugguuagauuuguguuuuaagaaguucuccuggacaauguuuugguggaggauggcuguuuuuggaauuaaugggagucuaagcaaggguuguccuauuaggauaguguagcagugaucagggccagaauaauagagaaccaaugcuaacgcagacaaggggccgauuuagcugguaggacuggcagaacgugaugcggguguggcagaacuugggcuggaacgucuugcacaucuucacuguuagacuugagcuaguuccuucaagccuuggaucaaauguuaccugcaggauagggccugcucugaccauuguauuuaaacagcagcccugcuccuccccuccccacucucacccccugcugcuuuuuucuccuuagcucuauuuucuucuaauacccuguagaauguguuccugucagaauauaggcuuuaugagaaagaucuuuuucuccuuugcauucucagggccuagcaaaaaguaugguucccauaguuauugaaugcuuauuguagaugagaaauuuguagggugacucuuguuuuuuuuaaauacaaaauuuuauuuuccacaauuuuguguugagggucuuguuuaauauugguuggauaaaguuaauauacuuuuaaucaagaauuacgguagucuauugccuuuaccuuuaaaccugaggggguaauuugauuuuucugaacauugguaguaauuuaaaauagaaaagacuaaauaaagugaccuuugaaugaaacagguccagaagauuguguauuuuuaauuaaaauaugcaauuaaaauuuuaauuaaaguaggguauuaaaacaauguagguggcaggggaauagcugaugcuuugaauuacacacaguuugggauauauugccauuuacuguguuucccacaguagcacuuugccacuaaacggguuuucuuccuguuuuccucuccuugcucugaacccugcucucaguagucuuugguccucuucagaggccucuggagugcuucagcucugugguauagaucccuugaccaugauuucuaccagccuguuuauaacuguucuccuugugccaggagcaucuuauaaacuauuuuucuaucucuugugaagaaggguuucuuuucuguggcauguauguuagauuaaaaagaagcgugugaaacaaaaggcauucauacacaacagugcagcacagaauauagcaaaaguucuagaaucccuaccaaggccauuaaaaucaagacuuugggccagguacgguggcucacgccuguaaucccagcacauugggaggccgagguuggcagaucaguugaagccaggaguucgagacgagccuggccaacguggcgaaacccugucucuacuaaaaauacaaaaaaauagcuggguguggugaugcaugccuguaaucccagcuacuugggaggccgaggcagaagaaucgcuugaacccaggagguggaaguugcagugauccgagaucaugcccacugccauccagucuggaugacagagagagagaccuugccucaaaagaagaaagauuugaauuaaugguuugaaaauucuuagaacacuugaccacagguagcuucugagaauagcugaggacacguggcauugagccucuucuuuauguucaguuaccaggcaaauuuuuuggcauuuaaagacaggauuuguuuuucuuaagggcuuuuuuuuuuuuuuuuuuuuuugaagagccuuagcuuugucauuuuggucagaauagucuuuuaaucauguugguuuccauaaugguuguacuuggaauuuaaauguagcaucuuauaaaacuuuuuaaagaaaugaaucuuaguuuggggauuaucaguaugcacauucuaaauucagagagacuugaaaaauagguuuggaugauauggauaagugaugcuugguuuccaagccuucccugguggcccaugacuuacugaugaauauaagagugggaaaaggguagguaagguauuuuuuuuuguaauguuugccuugcuacugcuuuuauuuuuaaaaacugugcgcucauuuauaaccagaaauaugcacuauauaaauaagaugcaauuuauguugucauaggaaugaauaauggcacugaaauucauauauaguaaaacugauauuuguauaaaagguacagaaguuugagauaguaaucaaacaagaaacaacuuuugcgguaaaagugucagaagugccugguuacguuauuauucaggcauauuggguacaaacuaguccugggcuuauacgcaauaugccugaagucucaguucagguauaaacuaguuaauugaguggaguagagcacagcauuugaaaguccugacuucaaguccugacuuuacuacuuccucccugccuuuuugauuuguagaagcugauugaccuugccaagcuucagauaucauuucuaccuuguaggagaagaaucugaauaccgaacaugguuaaugugaagcuacaauuaaacaguaaaauaccauguagcuaaaaggugagaauggggaggcuugccuaucuugguaucaucugcgauacccuuaauauauuuuaaacauccaauaaauauuugcugccuugauuacagauuuucacuguaaaguaauuuaaaguucuaacucccuuuuguuauagugccaacauuuuaauacaccaacgaugguagguuuaggaaugcagucuuuuaauagcagauacccccuuucauauuauuuugcuuaggauaauaauacaguuuugcuuaccucaaacauauucugaguggcacucauccuaauaaugccacuaggcaaauaagaaacuuuuuauaaggaggcaaagucauuuggggauaaauauuucugaguauaaacaacuuaacagauacuagauauuugacugacucauauagcuagucaugauugcuugaggguaucagguggaagacccauuugaugguugggucuucugaugguggugguggugaugaugauaauaccuuugguuaaauaaauaacaucaguaaguuucucauucuuucauuuagcaaauguuuccaugccuacagcaggccaggaguaaggguucagaggcuagagugggaaacagcuaaguaggaaguaagcaagacaggcuuuucacuuuacccagugaucuaaucucaguaggcacucuugugccccagacagaccucaggaggccaauaaacuguuucuuugaaguaauagguaacuugaagauuuuagaagaaacacauccacguguaccuaaacaacgcaacugugaaacagcagucaucccugcaagaccuuucuuagaccucccagcagccccguuguagccccagcuagguucucaccauuaaggcagugauuucucaacauggugguuguacguuagucaccaggauuuuaaaaagcuaguaccaaugcuucaugacagacugauaaaaucagagcccaaggugggaggaucgcuugaguccaggaguucaagcauggcccagccaauguagugagaucucaucucauauacacauauauauacagacacaaacacacauauauguauauauaucuaucuauuuuugggagugggauucggggaucagguuuuuuuguuuuaguuuuuuuuuuuuuuuuuuuuaagcuuucuagaugauuccauugcagucaaguuugagaaugcacugggguuagaagcugcuaagaugcaggaggaggaguaucuaucaguagaaagggcaauuagacuaugcugauacaauugauuuauuuugucauagaauagcaguaugacaaaacuauauuuguauugcccuuuucuuuuucuguuauauuuguggcaucuuuuuuauuuaacuuuaaaugaauauacuuaaaaucuuuaacaguaagcauguuauuuuuucucauguuaucuuuugacuagggugacgauccacuuucaucauuaaugaauauuuucaucauugcaucagcaaccuaguuggguaggaauuacccucguuuuagagagaaggaagcugugguucagagagguguuaaguagcuucuucaaaguugcacagcuaacugcgagccaguaaacaccagagccgguauuggaagucugucuuuccacuauaagcugguuccuugagcagauuuuguuacauucagccaauuuaauucuacucaaugacaauaggacugcaacacauuuucauaagaggggcacaaugcaugcaguaaacacaugauaaauuuugaauuaaugaaaagcugaaugcuuaaaaauacaguggcuucacaugugacucuuuacuagaacuguaaaauaaaaccucaauuuuagugugagaugaaauuaaccuaauuaguuuuuagcucucuauuccuuucucuuuuuuaaaaaggaaaaaauacauuuugauagaggacauauauuagcagugauuauccaaaauucugauuguggucccaaaauauaaucacuaguuuucauauugggcacuguauuuagccuucucuuuucguuuaugugguaacaaguauccacauuaggauaaccagaguagcuguccuaaaaacccacauugauaaccacuugcaccuacggugccccaucaagaaaaaauaccucacuucccuaugaaauugaugcaacaguaguacuuaguaaaagcauuuggaccguccuugggcaucugggaaaucgucauuuaguuuguuuugacuuuuguagacuaaacuuuucuuaugccauuuuugucaccuguauaauguuucuugccauuucaaacugagaaacuugcuucauugaaaaguugagaccauugcgauugacuuuaguuaucuuugcauuccauugaugcaacugcuuuugauagcucccauugucugagaucuagggcaucagugaaccaggagugagagggcucagaugauggggggaggguggcaacaacaacaaacacuuagaagcaacuuuuacucuagacuuuuuuucuccuguuauuuuuguuuauguucuauuucuucuuuuccuauauguucucauugucuucgaugucaucccuguaagucuuuuguguucauauuuuccuguucuuaucuagaucauaaaacccucuuuggagaaauuugauugaguguauuugaagauaagcccucgucuaaaauaaacuuacauguauacacgcccacacaugguucuucaccauuuuagacuccgacauuauuguacuugguaaaggcuguaaauaugucaggguacaauuuacugaacacugacagauucuugguugauguuuucugucuucccauuuuuauggcuaaggaaacugaagcugaaaagguauugccuguuaagcccucuccauagcacagagauuuauccccacaguuuaugaagcugaccuugucuugcugaugguauacucuggcucaggcagggcauggaugguggaauccuuuggggauguguguuuuuuuuuuccuaaacagcacugcuugcugaguucuaaaacuugaaaauguaguagacaggagacauaaagacuucauguauauuucuagaauuaauagagaguucuuuuuacuguugaggaaauaugcugguguuaaugacaagaccauaugccaaaaugaaaguugaucucugucaacaguauagaacuaauauaugccuuuuuccccuuccuuuucauuagggcagagcuugggauauggcuuugugaacuacauugaccccaaggaugcagagaaagcuaucaacacccugaauggauugagacuucaaaccaaaacaauaaaaguauguuuaaaguuuuuuuauaucuacuugcggaacagaaguuuaaaaaaauuaagauuuauuuguaguucuuuccuuucuuccuuuugggcccauauaaacaguuaccugggagacauaguggaauuuugguguuuguugcaagauggaagaaacuguuuguucaagagugcuauguauaaucauucauguauucgcaaagggggacagagcaacaacucucuuagauaaauguuauaggaagccuacggaaucaagucuccuucccuuauagagaauuacuugcccuauaacuugaggaaaccuuagacuuguucuucuauaaaggucuggguagugaauaagcaagguuuugcgagccaugcauucugucacaacuucucaacucugccuuuauaguaugaaagcaguaauagccacuacauaaacaaauggaugcagccguuauccaauaaaacuuuauuuaugggcaaugaaacuugagauugauaagauguuuauguauuacaaauauucuuuuuauuuuuuccaaguuaaaaaauguaaaaaccauucuuagcucauggguuauacaaaaagguggcaggcuagauguggugcuugaguuguaguuugcucuagcuaauucagcuugcuuugaggagacugacuggaggaacuuacaugacacagguuauuuuuucuguuguuuuucuuuuuaagacguacaguaaauaacuuuguacauacuuugcugcuuuugugaaucuuugaaauucuuauguagauucucucuugagagggagcuaaucuaauucacagcauagauuucuuuuccuuuagaaaauaagagggaugucgccucuagcaaauucuuaguuagcuguaccaucaauuugcccucuccugcccagugcagacauugccagucaaucauggcacucuuucucacagagucuagauguggcucccaaauauuuuuuucaaaauaguguuccagacaacuucuaucaauugacucaaguuugaaccuauuuuccacccuugauuuaagaaaccagcucagacuauagccugaaguggugaggggaaguuagucaaggcugacuguaguauccaucuugcuuagagacuuguguaaaagauuuuugcucauuuuuuucagguaucuggaaaugaagugucauuuuugugcuuuaaaguugcuuuucuuagaauuaccaguuaagguaauuuauuagcccugagugguuuugacacaucagucuuuauauuuauuggccccuaagaaaaaugccuaccagcccugucuuaucuaaaugaaaguauauagugguucccaaauauacuaggguaugagagguccaagaauucuagauacuucuugagcaagaaacuguucuaugaaaagauucaccaaucagaaaaugaacugguuacuguauauuaucaaaaugugaagggaaaaaugagauuuccaauaaaguguaagacaaguuuguuuugaaguuuuuucagucugaacugcuuuuucucguuaucuauauuucucugcauacuuucugugucagagaucuuuuacuaguacuauuaaguaacaauaaguguucuuuaaaaagacauccaguguucaguuaccgucagaccgugugcucuuuauccuacagcagauuuuugcagguuucuuuuccucaauuuauauugauuuccagcguugcugcuaauuuguccuaguucugagguccugaguuguaguugggaagaaaauggaauagguggucaagauggcuugucccaggaacuauccuuuucuccauucuagaaauaauuacccuuauuucauucuagugugucaguucuuuuacuaaauauccuccugcacgaagauccagaagaagguagaaaugcaggggaaauaggucuccacaggagaaaugcccguggccuucaaggagacaguugaugacagcugcuuccuuacuguucaucauccagccuuuucucuuuagggcccagcugcuugggcugaauauguggaagaaagcacaguaaagcuuuguggcuuuuauagugugacaucaguuucugauuuucugagaugugggucaggguaaugggcaaauagcaggcuacuucuuuccccgccccuauuugguuccuguaaaaauaucagauaacagcuggcauccucaauuuggcccacauuugucuaagaggcaaagcagaccauuucccacaaguauauagcacccccuuugccuguuuguucuuucuauguuuauuuauuuccauuagacagauuuugugcucuuguacaaugucuugagccaaguuuuucuaguauucacagcuuuaagaauguuuuggaaguugaguuaagccuuuucauuuccugggauacuauuccauaaauaagucuuuuucccucgucuaaucuauacuggugauggcugucagcaccacuuucuuacacagcaccacuuuacucguguuacugcucacucaaaacucuaugguguuucucuacuguuuuacccuaucaucuggcugaguuuuguaggagugaugccagugcuauugccguucuccacuguucucagacuggcucuuuacuuguaagcugaucuuacucccagcguccaugcauaugcuuuugcagcuccgacuuuuugguauacccuuucacacucauuuuuaguuuaacuguggucaucucaucuuuuggagcccaucuaaaggaauucuguccuucagcuucugucuuuccagguuguuccagcuccugcugaguucccccuucuuugaagucuauauucuuuacccuugaggaaccacagaaguuuuggaauuacagggggacccauauguaauuuaggcuuaagcacuguucucuguccacagucagaguggagaucuugguggucauacaauuuagccaagaccaggcaguugaagaaagagcugcgacucaaacaaauccuugucuucugaucguuauaucaaaacucuugccaggacacugugcuuuacuuuagaaagguacagaagauugguuaguauauacaaguguuuguguacuccaagccacuuagaauuuaguaugcguuugguaaaauuccugguuauugggauauugaaacagugaaucaagugcugugaaaggugguuuauuuagcaguuucuccuggggcucccuaauagcauuagcucaguaggguuuugugcaguaguugguguguugaauaaaugacagauguucaguauuuccauggugagugaagugaagucccucaggcucugugaggaccuaaagcauuuguucccaaacuuugguugcaucuuaaucccaagggaagugaguuagaaauacaguuucugggauccacuguagaucuacucgaucccuguccacaggugagauuccggguucuguuuuuuauuaugcuucccagguaauuuaugacagcaagucuaaggccuagcacuugggaaucaccaaagauguuuggcgguucucuauacauuugguauuugugugugcaaaguucaguuugucuucuagcauuuuaccuuaauaauccuccugugguucauucuguuaaccaaaauauuaauguuuuuucuugagcaugcugggcgaucguuuagcauucagaguucaacgugguucaccagccuuugcuuauaaaaaaacauggcauagaaauugaaaacaacguauccgucucauaguaggaugcuguuuguuuaaguaguagcagauacagguuaaagucucgagauacuuguucucuuguccuaaaggucacuuuuuuuccugguuaaggagaugucccagaggcauaccuugcuggugaaaugacaucaucccuguacugcaugggaggcagcuauuuuggguuaagccugcccacaguauccccaguguugacaugguaaauaaagugugaauauuacaaaaauguuuuaagauucucauuagggaagguagugaaaaggugauauguguacaguucaggcaugggggugggggaguaaucucauggaagugucaaguuguaugcuggugagaagaagagagguuuuucuccaagauccuucaggucccuaaaggaauccuuccuuuggugaguuauucaugaagugagugguuguaccuacuguguucagucuucaugcucuuucucuacucauuuuauuuuuaggggucuuaaguauugaaaaaaaucuaaauaguauguggaauuuuuauggcuuaaagccaauacuuuugacuuguuagguuaacggugucagacuuaaauucaugauuagcaaacuaaaaucauucauuuccaagaauauguguagacuuccucccuccucugcauaaagaacucuggauaggugauuaucacauaacacagugaaauggauacguggcucccagcaucucucucagcuuuucccuccucuacaaugggccuaggaugcuuuauuuuuccugaaacugggguugauuuaucuggaaagaaggagcuguuaucucagggaauagaauguuuuauuguuauugguaaguucugaccccucaaaagaaaaaaaaauucugucuagaauuaacuaccauagaaaaacugcccgauuuuggucuugauuaaagaaauauuuuccuuaaucauucagcuauagaccaggcuaaaauuuaccuuugcuuaaaaguuauuaauugguauacaaucaugaaauuucuuauacugaaauaaaccacaauuuaaccacauuuggaaaauucuauuauaaaaaugagaauauuauaaauaguauuaucuauuuuuuguguucaguuugagagugauuaagcaaaccuaagaaaccuguauucuaagcuacuguauugccauuaacuuuuuguuaaauuuauaccuuuuucuaacuagcuuauccuuuccucauuaguaaaugucauauuuauacuuuuuuuuuucuguucagcaugagcuugacccuuaacauaggaauauagaacuacauuucugaaaucuuacucugucuaaauuaccuuacuaaaaugauuuaacuggcugcuuaaucuuggacagagcuuuuaaccauuuaaguuuccauuuauaucguuaaaauaauuuauucaucacugagaauuuucauuaccugcuuuuuaggagaggaaaaaaagcuuuucauggucugcuaaguugcauauuaagaagaaauguuaacuuuuuaaacaaauucauguuuauugcauaaaaugauuugaugaaaagcagcaaccucuccugaagagagaauaauuuuaauugccuucuucuuucacucuugaaaguuuaauagccacuguaaacuuuauauggggauuugaguuucuaguucaaccuccuuuugcgacaggauuauugggauuggguugguuuuucuuuaucauuauaauuuguucuuuuauaaaaguuaauacuggccagaaggaaauauucuuagaugcuguguaaaccagcccccacuguaaagaaggaggagaggguaugcaggcaggaauguaaguaaagcuacgcuaagggcuugccacccaguagguccucuguuaaaauaccugcagcacaguucuguguuugagacgaguggcucuaauagccauaaugcugggaguucaugacuuuaguagggcauggaaguuuuaaagcaguugauaggggaaccauauagaauuugcccaaaaagaaagcaggaugggaggcgagugugggaaaugagccugaguuaugcguuauagaaguguguucugggugcgcauguaugugaaggcgcugauguuuuguucucuaggugaggaaggggcaccggaggguuuugagcagaguaguguugggauugaccuugaguauuuauucggagaggaagguuuguuuuguauuuaaacgccacaucuuucucagcauuucaacccacccuaguguuuuucuggcuuguguaguuuguuauuuccugugaugguacaaaggguagaaauuuauaaaucaucgucuacaaaguaccccucauuuaaaaaccuuuaccuugagcagauuuggaaaauuuagaaguaauaguuggaagaacaggccucaaauuaacugaccuacuuaugagauguuagccuaauaacuguuauuuauccagacaaaaaaaaaauugaaaaaguauaugccaggagugggguaaaaauugaaacguugaguaaauuguuccucugccuuuuaaaaaauacagacugaccgaguacauguuuuccuaacuucauuguuaacuuguauucuggaaauuuccacagccacaugucaaguuuuaacaguauauuacaucugauuaucagcaccucuucaauacauuuaaauaaaaugcuucuaucuauauugagucccauuuacauaguccuuauuugaagugagaagucacagaugacuuuuuuauuguuauuuguauaaugcccuucauguguuuuguagaaugcucucuugucagcuuuaauuuuuuucauacaaaaagcccagaaauuucuuacucaucuaauguggucuagggaauguggguagguagcccaaguaagguccagagcuugaauguccuguccucaggccucuuguguuacuucuguuccuuuuagccaacuccaaagugagaguuaauuggaauucucaaagggcaauaacuaggcauucuuccaauggauuuccuuuagauuuucccacaguuguuggagcagaggcagagccuacaaagagggaaggaugaggaacaggguucuugguggcaguguccccugcuuacuuccugccugucagccacacaguggauagugaugguagaagagucucaacaguugacugaacccaucuuuauuggaauugauggaucauuuuguuaccuaagcaugcuccacagggguaucauagccccucauggcagaugcuuaaacuuaugcaaaguauggucuauaccagaaaagccuggcuauuucauuucuguaaccagcauggagaaugucagguuuuaugaagaccuccauuggaauuaaaagaguaacugccuccuugugaguauugcuucuguguaagguagggggaaagccacagaaguaauaacuuguauagguuuaggaaauuguugcugucugugugugugugcacguguggaauugaaaggggcaugugguggggaugucacugaaacuuacuguuuaucagaaauuugagucauugaggcagaacccuuauaacagcucacaggucuagaauguuaagugcaaaauugguuuccgaauaauaaggaggcugaggaagagauucaagcaaaccaugugcaucaugauagaagacacugaaaauaguugaaccacauguucaaauguguuugaguuugauuucuaagauaacagugagauaagauaaauugaaacugaucuggauggccaaaaaucuuuucuuuuuuuuuuuuaaauuauuauuaugcuuuaaguuuuaggguacaugugcacaaugugcaggucaguuacauauguauacaugugccaugcuggugugcugcacccauuaacuggucauucagcauuagguauaucuccuaaugcuaucccucccccguccccacaacaguccccaggguguguuguuccccuuccuguguccguguguucucauuguucaguucccaccuaugagugagaacaugcgguguuugguuuuuuguccuugugauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauaccagaaucuacaaugaacucaaacaaauuuacaagaagaaaacaaaaaucuuuucuaccugaacaucacacugcuagcccuuguugcuuuacuuucccacugcuuuuuaaggggaaugugggguagggcuuuucuuucauuuaucaccugggaaaaguggugcuaggucaguuuggcuucagucuguucuaccacauaccuggcuugugaaguuaagaugauuguguuaacuucccaagaaggagcccuuaauucuuugcuguaucuacuuuugaaacaaauuucauaggacuauuaucuuuuuacuguuuugaauucgugcagaaacagcaguagucucugguaggcaaauacuuaaucccuuugaugaaauaaagcucagguuaaaagggauuuguucaaaaugaaauagcuaauaagcaucagaaauguaguaucauguuggcugaugccguagcuuuuguuguuuucuuuccauuucacauuauugauguuaaacuguuuugcucagauaccacucuaaauaaaccaacugagagaggccuuaauuugggccuuugagugucuuugucuugagacuuucuggaccagaucucuuaggugccagagaguggagcugucuuugccuaggagugaagaacucugcccucuugcagagugagcacuugagacagccagacguacaguuugagaagaaaacuggaucuggaggucauacuuagcagauaagugaguuaacauugauucaguuauuucaguuguaaugaacaguaaaauuauuauuauaguaguaacuuccugaaauuauuuuuuaggcagcuacgcauucuucgacaauguuuuucugguagguucauguaagucguagaugcuaguuuaaagguuacagaaauguguguuaacauuggucucucuuuaaauuugcguagacucuuuaaaaaagcauggauggugcauuuucuuuuauuuucacuucugccagccauuccuaucauuacuuuuaguguguguucucacccgcauguacuacauuagaauuacuuguggauguuuuauuuccagaagugucuugacaugcugcuuuugggcaaugagacagagcuguacaguugacacuugaacaauucgggggcuauggguagcagcccccauauagcaaaaagucuaacuuuugacuccucaaaaaccuaacuacuaguagccuacuguugacuagaagccuuacugauaacauaaacaguuaucacauauuuuguauguuucauguauuacauauuauguguuauuacaauauaaaguaagcuagagaaaagaaaagguuaagagaaucauaagguagacaaaauauauuuacuguucauuaaguggaaguggaucaucauaaggauccuucccccuugucauguuuauguugaguaggcagaggaagagggagggguuggucuaaaaucccauauuaagugcacccacacaguucaaacccauauuguuccagggucaucuguauuuugaaaacaguacaggaaaucugauacuugccugccuccucucccuuccuucugugaagaacucuuuugaaugcugcaauaggacuuggagguguaagucuuggauuuguguucuguucuugguuucuugaucaggugagcugcaggaagggcaaggaaaaauagaacaagcauguaguccuggaaacuaauaauucagaaaaaguuucaguuucuaguuuugguuguuaaaugucuaucuagaaauuugugcuugccuuaaccaaauaaccauauucauauuccuagaaagagucauugagagaagcuccuaacuucauagaaucaagcacaguggccuuuuugaagaggcuaacccaguugagccacauccagccagucuggguucuuggaaauaucuuuggaugaguuucaugggcuuuauuuuacgucugcauuuuugcauuugcaggugauuuauauuccuaaaugcuuugcuuucaagcuaccuggcauuugucuuauuuagaaacuaacgaucaguggauggcaaggaaaagggcuuggcauccgugguuguuaugagcuaucuaggaaacccuaauaugcccagaguuuugaggauuauuucaaaugccuuuacacaagagacugccaacacuuuaauguuuaucaggaucagugggguggggugguugauuaaaaaugcagauuucuacaccccaaccaggacuuacugaaucugauuaucugcagagagagacugaggaaauuguauuucaacagccaccacaggugauucuuaagcagaugguggccugaccugagaaacacuguucaguggaucuuaaugauuugcacuuggguaggucuguggugcuuauuuuaaaacaagucuacuuguaaaaaauaggauuuucauuugucgguuacaucaagauauguugaauggcugggauucacuaauguguuuuuaaugaauauagugcuggauuuaccuaagaaauaaugcacguucucacacacaauuugcucauuuucagggcauuugugugucauuaaauacuucaacauuacaauuaugcuagcauaauuuauuugcuucugaggguauuuggagaauuuucaguaugguucuuuagggccuauccauuuaaaaugggugucuuggccaggcacagugguucauaccuguaaucccagcacuuugggaggcugaggugggcagucagaaguucaggaucagcuuggccgccaacaugacgaaaccccaucucuacuaaaaaguacaaaaauuagccgaacaugguggcgggugccugugaucccagcuacuccggaggcugaggcagggagaauuacuugaacuugggaggcggagguugcugugagccgagauuacaccacugcacccuagccuggguggauagagggagauucugucucaaaaaaaaaaggugaaagggugucuuauagagauugggaguuaaguuuugaaaguggcuuuugagccaggcgcgguggcucacgccuguaaucccagcacuuugggaggcugaggcggguggaucaccugagguccggaguuugagaucagcguggacaauguagugaaaccacgucucuacuuaaaauacaaaaaauuagcuggguuugguagcaggugccuguaaacccagcuacuggggaggcugaggcaggagaaucccuugaacccgggaggcggaaguugcaguaagcugagaucacaccauuauacuccaaccugagcaacaagagcaaaacucccaucucaaaaaaaaaaaaaaaaaaguggcuuuuaaaauuuaauaaaaauuugucuuauuuuuauagccugccaaccaaaccccucuuccuucccuacccagugucuugauauuugagcuuucuagccagggccucaauaaaugggaauuugcucuauuauaagagcuuccacacauuuuaugcuauaauuuuuuaaaggaaaaaauuuuuugcuauaugcaaacuuaauuuagaaacccuuuugaccuguaaaccaaauguugccccaaagcuaugugaaagcagugcauacucuugccaaaaggcuuacaguguuuucccccugcucagaguugcaaaaaugaauuaauaagaaaccaaggauuuuucuucauguucuucauuaagcaaugucugaggggaauuguaaaauaugcauugucuacaguauauguauauccuggugcacaaagucagaugaacugugaaggugagggguaaaaacaccccucucaccuuuguacuuuguucuuuggaguauuaaagaacauuuaucugccaaguggcaaaggggauacuauuuggcgguuuaauuacagccagugaguguuauugaugcuaucagucagcaagacccagggaaagggccugguaccaaaucauucaguguaauuaaauaucucaggacgggauucucaaggugcuucuggagaucugaagcaggagaacacuuugucuuagaacaaagauaaaggugguaguuccccuccucgcugccccucuuuaaauuucugcagguguugcauagauggcaaugauauggucucuuuauugcguacagugaagguuguccauguuuuccuuaaaaacucuuucuuuuaaaaucuucacaacugucacacaaaggguuuugggaauacaguaauuauuuuuuguuaaagcuguuagggggaauauacagcucaggugucuaauagauacuuggagaaugaaggauugucuuugaaugagacuauuagucuugcaaaucaguucauuuaaaaaaagcuuucccuaugguuauucucuaaugucuaaucauguugugagagaaauaucuugguagacuuaaagucauaaaacaacacucacuaauguuucagggguuauccccuuauguauugaauaaauuuuucauaguugcauaacuuaugucagccccacaaaauauguguagguaaaacuuccuuuggcucuguggggagggcuuuuaauaacauuucuguuauucuuuuuccuugcuuucuccuuuaucauacgugccuuacacaaauuuccaucucugccuguuaaaugccauaagcaaucugcaguguuugcuguuacugcuuuuuaaauuuuuaaaaaacugguacaguuucuacugauugaggauuaccaaagacaggcugcccuugaaagaaagugagcuggcuuccuaacuucuuuguguauguauaccuguauacauacauuagaucccugauaauugugucaaaucagggcccaaaacacuaaaucuuggauagcguaugguuuacuuguaauguagauagggcuugcagauuguguuuuaaauuuaaaacagguguuuaaauggggauuguugacauaaaacauccuuuaagaggaagauuauuuguuaggaauuuuucucuggguguuugaggaauccuauuuuuaaaauacguuaaagauuuaguagaaguaguuacuuuauguucaagacuucccaccccuuagggcuuuauuauauuauauggaaccauaacaagacuaauaggccugucuccaaguuuguaggaaaggucaguagcuuuaaaagaugugcauggugcucaccuugcccacaaaacaaagggccaggauaagcaaauguaaaaguuuuugagaaguauuuaauugcaaguuguuuuuuuguuuuacugagaccauguaaucuuggcuauacaguguuggacagggaguaucuguaauuaaauauuuuauaaacauuuugagugcuuaaugugggcuaguuagcuuugcuaaauguuugaacagcauuaaaauaagacaagagguagccuuguccuugaugucauuguguaguaagggagacagcacuuaguuuauaugaccauuauuuggauauaugaugaguaagugcagaauacaaugaaaauggauaugccacuugcugucuagaggccucuguguugauuucagaguugaugguguuuuacaagcuagguuuuauugggcggaaaaagaagaaauguauuacacauaagggaaugucucauucaaaagcacagaggccuucacgugauguguaccuuuuaggagaagcuuacaucugaacaccauaaaguauacuuauucuaucaaguaauaaccuucuacaaaaaugauuggcaggaaaauuugauuaaaccuagcccuguacuuuacauuuaucccccuuuagugaggaccuaauuuauaagagaaacaauaggaaugaauuuuggguggaucaaguaauuugcucguagaaacauauuugccuugcucugcaaagauccguggagacccaugggacucauuuaaguauuuacaaaugguaucaagaugaaguuucucuaagcaguauuuaguguacacacagaggaaaggaucauuauauuuucauuacuauaugaaguaggucaaagaagacuuggguuucugaacauuguugcaaagcaguuuuucuucuaguuauaguacaaagggaaacuuaacuguagauggcauuuacauuuaacuuuacuaccacacugauuuugacuguucuccucaccugcguuaugaugggaaacugucucuguauucuccuuccauacauuucugucugauaauacuuaccaacauuuagauugucauuccucugcucauaaaaguuuugcccugacauucaaggucucuagacucugcccucaacucacuguucuaguguugucaguguccuacagaaaucuuuauucuggcucagcugggcucuucaucauucaguauggaagccuaauucuccauugccuuggauuauucucugccuacauggcccucuaacccugucauugauaaaguuuuauuuggccauaaaauaaauuaauaaaguggauaaaaauuucuuaacuauacauuuccuuucucaucuauuugguggucugcucucugagggcaacgggauuuuugucuuuggagagcagcuugcagaauguuuuuauuuauaaccucugcaugaggaagcuucugucuauugcuuauaagagacagugaagaccugcucugugugcucaaagacgaaaaaagucacaguuuaagugaaauuaaaaguugagauucuuggagguuuuucguuuuguuuuguuuuuguuuuaaugccauuuuuaacuuuggguguguuuuucaaaacuuguugguaggugucacuauacauugaagauguggucggaugaaggauauguaaaggacuuaacagcuuuuuuguuucauacaaaaacaaaguuuuuuuauauauacauauuuuuaaaauuauacuuuaaguucuaggguacaugugcacaacgugcagguuuguuauauauguauacaugugccauguuggugugcugcacccauuaacucaucauuuacauuagguauaucuccuaaugcuaucccuccccccucccccaacccgacaacaggccccggugugugauguuccccacccuguguccaaguguucucauuguucacuucccaccuaugagugagaacauguggugaaaaacaaagauuuaaguaaagguaucccguuaugugagauuuucuacauaauguccaccuacccgucucuugucuuauccacuucuccuuuucauguacuucucucugucagaucauggaugaagaaguguaugaaaguccuaggauguuuaauucaccaaaauuggcuugaugagaaccuuuuuucuuuuuucacauuaccaaccgguacugguuguuuuuuauucuaagacaccugcaguuuauuuaugccagccaguguguaguccuucuuuaguuuaacauucuaacucagcauuuuaaucuguugacagugucuuaggcauacuagacauucagauacuacacaaauuauaucuuaaguacauuuuuggagauaaaguugccaugguuaucuugauaguauuggcaucuguucgagaugucauugggucaaguuucagaaucuugaaagaauacugaagccauugcuggagaaugggcuucuaacaauugaaugaauauaucugauuuucugcaagccaauuuagccugcguuguuuucagugaagcagcaaaagccaaguuauuugggcaaaugccacaacuucuaaucaucuugcuugagagguacuucagaacaaccuccuagcugggcgugguggcucacgccuguaaucccagcgcuuugggaggccgagacgggcggcucacgaggucaggagaucaagaccauucuggcuaacacugugaaaccccgucucuacaaaaauacaacaaaauuagccgggcgugguggcgggcgccuguguucccagcuacucgggaggcugaggcaggagaauggugugaacccgggagguggagcuugcagugagcugagaucgugccacugcacuccagagugagacucugccucaaaaaagaaaaaccuccugcacaaggccauggaauguauacguucaacagguaguagagucccuacuuggugggugggacuaugugagauaggcaucauauaagacuuaguuucaacccucccucuagaaguauaaaacauaguaauauaaaagcuuugaaugguaauacuguuaacuugggaggaagcuuugaggcagucuaguucucuggccguauuuaagaaggcucaaaauacugaguacugacuagugaguacugagauuuuucuuuuagucucucgaauguauucauaguauauuuaaugaaaaugucuaaagugaaaguuuuauagugguacuugagaguguagccucuucaguauuuuuuuuuuaacugggaaaucauauugaaucaucagguggccgauugcaugguagcuuguaacacauuucacaugcagaaacauacccauaaccuucaucucaagauagaaguuauuccaugaaguucauuuauauuucuacuacugucuauccaaaagaaucgcucauuuuacguuuuacuggcuuagguucaacaggucucuacaaaagagaauugagguagugagagguuuaauauguaacagcuugaugggagaaauaaaauuuuggggccuuaacuguuggcccauuuauagauguugaauguuugcucucuguaugucaguaagacagcuccuuccuuauguucccuccauccaggcugcaggcuucccagcacacucaucugcugucaucuuacaaaauauuuggaauauucaggaauuaacuuuaauaauuaucaccauggauuuggaagaagccucauuuauauaugugauuuuugaacuguuucuguguuagagugcauacauuguucuugugccacgucuccuccucugugucaucuuuccugaccucaaagauaauaguauuccuugaguuuuuguuccauaaauuggggaugaugaugcugcauaaacuuauugggaggagcaauugaauuaacauauguuacauauccagaacagugucuggcacaugguaaacaauaaguguuaggagcuaucauuaucugaauuguuuccuauguauguauauaaaaugauguuaugauuaaaacauuuaugguuccucugcucuuugcuaauaguuuuauuguugcauuuaauacuuguaagguuuccaugagguaaguacugugauuaacaucaaauuacaaauaaagagauagaagaccuaaggaaaugauuaacugguaaguaacagagccaagaccuggaccuagcucugugugacuccauaccauauguuuuuacuccuuaacaugggaggguucugguccaaacauuccauccuaaccucuaguuucauaguaugcuguguaguggccagaacuuuaccaguuacaguguauucucuucugcuuuguauaauauauuuuugaaccuggugcuaagcuaacacgugcuugccucaguugcagccuauucacauuacuuaguauuuauaaauauuauguggcuaaauaaaugcaggcucauuucugaaguuaaaaguaagggaguuagcauucuuaaccacuacugacaauuuucuaaugcagagagcuaccgguaggaauagacucuuuggugguuacgcuaaaacucccaucuauuuuuuauacuacuuuaguguaaucaccuucuaaagucugaaaaggcuaagugaaauauacaggauuggaaauggaacauggaacauuuugauugacaaguuccugcuuagacuuggaauggcuagccuacugccacuaccauagugaauuugauuucacugccuccaccucagaugccauauccacuaccauugcucaauuguuuuauuuucuguuaaguaucucugcagguaaaaaauuuaagaaaugguaagguauuuauggccuaaguugcauuucaagaauaucuuuaccauguaucccauuugccuuuaccaguaugagauguccuuguugaaccaacuucauacuagaaccaaggagaaacaacaauaaaagggcagaaguuauguaccaguuguacuuuacuaaaaacgagaugccugucagggcagccuauuuagacccucuuugauacacauggaugcaacuguuuggguagcauuuaauaaaccacacucagugcaguguaguuugucagaggcuguuuaagaugugugaaaaagguggucuaauuugugaagucuguaguugaugaucaguugcuugauauacaguucuuacagccaaaacacuuuuuauuuuucuguggcuauucaguagauuuauuauugucuuuaacaaugucauaggaucacuuauuuuuaugacauuacuuauuuauuccuaggucgccuuuaaguugaagcuaagaucaacugccuugacuaauauuuaaugauguugcacuaaaacuugaaaauucuaugaaaaugagaaucuccccuaguguaaacagccaguugccauucuguuuuccuguuaauugguuuguaaucuuauaaaagggagagacacuaucaaaaagauucuagcuauuguagguugguacguuuuaauugguggaaaguacuagucucaggauucuuaguuugauuuuucucuucaacucccaaauaauuagauuuuuuucuccaacaucuccuaaauaauucucaggcauuacuaguagaagaauuauaauaacuguccuaagacaguuuuuuugauguguuuuauuauuuccuuauguguauacaagaaaauauucuauguagcaaagcuaagguucuuauuuucuaggaauagcucuucugaugucuccuuggaaaugucugauuauugucccagucacugucauuucacaggaagauuuuaugauuuugaagacuguguugcagcuaaugauguaauggaaaaucccgugaugaagagcuaagaccgcgaguccuacacccaacucuuuuucuuugugucuuuggaaaaguugcuucaccuuucugugccucagucuuccuauuucccagauacaaagaaauuggacuaaaugaucacuguauuuucuuuuugcuccaaaauuaagacuccccccgccccacagccuccuaucagcaccauauuacuuuguugaagauugugucgccucuggggacuugaauccccaauuugagaaaugaaauuucauuuuugaaaugauuaauagaauuuucauuguagucuguacacaaaguaccaaugcguauaauguuggguauaugacaaagauuguggcuucuguuagcuuuuaaacaguauuucagaaauaaacucucaauuuaauaugugauuauaaaucaucuucauuacagugagugugugguaguuaccaggauguacaaaguaggaugaugacaagguuucuuauuucaagggguuaagucagucacaagaaaggguuaagagauaaguacauuuugguuaagucaguauuuaagaaaacaaggcauauaaugcagugugggugcagguaagaggcacccaacucagacuguaguggagaggacugauuaguguugacuuuagggacuaggugauacccaugaggugucugaaaugacugaaauuuagcugauuggaaggagggcagcuuauuuuuaacacagagaagugagagcaggaagcuuggaauacuaccgaagguuuuguauacuuguauggaagagguagccagugcucugaccauaaaggaauaagaauucuaaaauuuaucugaaagucuuagggagcccuuuagguaauuuaaguugaggaugacauuaucaaauauauuccgugguaucucugaacuucucacuugaauuaaagcaauuguuuagucuuaaaacauucaacaaauccagucacgauaaaauuuaagguucuguguguauuuuccacugauaguuuucuaaauccuauauuuuggaauauccguuaaagauaacugcccuaaccuuuaauaccuuuuauaaaauuuccuguuuggaugugauuauuucuuuuagcucuaacuuugcuggagcuaauacuuaauuucuuauuguuaucuuaggcuuauucauuuucaacccauugugaaauaugcccuuccuuauugaaaacuuaauauuggacugugauacauguaugccuugauguguguuugagacuuguuccugguaggaguuugaauuuagaagcagaucaaaguacacaucuuccuuuugggugaauuuugaggucucuggccugaguugugguuagagaucccccuucuucuguguacuauacuucugagcucauuuuggaagguccgauguagccaccuguccaaauauccaugaugcugucacaagaccuuugcuacugcuuacuuagagccuagagcuaacuuuuauugaguuauagugucauuuuucagauagucccacgaagacuccaucuuuaaaaaauaugaacagcaauuaacuguccguuuaaauaggcauaacugugaccuuucagcuggagagauugaaaggagcuuuuugaaaaaagucuaaaguggcaagugucuaauuuucagguuuaauguuuguaguccugggucaguaauugacaagugauaaaaguuguucaguggugaucuuagcagugggugacuucucaaauguuuuuaguuuaaaaaagagggaacuucuuuguucauuuauagaccuuaucacuuuaaucuauugguauuaauguccacugucacugaucuuuccauugaugaaucagagaaacgagagcaguuguguguuuggacgaaagcauuuagagggacuucugauagugaugcacugggauuuuaaacauugcuauguacauuuaauaaaguacuaauucauaagaugguuuuguuucuuuguauaauuuugaucaacuuguguuugauagcccacucuuaguguauguguuacucaucuuuguauguuuaauguaucauuaguuuuagcugcugaugaagaaaugagcuuuuaauuacaaguaauacacuauauuucaaacgguuccauuuucaagacauaauucaauaaauauauucuaucuuuauuuugucuagucuagucuuguuugugaagaacaguuugagaagccaugggccauuuacuuaccuguaguagcaaguacuuacugccuccccgucccuccccuucccucauauaaucucaguauugcuugucuuuguuuauuauaucacucguagcuuuugugagaaauuccagaauaaaccugaguuuuaaauugcuaucuuuggaguagauugguguucaguguuguacucccuguaucaucuuuaaauauuuaaauugcagacucucuggcugccucuuaaauuagauccuucacuuaguaguuuugacauuucauaaccuugcuucucaugcauuaaauauucaccuguuuaaguggcagugaaaauuuaaaauccaaacucauauauuaauccagcaaauggaaaauggagaacagauugcaguggagaaagaggcuauuuugaccucaguaggacauaugcuggaaguccauuguuuugaagcauuucuaaauagaauuugucauuuaaagcgaacucuuuugggccuucaagggaguuuagucuuguagaaccaaaaagauacuuaacacuuucugaaaauagccccuguaugauucuguaggugcauaugaaggcaccuguaagaucuaaauccacaggaaaaaaaaaaaaucggaauggagaagguugcugguaauggucagauacaaaauuuaguuugguaacugauuugaucuccagagugugaguccuuagguaacugaucuccagagugugaguccuuaucccacuaucagccuucuucccacuuaggucuaaauacauuuucuauuuauaaucuuuuuagaugaaagaagaaauguuuuccaggaagggaggauuuugaugacagcgauauccuugauaguggaagggaaaggaagcuguuuuaauuccaagaacaguaaauaaagggauagggguaggaccuugagccuuggucugggaggaaggagaaggcaauuacccuuucuuacaccuuuauuuccugaaagugaacgaaaauggcauugcuuacuccugagaauuagaaaguaacaaaaauuaauuuaaaaauucuaaugaugauguguaguuucuuugguuaauuguaauuaguggccacuucucuuuucuuagaaaaaauuacucuuaaaaauauuaauggagccgggcgugguggcucaugccuguaaucccagcacuuugggaggccgaggugggcugaucaccugaggucaggcauucgagaccaggcugaccaacauggugaaacccugucucuaaaaaauacaaaaaaagccaguguggugguacaugccuguaaucccagcuacuuggaaggcugaggcaggagaauagcuugaacccgggaggcagagguuacagugagccgagaucacccacugcacuccagccugagcaacagagugagacuccgucucaaaauaauaaaaaguggaauaacuuuuaacuaauuucuagcaacauccuguuuucugucuguggccaguuucucuguguaugccuuuaagaaacagccaggauucauuuaauuuuucccaacucagaacaagugaacugaaacacucacuuaccauaguauuauugaaggaaaacuggaugaggagaccaggacacagaaagagaaagaucagaguuugaacccagaauucaacacuaguuguguauaaccuuaggcauguuauuuaccuugucugugccuguuuccccagcuauaaaauacuaauauguaugcugccuaccucaugggguuguugugaggcacagacaaaauauuguaguuugugaaaaugccuuguaaauggugaagucucauaaugcccuaaauguaaguuuaacauuaaacauuguuaccgacguaaguuuauauauaaucuaaucacuccuguccugccugugguaguggaaaaugguucuuugacaaugucacugaaagauacuguuuuugagaagguuugucuuggagccuuuuuaauguggcugggaacuaaagauacaauauaaacugaagaguggacauuggggaaaaaaaaaaucacauaacugaccuagguauguuuucaaagccuuuauauaagcauuaaauauaaacccauuuuccuaaauauauuuuaggaugacuuuuaagacacaccaccuacacucaucugaauugcacaaagcagugaaugucacugcaugaguaaauuguucuagaacacuguaauggacccagguuucucucuacuuuaaggggcugggcauuuaccuaaauuuucagaugcauguagagguaaauaauauuuauaaugucacauagauuaggcucugaagcuuuucauguggauuagaaauuauuuaauuauuccuaauagccauauaaagaagguagaauugugguaauaggcuugaagaacuuaguucuaaguucacagaacugguuaugaauuaaaccuaguuuugagcccaggcacaccgauuagcuguuaccuuuaaccacauuuccacugccuccugugacacuugaucucaugcagagccugucaccugcugcugguugcuugaucagucauuggaaguuagccuccuuggagaauguguagaugccugcccuggagcccaugggacauggcuguucauaaugggaguacuucagucacaugaucuggaacagaguaacagcugacuuguugggugcucccuccuguggaaaaaaaagccauagaauccuagauagggaugcacgucccagcuggugagguuucaccuuuucuggauaauugagaaucuuacacgagaaaagaaauuaaguuuucauugauucauauuacugaaugcauauauaauucauuggccuuguuucaucaguuuauagcaaucccaagauuugauuccaucuaaguuacauuaaucacuugaaauuggccacuuguucuucacuuacauuuaaguuccccagucuucauuguucuuaaguauuuaggcauagagaaaacaaauagcguaugaauaguuauguauguuuucuccaccacuauuccaaauuccuuguuucuucuguagaacaggacagugcuaauauaacuuccaaacauagccuuuggaacaacagguauauuuucacuuguuaaugagcaaacgguuugaauaaagaagaguauuaaauguuaacaccauuggggcaggggugugaaagauaacgaggucuuuauaaaguaguauaaaauguggcuuauauuuuuuucuggaaagccaagaaaaaguggcaacagagagcugugggcacaauucaaauuauggggaaaauguuuggugcuucauacuaaaaguuauuuaaguauuaguguaaauugggaaaguuuguuguuaacuggauuaaagguggguaccaauaauaaaaugagcaggcaguaguuaucacuuuaccucagcaaaucaaucccagacacauugaccauuuuuaguaauaaucugaggauggcguauauugugaaauuucugucccuugaaguaggcuaguccagaauauuacagcuaaaccaaagggaaugcgaucaggaauagcucaugagacuaaauguuggcaaagauagguuauaggcagagagucaucaauuacaauuggggcaggagaucuggaugacuugaacugacccuuaaaugcucugguucaguaagccguuguggaucugcaugaucaaugggguauuauuggaugggcuuuacucaccaaauguguuagcaucuaucacaugucaggcacucacuaggcauugaggauacagugaugaccaagaaugaugugguuucuucccucacagaguuuacaugaggaaugaugauuauaaacaaauacaugcagaccuauuuugucuuucguccuugugggauuugguauaccguaucucaaagacaugaaacuuuuugaaaguacauacaguggcaggcaaaguuaauuauagggacuuaagaccuuuugaaaaucaagguuaaaaagaccuguggaugagaagacaacagacaaaggauaaugagggcuuguucacacauucaaauuucugggaauuuauggacaaucauacagcauauaucaaaagagcauacuuacugauaagggugaauuuuuuuuuagaaauguagcacuaccacccacacagaugugagaggcuagaaaacaaaaauguuccaugaauuuggaaucuuuaagcuuagaaugauugggccuaaaucccuauucuagagcagguguucccaaccccuggccauggacccauaccaguccguggccuguuaggaaccagugcacacagccagaggugagcagcaggugagccagcauuauugcccaagcuccaccuccuguccgauuagcugcagcauuagauucucaucagggcacaaacccuauuuugaacugcacaugcaaggaaucuagauugugcaguuuuuaugagaaucuaaugcaucccccaccaugguccauggaaaaauugucuuccacaaaaccagucccugguaccaaaaagguuggggaccacugcucuaggggauuggccccacagaagacagccuauuauugugaacaguacugugcuguaugcaccacuggucuguuuuaagaacuuuaaauuuuagugaauuaaaacuggacuaaagguggguacaaaugauaaaaugagcaggcaguuguugaaucacuauaccuccgcaaauugaucccagacccauugaccauuuuuaguaauaaucuggaggaugggauauauugugaaauuucugucccuugcaguaggcuaguccagcauauuacagauacucuucccuguccaccuaggggagagggaaugggaauacuacuacccauuugucuagaauuuuccuggaaaugaauaaagcaguuagcaccugacuugcuugaacuucaguguucuaugcuguucaugggaaaguuaccgaggcaguuuuugaguuucuaaagggaggugggugagugagcaugcauauacauuuaauuuuauuuuccuuuuccagguuuccuaugcucgcccaaguucagcuucuaucagagaugcaaauuuauaugucagcggacuuccaaaaacaaugacccagaaggaguuggaacagcuuuuuucacaauauggacgcauuauuacuucucguauucuugucgaccaggucacugguaaguagacagccacuccggacagucuuucccugucucugacuagcagauugugaaauauucugucuuuccauguagcagucuugcuucuagaacauaucaaagguauaugugggccagaaaaugcaauuuucugcuggaauuguucauaaauaugcauggauaaaaauagauuguggaguauagugagcgugcuugagucauuuccacccugaaggugcaggauugaagccuguuucauggcuuguaauaaauuuauagaugcuauaaucuucauuuccaagccacugugugauaaaagcccccauccugcuuauagaguacuaauaaacaaccuuucuuuugucaaaaagcgaaguuuaaugcagcgguaugcagcuaguucuccaagggaggauuacacuacauccacacugguaauugcuguucaggcuguuuuccagguucaugcugugcuguaugggcauauguaagaguuugaaauuuugaauguuaaaaauuuauuuuauuccuaauaucacuguuagcccaacugaaaugggaagacuaaaauguucauuaaaacucuugaauguaagggaguuguucugccaaaucuuaguuaacaaagcuauagcaauauagauuugauuaugaauuuuaaaaauaaaauacagauacaauuuucuauuauaaaagcaauacuuggccaggcacaguggcucaugccuauaauccaagcacuuugggaggccaaggagggcggaucaccugaggcugggaguucaagaccagcgugaccaacauagagaagccccaucucuacuaaaaauacaaaauuagcugggugugauggcgcaugccuguaaucccagguacucaggaggcugaggcaggagaaucacuugaaccccagaggcggaggucacggugagcugagaucaugccauugcacuccagccugggcaaugggcaacaagagcaaaacuccauuucaaaaaauaaguaaaaaauaaaaugaaagcaauacuuguucuuuaggaaacaguuaaaaaauagagaaacauugugaggaggaaauauuagcuguaguaccauagacugaagcagccacaugaagauuugugagguuguuuuuguuuguuuuuuuaagguagcuuuucuccucacuguuuguuucucuccccgccacccguauaauaauaauaccuuggaggcauguuguauauuacaaugucuaauucuuuuaaagcagugacuucagaagaaaauugagccagauuuuucauucaucaagugaagauccauuuaguugaucugaaucuaaucagaggagcccauauuaccugccucuguguuguuaauuggcuucauaggaagcaccaccuuuagaguucugaguagagagagcuagcacuacaugcaugccugggagaauagccuacagauuuugcugucaugagacuauuuagucaagugagaguauauaaaauacagccuccuuaauuguguuaguuaauucauaauacuuauacauugccacccuguguuguuaucacauagacuaauaaugguguuaaauagaaauccaggccuagaaauaaagaugaauuuguucaaagcaacaaaaauauuuuuuauuucauuugugcuuucuaauucauucauucugagaucuugugaauugagaguagguuucaccuaugacacaaagugcgucucaucuuuuaccugcuaguccaucacagguggaccuagcuuguuuuagucagcgguucucaaguaugucccgcaccugcaguaucagcagucuucuggaacccugcuaaaaaugcaaauuauugggcuucauucagaaccuacugaauaaaucucugagggugagccacagguuguucuuagguaugcuuaaguaggaggaccaccgauuuaggugacucuagcuguguagaggcuguuuuuuuuuuuuuuuuuuuuuuuuuuuuuugcuaaucugaugcuuuucuaauggaacagcuaaauucuagagguuauuaauucuuaauaggcgcuaguagauaagugaaaggauuugcuaucauuucacuauuuauucuucauacuuaaggcuuucaaagugaacuuacucaauuuaccugaaaugaaaaaugaaacccugcaauuuucuuauucagccaucaggugguaauaaugugcaaugcaugcucuuuaaauagaaaagguaaagugauaggggcugucuuagauacgcauauguggaaaaaaugcuuugucuacauuagaaaauucuuagucauugaccuuacacaguauuaauuuuaaagcaaguagaccuucuuucuuuuuuuuuuuuuaagcuccuccaaguaugaugguccagugcucauuuacuugccaaaaaaaauuucccugccacugcuuaucucaugaugaccagcuguggucaccccacuagccuguucacgcuaauuaaauggaauaagcuggguuucccucuacaauuuuucauaaccuggaaagguucuuggcuauccuuucccauuugugucuuucacacuggggagaauguggggcagggagugaucuucuguagucaggagugaugcugcugaggucagaaagcuuugaugcuuuacuucuagaaauuuauuuauuuuuaaaaucuacgucuuuucuuuuucuccauauaauauuuuucuguaauaaaauauagcuagucagaagcacaagagagcuucagagaacuggaagagcauuuucaggcauuuuuuuccuaaaggaccuauauccuaugcaauauuauuaagcugaauauauuauuuaaaauuucaaccgaaaugucuuucuaccacaguguauguauuuuuagcauagcuuuguagcauuuuuagcaaauucuucuuucuguucuccuuguuucaaggacaggaacuacugugucccucauuucugagcugcuuauccaauagcacaaauugaaaaauggaacuccgguacacuauugacauuaaaagaguguacgggagggaggugggagagagagaaaacauggacaugcuuguguuuucuugucuuagcugauuggaaugcaugugauaauggguacucagauuauguaagugacacgaauuuuucuaaaaaugcaaaauugugauucuaaacugaauggcuaguaaguaaaggggaaaguuuccuccuggugugauuuugugggaaauguuauauguaggugaaaacauguucuugagaaggaaaaauuaauguguccuuucuucucuccuucccuucuccuucuguucccucuuuuccaaaucuuuacucaaaucuaccauaggcauaucaagggguguaggguuuauucgauuugacaagcgaauugaggcagaagaagcuaucaaaggccuaaauggccagaaaccucccggugccacggagccaaucacuguaaaguuugcuaauaacccaagccaaaaaaccaaucaggccauccuuucccagcuguaccagucuccaaacagaagguauccaggaccgcuagcucagcaggcacagcguuuuagguaagucugguuugguucuugugcccagcuacuaaacugaaagagaauacucagguuuacuguccaguacuuuuauugacaggaucucugguuugcuuuugucaguguuguugguuuuauuacuauuaauuuuucaucuccaugggcacagagagaaucuacuugaggaauagugucuuuugcuaauauugaagguggggaccaaaggacaguaaccuacagcagugauucuuaaccaagggugauuuuugccucccagggaacauuuggcaaugucuagagguauucauguuggcacaaccugugggggugcuacuagcauguaaugcuagaggucggggaugcugcuaagcuccuacaguguacagcauagccccagcaaccagaaguuaccugguccaaagcaccaauaaugcugugguugagaaauucuaaucuguagcuuucugggguuaucugaauuguuuccagggcuucagauuuccuuuuuuuuuuuucuuaaaggauuuuauucucaugugucaauuuuuaggucaagcuguuucuguuacuucacuuuauaguaugugcaccauuaaggguauauaaccuaugugacuacgugaaguuucuacaaaugaguuccucucuuccuuuucaaaauuguuuacaaacagguuggcagacuuucucuguacaguaccagauaguaaauauuuaacuuuauggguuauggucacuguugcaucugucuuguuuuuguuuuuaaacaaccuguuaaaaauguaaaagccauucuuagcuuauagcccauacagcaacaggugggaggcagucuccauuuggccugucgguuguaauuuacugaccucucuguaguucauagaaugaccguggcuuuagcccaaagaagacacucuaucucacugacagguguacauaugcuaacuguuuaaguuuuauucugauccugggauaacaaaccaggagucauucaaaaaaucucuaaucugcaugugagaagaacagugacuuuaagaaguuaagcagagcagagaguuuuugguuucauaagcaagucaugcaguuuuuauuuuccaggacauuuuuaaauauccuuuuuggccauaugguacacuauacccagaaugcuaucuaaccccacacugauuuuuaaaaauuauuuccaagugcauaucaauuuuauuuauuucauucaugggacagaauaguuaauuaccaaaaauauaaucacaaauauaaccuaauaagaucaggaguuauguuuucuagcuuaaaucuaugcauuuauuuuuuucauuggaauauuugcagugcugaagagaguggagauaaaaucaguuaaaaauagcuccuuuuaaaaaaauacuaaauuauguugcuugagauaugagaaggaaauuuguuaugaaugccacauuaaauuucaacuuaaguuggccuuugccgugggagaagaggugguacugucaaaagcauugagccuuguacuucaugcucugcugugaggaaaaggcauugguauuaaaaaaaaaaaaaaaaaaaaaaaaaaaaaaaaaaaaaaaaccuuugccaccuuugacuucccaugguaguggugaucagacuagugugggagaugcguggggcugccugaugcuugccuuuguggagaaagaagucucacaaagaaagcccuuuuucagcucugcacauagguuuccucugugacaucuuaagugaauaauauauguauaaauauacuuuuuuaaauugcaaacguaggaugaacaagccugaaggaauuuuacagguauuuccuaggcagcuuguccaguuaauuucagagcucuuuggggccuugaaaaugaucucgaguuuagauagaacaaaguucuucauaauguauugguugauuuuuaacauugugaaguuauaaaauguuugcuguuaguggaaagcuauauuagcuacuuuuuuuuuccagauugaagcaaugauuuuguuugauaguuauuaaguaaaacaaaguucuuggaaucaagauugaauucuuaggaagauugagaagacaggauuugggagagugccugauuauugaaauggcaaggcuuguaggugacucaggugcuagguuguugaugggugucagcccuuagguuuaccuagccuccaucccugcaggcucugugcuuuuuauuuuugguugaguaaagcuuuacaggauguucuuauggucaaauuuaauuaucuuuuucuggcccauucuguguuuuuaucuuuuaguaccauauguuaucauuaacuugaaaauucuuuuuccuucacuccuauagaaagacauuuuggaagaagagaauaagagauugucaguuguaagggaaacuugguuucagaaaaugggagaaauuguuauucucucuucagauuuuuaacuguugucccauucaccccauuucucauuccucccaugaucccuguccagauaauaaaauaugaacgaguuagugugcucagagauaguguuugaucuagauuggguguguuggaagaaaucagauuucagguuuaaccugauguuugaugcuuuucuuuaauacaguauauugaaccugguugucauuaucuugauuuccgccccacucccccuucuucuuucaccugauaaagaaacuugaauuaagggcuugcuuguuuuguugguauuuugcuguuuucuguaguucgagucuaaaucaucacacagauauauuuugucccugauauuuguguuuuaaugcucuugccuugaguuuuugucaccuuucagcagacauguagaaaauuucucacuguauuuuuauguucucauaguaccuugggaguugagagagauugagcaauauaaguuauauguauuauggucaagaauacuuuuaauaaucauaaaguaugagccauaucuuuuauggucaaaaagcuuaaaaauccauguaauaaggguuaaguuuaaagguggguuugugagguuuauggcuuagucaaucuaugaauaaucagagaauuguuguaauaugagcacugcuggucuaauacgcuuauuuaauugacugcaguuuucaaaauaggacaagccuuauuuauuuggauggaugguguaauucaagccccuuaaguauauucuugggacaugauaucagaauuaaacuuuaagccaaauuuuuucauguucuuuucugugaaacagcuauaauuuuauugaauaugaucuaguguaaugaccugugugccugcuucuaugagccuuuaugcauuuuuuaaaaagccuuuuaaaugagcacuugaguugccuuuaaggcaugacguacugguugcauuaucacaauuuccuuuuggaagaaaccgguaucaauccccuugaauacuuuuccucuuucuuagaggacagaugauaccaucuaauugaauaaggcaguaaggcaguaagaagaugaucuuguuguagauaauuuccaagcaguucucgguuggcgcuuuggagagauuuugauaaucauuauuugugggauuccgaguauauuuucuuacccaucaauaacuuaucuuccuauuuuuauuucugacuuuaaucggguucacauuuccccuuacuuacauguaggccuucccauaguccaucagcuaauuuuuuuagaaauuaggcagguacuuuauuuuuauuuucuacuuaugaacaccuagcuuuaaaauaggaaugaucugauacaugguucuguucaaaauuuugacagguuauaauuggagcuuugguccuguugauagaaaaauguuuauacacaucucucuccuaugugccuuuuucauaaauuacauauguacaugggcgugugcuauucauuaaauuauaaacucuaaucaaacauaaaaaaggauaaagaugagacaaucuguauuaaaugucuugcuaauuacuauacugguuggcuucauuuuccauguaccuaauaucuuaauaaaugucuuuuaaagcaagaccauaaaauaauuucagauaucucaucugacuucaugugaugcauguuggauuaucuugugucuaaccuuauaauguagcuuguacuaagaguaggagaaauaaucggcucucccuuuccuuauuuacuuguauuucccuuacugguaccauucuuuacucugauuuacauuuguaguaaucuuuuuuuaaguuacuuuuucuuuaaauggaggucauuuuaauuaaagcagguuauccagucuaauccuccauaucugcuugcuguguuauuuguaaaauggauuuuguucaggcuaaagagcaggagagagugccacucgccgccucuccccuucgaugauugcucagucuucccccagggaggcaggugauacacaggacugagaagguacuggguucagugcaucuauuaaauauaaguaaaaaauacuuuauuuuaaauacauauuuauuuuauauuuuauuuuaaauauauauuuaauggauacuuuaauauuuaccuuccauauguacuacguuaucauccacaccccucccugagauauucuggaggcagcuagcuugcucuccauuuaaaaauugacuuccauuuauaaaugaccauaaauaaaagauggcugggcgugguggcucacuccuguaaucccagcacuuugggaggccaaggcggguggaucacgaggucaggagaucgagaccaucauggcuaaauggugaaaccccgucucuacuaaaaauacaaaaaaaauuagccggacguggugguugggugccuguagucccagcuacucgagaggcuggggccagagaauggugugaacccgggaggcagaguuugcagugagccgagaucacgccacugcacuccagccugggugacagagcgagacuucgucucaaaaauaaauaaauaaaauaaaaagauguccuugagcaguggacagacccagcagacauauuucuaggggcuuguuguaguaguccuuguguuugagcugcugcacuauuuucucuuacaacugccuguguuacaguuugccaacugcuacuggauuuggagugaauggugcccauguagagcacccguugccuuuucugagcucccaugggaaacaugaaucuauggcaccgagaaagcuaggaaauacuucugggcucagaugcauacagucagggggcuucagcagugccugggcacuguuuucuagguuccaugcuucucccuacacucguuggugauggaggagaagaaagauuagaguggauaacuuggcuuaguuccaaaggaccaauuuuuuucuaaaaugagagagaagugaaggaaucagugaagaucaugguaucauguaaaacuucacagauaggguaaaaaagaugcccuaucauaauuuggaggguccucggagauccuguuauaaaaaauucgaaaccuccugucuggggaugccagagauggaagugagggagauggaggauggaaaacgaaauguuucucccucacugcauguacagucaugcaucacauaacguuucaguuaaucacauguacgaccgugguaccauaauauaguagacugcaaaaaauuccuauugucuagugauaucauagucauccuaauauugugcaaugcauuaccuuuucuauguuuagauaugguuaaauacacaauacuuagcauuguguuagaauuaccuacaguauucaguacagugacauguuauacagguuuguagacugggagccauagcccauaccauauaacuaggugugugguaggcuauuaccaucuagguuuguauaagugcauucuaugaucguacaacaacgagaucaccuagugacacauuuucagaacauauccccauuguuaaaaaaggccugacgguaauucacuucaggggcagauuugguuucuacccuguuugaaaauucugaaaacucaucugucucugggccguaugcuugguguccugagugggugguagcaaagcaugaccugucccuacauggaugcaauuaaugggcauagaugauguaacuuuugagugaauugauaaggugccucugcauucugggucuucuagcacuuugguuggagaccucaguaugcgguucucuucuacagguagcauaugccaaaugcauucuguguugaucauuccagcaauuugauaaaauuguauuguuacuuuaugauugguggugcuaauauguguuugucuuuauugcugguaguugugauccuuauucuugacuauaaaggcauggcaucuuugacuguacucaccucugcaaaaaauaaaaccccacaucuuuuuacuuaugugcagacaaggucauccaaccaauccucuuacuaguuuucauucuggacuaaguugaccauaauuuugguaaccucauugucuuuauuuggucaucacauauuuauuauaaacuaucagugacccuggcuugugcucaguggugcaaugagaggguggugggucaaggcacgcacacacacacacgcaccacgcacacagagacacacucacacacgaagaucuuuugucauugugaucuguucuguuuccuuacacuuugcauaagcucaguucuucucaucuuuacaaaacagaauuuucaguggagacugagggcagggaugugggaggcuauauauuuccccauucugaaagaccagaugagauguguuuuggcuuuuacaaaacuaaaagguguuggcuuuugcauguauacuuuagcgugacuugaugccacagguuaggugauaaggcugagacuuuucaaacuuaccuuucacggguguuaaagaaaaaauucucacccccacccccagucccagagggacaacccugggaugucuuuggagaguguugagcauuguagcaguugagggugguuguggacuauguauuaaguuaugccuccuccucagaacacauaauuaguugguaagcacuguggaaauuugggacauuagagugguguuuugaaacugauaaagaagagucaaaugcuguaaaacuaauauuugauauaggaaaaauguagaagguuuuaaagaguacuuacaccuccacccccaccccuauuuacuuucuauaaacauuuuaagugaggcucagauuggcuuguuuuguuuccuaccuggccuuugaaaacugaguaggacgacacuuccuguagcguaauuugaauacagcauccagaucaggaucugaacucuuggcuuuguugcacacuggagugauggauuuuucuuuuuuccuucucuagaccucagcugagcacauuugagaaaugggaggguuagcuuggguuguccauaagguuuuuucuaccuguaauuauaccuccuugauucuaaaagaugaaagcccuucaaaguugggaaaugaaaggaaaauguauagaauucuguaaccugcagaguuugaguaucaaugccauaauuuacuagcccuguggucuugagcaagccacuuaaacccugugugccuuagguaucugcaggcaccaacagaguugugaaaaucaaaaguaguauaaagaacauguagcuauacauugaucacuuugaagcuaccugaugagaacccuaaaguuaacuaucccagagcuuucgcacuuccucucugaaagguauccucagaugaccgucacugugucccauguacugacccuuguagagagaaaccauucauuggaagaacuguccuguggcagucggugcccauuagcuuaaaaacguaaaaagacccagcauucugagucuucacauauaaucaguguacagauauccccucggaagauggcaguaaugagcccaacuuucuugaacaucaaggggaaaaauuaaaaacugaaguuugcuaaauguguguuuugcagguuggacaaucugcucaauauggcuuauggaguaaagagguaaugauagagguucaugauacucauaaucccuuuccacaguugauugguuucuuugauuuugggagugcuauucacaccccucauaaguuuuuguuggguuuuauuuugcaugugcaaccuaaugaaaagcugcucuuugaagcacaauugacucaagaaauuuuuauaccaccggaugccaccuggucuuuuaaaaacccaucauuuguuucguauugcguuacgacguuacagcauguuuacguauguguugaucccuuccccugccaauccugcuuaauucaugaagccaguucuaaauauauuucuuugcuauuguggaugauauucaguacagugaauaauggucauuucauaacuuauuaauaucucaguagucuagcaugucacugcaaagccacacacagaccuuggucaaaacaugaaauaguuuauauauuuguugggggaggagaguuacuaaaauucuuggggauggaaaagguauacguucauugcuauaaccaaccucuguuuuuauuuuuuguguguauguguguauuuccuauucuguuuagcagguuuucuccaaugaccauugacggaaugaccaguuuggcuggaauuaauaucccugggcacccuggaacagggugguguauauuuguguacaaccuggcuccugacgcagaugagaguauccuguggcaaauguuugggccuuuuggagcugucaccaaugugaaggucauccgugacuuuaacaccaauaaaugcaaagguuuuggauuugugacuaugacaaacuaugaugaggcugccauggcgauagcuagccucaauggauaccgucugggagacagaguacugcaggucuccuuuaagacaaacaaaacgcacaaagccuaaugagcucuuguccucaguccauuuauauaugaaaacuauacaacaaaggcaaguuaagagaaacuuuauacauuaguaaaugucuuuguaagucaguguugagauggggauaaaaugacuacuuagcauccuaagaaauaugugagauuuuuuauugcuaguauuugaauuaaaacuucuuaaauaucuuuuauguuugaauauggacaagagguacaggguuuuuaccugucacauugcauucuauugccuucuuugaagaagguggaccuuuuaaaguguuucagcuaagggaagacauuucuuuucuuuuuacauaacugccuugaaccugugaguaaauauugaggcuuuguguuguaauucuucaguugguugugucuuuuuuuuccccccuuuuuuuccuuuuucugauuagcuuuguguuugguuuacauuuaaagcauugcuguuaugucuguuuaagaaaaguauuuugaaguuuacauuuuuauuuaugaaguuuaaaacaguauuuauuuuguaauuaugauuuggguuggggaagggggggcuacauuauaaacgcuuauuguaagaauacuggagaacuuuucguaaagcaguaccuugccaaagagauaagagccucuuugauguggguuuaaaaaaagcaucuauuuuuauaaaaaagaaaauuuggagaaacuuuuuacugguccuggaacaaauauuuugacuugaauacuuugagaaaucucuucauaugacaccuagugagcuuuuaaaauuuaccaggaaauuugcagcgguuggaaaauuuagaaagauuuaugguguagaaaauacuuuugagaucuuuguaugaaaggaguagaaucaauggggggaaacacugcugguuucauuuuuguaaucaccaguggagcgucugaucauccugguuauuaugugauagguggcucacauugauuugugauuuugaaacaaauaaaaaaaauuuacaaaagaauauauaagagcaggcaagaaauuuaaauuaccgagagaugggggaaaaaaucuguucuuccuaaagaaaucccuucagauagagcucaugguguuuagugauguacuugcaguauuguuugaagaauuguuuugucuuaaggaaaaaagacguugcacaugauuuguacugcagcaaaucagcaaaagugaucugaguuggauauauuugaagguauuuugaaaguuacguucaaggcuaacaccugagcuuuguguaauguaaauaagaccuuguguuuaugaaccuuucagcuaauuuaauuuuuuuucccuuacaugccaagugauguucagguuuugaauguuuuuguaucaguuuuuuccuuuguaaauggcauuaacauuguuacuugaggucuugcuuaaucacuuuuguuguccugaggacuugaauuuacagugcaucagauuuguugcaaauuuugucuguagauagucuagcuucagcuguuuauggugaugcuacauuuugguuuauaaauauguuugugguauaaaaaaaugaguauaaccauagguuuugaacaaauuuccuuacauuuuucauacaaaaaucauaaauaucuguaugcuauugaaauuuaacuuuguaugaugcuuaaaaaccacuauuuggggaaauaauaaaauaagucuuuaccauguaugaaagaaauuuuaaaaaauacaaaauauuuucugauuagcaucuagcuuauaauaaauuuucaaaaaagcugaaggcaaaaaugccuucaucaggaugcacugagaacuauauaguuacguccugcuuuuuguauaaacugagaugcucacaugcuuccccuuagaacaggcaaugugcuaugcauaacauaguuguacauuaucuuugcgguugcuuugaguuuuauuuuuuauuauuuaaaauuguaguuauaaaauuuuucaguauaguacaguacauauacugugaggcgcgugcuaaagugaauaagcgaguuuucaugcugacccacucaaugcuauucagaaaucaauuggcuuagcacuuucucauauccuuaggugcauuuagauugccagaguuaaccuucugcguuuaaaaaaagaaaaacacuaaaaaauaaaauacauguauauacuuaaaaaaaaauaauaagguuucccucaagggaaaacagcagcuacaugcuucuuuccuauacuacuguagcaaaccaaggcauugaugagagggcaugcaaauugugcuucacuuuacaguguuuuaucagagcacuuaauaaaauguaaggcugguauuuauuugaaguuguacaguaugacuuaauucacaucuguuggaauagaaaauauauucuguugaguauuuaagaggcuguacauguuuucuuuuguguuuggauucuuuguacuuuuucauguucaguacaucaauaaacaaaguugaagggaa

SEQ ID NO: 192927 - RNA, 5252 nt, Homo sapiens
cgggccugggcggaugucuccggcgcgucggugcagggggaugagggccgcgguggcugccagcgugggguugagcgaggggccugcuggcucccggagcggucgccucuuccgcccgccgagucccgcuccggcggcccccggcgcccggcuguugcggcucccggggagcggggccgugcaggccgcgagcccggagcgcgccggcuggaccgaggcgcugcgggccgccguggccgagcugcgcgccggcgccgugguggccguccccaccgauacgcuguacggccuggccugcgcggcgagcugcucggcggcucugcgcgcuguguaccgccucaagggucgcagcgaggccaagccucuggccguaugccucggccgcguggccgacgucuacagguaaggccgccccgacccggccccgcuaggggcggcaccgcgggagggguuuccggugacaggcuugggagacugaggcgcagagagcgggaggggcuuguccaggcucaccaaggaauccggaacuggaaauauguaccgaggacuuaacgugccccgggcccugaacuacaugcugcugggaagcagcaacacacgagaaaggcagggacccuguucccuuggcguauuugugcuaauuggggaggcccccgggaaaaaagcaaacaaacacaguagcuuaauuuaauagcgaaugccuugaagaaaauaaaacguggagcuugaucccacuaucaugauaucacagcggugcagcuguuguagucccugagaccagaggcacaugggcgucaagccaggggugcgccucuggagcccugcuuucugcucaagcucuuagggaggugaagcagggagacaggcggcucccauuguaaacucgaaggauuccuuuucuacgucugccuagagucuaggaaaggaccaccaguggcccuucaauuuugaauggauuuauucuucuguguuucccagauacugccgugugagaguaccugaggggcuccugaaagaccuacugccaggaccagugacccuggugauggaacgcucggaggagcucaacaaggaccuaaacccuuuuacgccugugagucaaguuuucucuuguguccccagacuccaggccacuuggcuuucacuaggauccagauaagacuuacccucuuaucccuuccaaccuuucucaugaucccuuuccccuugccuuacagcuuguaggcauucggauuccugaucaugcuuuuaugcaagacuuggcucagauguuugaggguccgcuugcucucacuagugccaaccucagcucccaggccaguucucugaaugucgaggugaguuuacccaguccuuccccuggaaaugucaccagcgcacauacuguuuucugugaaucaguggcauugauaguacacugggauggccaggcaugagaguucuugggccaacagugggaagguugcccagcuggcagggaggugguggggggcaauauaaauuaaaaaaauuugaaagauuuuaucucaaagucugaaaagccagggggagaauuggucuuuucuucagucuuuauaauaauaggaaagauuauaagaacaaugucuuccuguuuuucuggagauaacaguuucuggagaacacaguuaggcuauaaaucuucacgacagugcuguaaagaaagaugaagaaggccaagggcaguggcucaugccugugaccccagcacuuugggaggcccaagcagguggaucaugugaggucaggaguuugagaccagccuggcuaacauggcaaaacuccaucucuaauaaaaaauacaaagauuagccagacaugguggcgcaugccuguaaucccagcuacuugggaggcugaggcaggagaaucacuugaaccugggaggcagagguuacagugagcucagauugugccacuguacuccaggcagggcucuagagcgagacucugucucuuaaaaaaaaaaaaaaagaugaaguuuagccuccagaaaguuaaaucacuuguuccaggucacacagccauuaagugacugacucagauuuuuaaccaguuuuugauucucgccccuguucucuuaucucugccacaagccagaucaaagaaaggaucauccuaauccuuucuuggcuacauagauuagaacaaaggaggacacauagaaauuucguuuuuuuucuuauuacuaagauguaaaacguaguaauaagcuacauuguguccccagacucggccagacacauaguaucacacauaguauccagcaucaggccuugggccuuccuugggcuuauuacauccagcuaauaagccuggauagaguaacuugcgugcagucacauagagauacgauggaaaguccagaguuagagcccguaucccugcucagaacuccauucgauggguuuuccauucccagaccuagaguggggcucaggguucuuagaaagugagaguucagcaucccuucccauucucagagugcagguuugacuugguccugguggcuguaccccaggagcaagaaucgggauguggcacagggaggggagguuuuuaccuugucagcaaucauuugaccuguccaacacaguaacugguauuuaugauuuccugucccagauuuccaggccuaacugccacugcagugucuuccuugggggguuggggaagcucuagcucaguuaacaauucaguccacugcucuagggggaguauccuucucauagcccaaagacugagugcugguggcaugcagaaucuaccauguucuacucuuccuacccugaucagagucgcagugagauccaggagcauaguucuagagcuagaaggagcuggaaucacuuguuccagguuacgcagccauuaagugaccagauuuuuaccuaguuuuuuuuuguuuuguuuuguuugagacagucucacucucuugcccaggcuggagugcaguggcaccaucucagcucacugcaaccuccaucucccggguucaaacaguucuccugccucagccucccgagugaguagcugggauuacaggcgugugccaccaugcccggcuaauuuuuguauuuuuaguagagaugggguuucacuauguugaccaggcuagucucaaacuccuggccucaagagauccagccucccaaagugcugagauuacaggcgugagccaccaugccuggucuuuuuaccuaguuuuugacucuugacccuguucucuuaucuuugcggcaagccaggucaaagaaaagaucauccuaguccugucuuggcuacauagauuagaacaaaugaaaugaggacauaggaucaucuaguccagcccacuugucuuguaggccuggauagaguaacuugcaugcagucacacggagauacgauggaaagucuagaguuauagcccguaucucugcccagaacuccauucauuguacuuauauuucccuaacugaagcaaugugugaaauuuccuuuugacauagcaagauuuucuuuaaacccuagauagguguuacuuggagugcuaacccaggaggccuccaaaccucauagaauacagugucuuuggcacaguugaccuuaacuaaaugaagcuccuuucucugcuuagaggaaagugccuucuguuuuaagacuauauggccuuugaugacugcgugcaguuugacauuauuggauacaccagggauaguguccaugcucuuccuucucccucuucucaggaguuccaggaucucuggccucaguuguccuugguuauugaugggggacaaauuggggauggccagagccccgagugucgccuuggcucaacugugguugauuugucugugcccggaaaguuuggcaucauucguccaggcugguaagucucuuuccugugguguggggaaauaauuugagggagguuggagagaugcaaaaaagcuuugacaagauaaagauggugccuccuauguugcccugaaggagugugggccagguuuggagaagugguaguugcagugggacuaaguuuccuggcuuucuuaggauucaaaagguuucaucaaggguugaugaacagggcuuaacaaggcuagccaguuucgaugucccugcucaccagccucuggugggcucgggacuucugagaagucagacugguaacuguccuguuuccuccucagugcccuggaaaguacuacagccauccuccaacagaaguacggacugcuccccucacaugcguccuaccugugaaacucugggaagcaggaaggcccaagaccuggugcuggauacuaugugucuguccacugacgacugucaaggccucauuugcagaggccaccggagcuagggcacuagccugacuuuuaaggcagugugucuuucugagcacuguagaccaagcccuuggagcugcugguuuagccuugcaccuggggaaaggauguauuuauuuguauuuucauauaucagccaaaagcugaauggaaaaguuaagaacauuccuagguggccuuauucuaauaaguuucuucugucuguuuuguuuuucaauugaaaaguaauuaaauaacagauuuagaaucuagugagagccuccucucuggugggugguggcauuuaagguucaaaccagccagaagugcuggugcuguuuaaaaagucucagguggcugcgugugguggcucaugccuguaaucccaacauucugggaggcccaggcgggagaacugcuugagcccaggaguucagaaucagccugggcaacauagcaauacuccgucucauaaaaauuaauaaauaaaaagucucaggugaccaaaggcuccugaagcuagaaccagguuuggauaaagauugaagagccacaggccacucuucccucugagccauugggccuaguggugucauguauuguaauugcucgcagggagagcagucuuuuugguguaauagugggaugucugcuuaguuggcagggguucaguccaaauggaagaauauugggaaauaaaccuccacuauccuuuauagccagggacuuuuuucuuauuuauucauaaaauaaauuauaguuaauuauacccauaacaccuuuauuuaaauccaguguucuccgcagccuuuugucuauuuauauguguaccaaguguuaaacauaauuauuauugggcauuugaacuuuguuuuucuuuaaagaaaugcugcuauuaaacauauuuguaaaugguuu

SEQ ID NO: 192928 - RNA, 5252 nt, Homo sapiens
aaaccauuuacaaauauguuuaauagcagcauuucuuuaaagaaaaacaaaguucaaaugcccaauaauaauuauguuuaacacuugguacacauauaaauagacaaaaggcugcggagaacacuggauuuaaauaaagguguuauggguauaauuaacuauaauuuauuuuaugaauaaauaagaaaaaagucccuggcuauaaaggauaguggagguuuauuucccaauauucuuccauuuggacugaaccccugccaacuaagcagacaucccacuauuacaccaaaaagacugcucucccugcgagcaauuacaauacaugacaccacuaggcccaauggcucagagggaagaguggccuguggcucuucaaucuuuauccaaaccugguucuagcuucaggagccuuuggucaccugagacuuuuuauuuauuaauuuuuaugagacggaguauugcuauguugcccaggcugauucugaacuccugggcucaagcaguucucccgccugggccucccagaauguugggauuacaggcaugagccaccacacgcagccaccugagacuuuuuaaacagcaccagcacuucuggcugguuugaaccuuaaaugccaccacccaccagagaggaggcucucacuagauucuaaaucuguuauuuaauuacuuuucaauugaaaaacaaaacagacagaagaaacuuauuagaauaaggccaccuaggaauguucuuaacuuuuccauucagcuuuuggcugauauaugaaaauacaaauaaauacauccuuuccccaggugcaaggcuaaaccagcagcuccaagggcuuggucuacagugcucagaaagacacacugccuuaaaagucaggcuagugcccuagcuccgguggccucugcaaaugaggccuugacagucgucaguggacagacacauaguauccagcaccaggucuugggccuuccugcuucccagaguuucacagguaggacgcaugugaggggagcaguccguacuucuguuggaggauggcuguaguacuuuccagggcacugaggaggaaacaggacaguuaccagucugacuucucagaagucccgagcccaccagaggcuggugagcagggacaucgaaacuggcuagccuuguuaagcccuguucaucaacccuugaugaaaccuuuugaauccuaagaaagccaggaaacuuagucccacugcaacuaccacuucuccaaaccuggcccacacuccuucagggcaacauaggaggcaccaucuuuaucuugucaaagcuuuuuugcaucucuccaaccucccucaaauuauuuccccacaccacaggaaagagacuuaccagccuggacgaaugaugccaaacuuuccgggcacagacaaaucaaccacaguugagccaaggcgacacucggggcucuggccauccccaauuugucccccaucaauaaccaaggacaacugaggccagagauccuggaacuccugagaagagggagaaggaagagcauggacacuaucccugguguauccaauaaugucaaacugcacgcagucaucaaaggccauauagucuuaaaacagaaggcacuuuccucuaagcagagaaaggagcuucauuuaguuaaggucaacugugccaaagacacuguauucuaugagguuuggaggccuccuggguuagcacuccaaguaacaccuaucuaggguuuaaagaaaaucuugcuaugucaaaaggaaauuucacacauugcuucaguuagggaaauauaaguacaaugaauggaguucugggcagagauacgggcuauaacucuagacuuuccaucguaucuccgugugacugcaugcaaguuacucuauccaggccuacaagacaagugggcuggacuagaugauccuauguccucauuucauuuguucuaaucuauguagccaagacaggacuaggaugaucuuuucuuugaccuggcuugccgcaaagauaagagaacagggucaagagucaaaaacuagguaaaaagaccaggcaugguggcucacgccuguaaucucagcacuuugggaggcuggaucucuugaggccaggaguuugagacuagccuggucaacauagugaaaccccaucucuacuaaaaauacaaaaauuagccgggcaugguggcacacgccuguaaucccagcuacucacucgggaggcugaggcaggagaacuguuugaacccgggagauggagguugcagugagcugagauggugccacugcacuccagccugggcaagagagugagacugucucaaacaaaacaaaacaaaaaaaaacuagguaaaaaucuggucacuuaauggcugcguaaccuggaacaagugauuccagcuccuucuagcucuagaacuaugcuccuggaucucacugcgacucugaucaggguaggaagaguagaacaugguagauucugcaugccaccagcacucagucuuugggcuaugagaaggauacucccccuagagcaguggacugaauuguuaacugagcuagagcuuccccaaccccccaaggaagacacugcaguggcaguuaggccuggaaaucugggacaggaaaucauaaauaccaguuacuguguuggacaggucaaaugauugcugacaagguaaaaaccuccccucccugugccacaucccgauucuugcuccugggguacagccaccaggaccaagucaaaccugcacucugagaaugggaagggaugcugaacucucacuuucuaagaacccugagccccacucuaggucugggaauggaaaacccaucgaauggaguucugagcagggauacgggcucuaacucuggacuuuccaucguaucucuaugugacugcacgcaaguuacucuauccaggcuuauuagcuggauguaauaagcccaaggaaggcccaaggccugaugcuggauacuaugugugauacuaugugucuggccgagucuggggacacaauguagcuuauuacuacguuuuacaucuuaguaauaagaaaaaaaacgaaauuucuauguguccuccuuuguucuaaucuauguagccaagaaaggauuaggaugauccuuucuuugaucuggcuuguggcagagauaagagaacaggggcgagaaucaaaaacugguuaaaaaucugagucagucacuuaauggcugugugaccuggaacaagugauuuaacuuucuggaggcuaaacuucaucuuuuuuuuuuuuuuuaagagacagagucucgcucuagagcccugccuggaguacaguggcacaaucugagcucacuguaaccucugccucccagguucaagugauucuccugccucagccucccaaguagcugggauuacaggcaugcgccaccaugucuggcuaaucuuuguauuuuuuauuagagauggaguuuugccauguuagccaggcuggucucaaacuccugaccucacaugauccaccugcuugggccucccaaagugcuggggucacaggcaugagccacugcccuuggccuucuucaucuuucuuuacagcacugucgugaagauuuauagccuaacuguguucuccagaaacuguuaucuccagaaaaacaggaagacauuguucuuauaaucuuuccuauuauuauaaagacugaagaaaagaccaauucucccccuggcuuuucagacuuugagauaaaaucuuucaaauuuuuuuaauuuauauugccccccaccaccucccugccagcugggcaaccuucccacuguuggcccaagaacucucaugccuggccaucccaguguacuaucaaugccacugauucacagaaaacaguaugugcgcuggugacauuuccaggggaaggacuggguaaacucaccucgacauucagagaacuggccugggagcugagguuggcacuagugagagcaagcggacccucaaacaucugagccaagucuugcauaaaagcaugaucaggaauccgaaugccuacaagcuguaaggcaaggggaaagggaucaugagaaagguuggaagggauaagaggguaagucuuaucuggauccuagugaaagccaaguggccuggagucuggggacacaagagaaaacuugacucacaggcguaaaaggguuuagguccuuguugagcuccuccgagcguuccaucaccagggucacugguccuggcaguaggucuuucaggagccccucagguacucucacacggcaguaucugggaaacacagaagaauaaauccauucaaaauugaagggccacuggugguccuuuccuagacucuaggcagacguagaaaaggaauccuucgaguuuacaaugggagccgccugucucccugcuucaccucccuaagagcuugagcagaaagcagggcuccagaggcgcaccccuggcuugacgcccaugugccucuggucucagggacuacaacagcugcaccgcugugauaucaugauagugggaucaagcuccacguuuuauuuucuucaaggcauucgcuauuaaauuaagcuacuguguuuguuugcuuuuuucccgggggccuccccaauuagcacaaauacgccaagggaacagggucccugccuuucucguguguugcugcuucccagcagcauguaguucagggcccggggcacguuaaguccucgguacauauuuccaguuccggauuccuuggugagccuggacaagccccucccgcucucugcgccucagucucccaagccugucaccggaaaccccucccgcggugccgccccuagcggggccgggucggggcggccuuaccuguagacgucggccacgcggccgaggcauacggccagaggcuuggccucgcugcgacccuugaggcgguacacagcgcgcagagccgccgagcagcucgccgcgcaggccaggccguacagcguaucgguggggacggccaccacggcgccggcgcgcagcucggccacggcggcccgcagcgccucgguccagccggcgcgcuccgggcucgcggccugcacggccccgcuccccgggagccgcaacagccgggcgccgggggccgccggagcgggacucggcgggcggaagaggcgaccgcuccgggagccagcaggccccucgcucaaccccacgcuggcagccaccgcggcccucaucccccugcaccgacgcgccggagacauccgcccaggcccg

SEQ ID NO: 192929 - RNA, 39948 nt, Homo sapiens
augagggguuaccauggcgaccgaggcagccauccccgcccagcccgcuuugcugaccaacagcauauggacgugggcccugcugccagggccccauaccugcugggcuccagggaggccuucuccaccgagccccgcuucugugccccgagagcuggccugggacacauuucuccugaagggccccugagccugagugaggggccgucgguaggcccugagggagggccagcgggggccgggguugggggggguagcagcaccuuccccaggauguacccuggccagggccccuucgacaccugugaagacugugugggccacccacagggcaagggugccccccgccugccuccuacacuccuggaucaguuugaaaagcaguugccaguucaacaagauggcuuccacacacuaccauaccagcgagggccagcaggggcagggcccgggccagcgccagggacgggcacugccccagagccccgcagugagagcccuagccgcauccggcaccugguucauucugugcagaagcucuuugccaagucccacucucuggaggcgccggggaagcgggacuauaaugggcccaaggcugagggaagagguggcucuggaggagacagcuaccccggcccgggcucuggaggcccccacaccucccaucaccaccaucaccaccaccaucaccaccaccaccagucccggcacggcaagaggagcaagagcaaggaccgcaagggggaugggcggcaccaggccaaguccacaggcugguggaguuccgaugacaacuuggacagugauagcggcuuccuggcgggugggaggcccccuggggagccugguggucccuucugccuggaggguccagauggguccuaccgggacuugagcuucaaggggcgcucgggcgggucggaaggccgcugccuugccugcacuggcauguccaugucacuggauggacagucggucaagcgaagugccuggcauaccaugauggucagccagggccgggauggauacccgggggccgggccaggcaaggggcuccuggguccggagaccaaggccaaagccaggacuuaucacuaucugcaggugaggcuuuuuugggguuggggaacagaguccuuagccuucaccagucuugucaacuagggagcaguggaaaggguugggugggagccagcugucccugugauggagggccuggguguagggaggcucugcccugccccauugggucacucugagcuccuuuggggcuucacuuuccccauuugugcaaugaaggggcccuucuguucuaaugaugugucugucccuagagauuuucccuugaccuacuguuuuggacaggcugugcugauaucugucuucggagguuggaggcauaaugaaguugagggcaggcaguagacaggauagagaggugcaccuuaguuguagcugcucucaagauugaaggucggcaguuggaaagcaguucuccugccccaaagccuucuccagcccucuuuucugcuauaauccggauggcccacauguuugaauaugaagaucaguuauuucuagaaugugccucugcugagguuugucauuccgggguaccgguggugggacagccgaagcuguggagggguccugggaguuucaugugucucauguguuuuccuaggcugggggacaaacuggguuucagcccugauacaauucaggcagggccucccgggaguggauggugcaggugauagcuggcaugcuguucucaucuugucuuaccacauuuauggucucugcaggugaggccaggaacucugauuccuacuuuuuauggagccuucaccccagccucauccagcccacaucguuuucuuaaguccugccguaauuuuaggagaaaaagucaauacaaguucuggagguccaguguauuuccgcauucgacauaguugauacagaucuauuuauucaaugagcguuuucugggugcuguggauacaaagaugaagauacagaugcugcuugugaggagcucacaguguagagugggaauagacaaggaagcagauagaauacagugugaugaggcugugauaggggagagcccugggcaucuugggaacacagaggagacaccucacugaccugggugaggaauguccccugagcugaaucucaguggaggaguugcaguuguugagugcuggcuaaacguguauugggaagagacuauacagcauguucaaagguauggagaauagaggcugugugugucuuuguggggcauuggccuugcuggguaaguugcacacaaguuagggcucuccuggagaacucaugaaggcccaagggagcacauagggccacagugcaagcaagaagggacuucuggauuggccugguuugcccccucccuggguagggaggugcucuaagcugggaacugcagggugcagggaggcagcacccauccuuucucccccauagccgauuccuugccaucccugaagacuuguugccauuucgcugcucccugcugcugcuucagggcugcccugaccucccugggggcuuccuuuuuaacaugcaccucacaguguccugcagaggagcucugcaguggcuagaaugggaacccugcaguauggccuucccaucugcuggccugccucucuccaccugccugcugcucucuguagagaauggggaaggggaaugaucccuccggucuggaguuccagggcaucugaggacugggaagucugagcccauguggggaagaaccaaagggcuauagggacccuccagacagccucgcacuccccugguacaaaagcaggggaggcuggccccaugaggccaggugucuuugcuggacucccgaucugauugucaaagcccuguuucucccacuggguaccagcuuucucuuaagccuuuuccaggaucccucuguccacucugagccccuguuucuuuauggagccucaucucuuuguuucccaucauccaaaugagcccuagccccuugaagagcccugcuccugcccguggguuccuucaagggaccccaucucauccccagagucuccaccuuuccccugaacccuaugcugucccugaggcguuaccccuuuuggagcucccaucccuaccccauuuaaccuguucuuuacacaaguguuuuaaauccucccuaccucccccaguccucucccccacgucuucacuuacaccucauuuuccgaaguguaggcugacaucacggacucccucagcuuccugacagcaucucucuagacgcauccaaauucccagccacccucguccccuuccuuggcucauaggaaaagcugggaccacccaucccaggccgauccuucuuccagggcuugaucccaucucaucaugacccccuccaucccugaacuguucucccuucugagguuuaaagacuauuuuuacuggcucuuuccaucauucugaaaacauguccaaagucgcuugcauccuaaaaaauauuucugcagccccaucccaccuuccauguccuucauaaucgaguucuuagagcauagacaccuacucuucacuucccuucaauucuccccucacuguggucugauuuccaaacucccugucauugacauguccuggcaguggccacagaugaucucuugagcgcuaucuucaaaagcuacuuuucagugccuauaauaauuguuaccauuuauugagcacuuucuauguccuggaaacucucuauuggcucauuuaucuuugccaccaacccucugauguaggcauaaguaucaugaccaacucgcagacaaggaaacugacacuuagagguuaaucuguuuugcuuaaguucaccuauccagcaagugauggggccagaauugcacauggaucuucuaauucccgagccugaguuacuaaccucugaacgcacuguggcauuugacauaaucgacuccuuuuauucuugaaaugucuccuguuucuaugacauggcauuuuccugacuucccuccuaccccucugcccacuccuucucaggugacuucacaggcuccucuuccuuucuucacagucccuuuuuaaaugucaguggaucucugcucaucucucuucuucucuccccugggcugucucauucacugcuauggauucagcugccgcccaugacucccacauguccgccuccagccccgaucuccccacugaaucccagaaccaaacauccaaccaccugcucaacaguucuaugccaagcucaaggugcucaaccccgacccuaccaccuuuccccagacuuguuucucugggguucuauggcucagugagcggcagcacccucccccagguccucagccagcagccuggcagucauccucgacuccucccgcccccucaucccccacgucuaaucaggcucacugaugcuccuuaacaccucucauuuccaucuccuccucuucccccucauugucauugucuuaauuuaggccucaucaucucuugccuggauaacagcaucagccuccuaauuggucguccucucgccacuugagccucugcccugcuccuggcccuccacaauccagccucuguuuggacugugggagagcucuuucugcaacacaaaucugaugucacuccccugcaugaagcccucuguggcuccccacagcggggaaggagagaggauuuggaauguaagcagguugaaaggaugaaggagaaggagggguagaagguugacugaggucaggugaugccugacugcugggcaugggauugacacaggucacuuuggccucugaucaucaaccgcuugacgccugccaugucacucccucagacucucuagguggcccuuaauuaagugcagaaggucuguggaggaugacgaggugucucuuguaagggacggggacagccugagacccuaccuccccuucugccucugcauguaccugagugugccuguucaagccagggcagggcaucucccacuggcaguggggaaagaguccuggccucuagauuuacuagggucaugucugagagacagagaccccuguuccugcaggugccgcaagaugacuggggggguuaccccaccgguggcaaggauggggagauccccugccgcaggaugcggagcggcagcuacaucaaagccaugggggaugaggagagcggagacucagacggcagccccaagacaucucccaaagcagucgcccgacgcuucaccacccgucgcuccuccagcguggaccaggccaggaucaaguaaggacagggagggccggggggugcggggucaggaggcugaugcuggacuccugcgggagauguguguagagugggugccagucagguaguccugcuuagguuucaacuggggugucucacuccacuccauguaaagggagggucuuggugggaguccuucucuggugccucuuugggagucucuuuacccagggucuccuaagggaucucucuuuggggguucugaggaauaggacuuacucaggggccccagugcuauuaucuccccucccccaccuccuagcaguccacuguucugacuccggaauuuugcccuuuuccagcugcugugucccaccccggauccacccccggagcuccaucccuggcuacagccguucccucaccacuggacagguagggagaggcccaguaugccuggaggaaagagugaaaaagggauucagucccaugcucagcuuaggacuuaaaaucagagggucugccuguggagagagcucaggccuggcucuggggaaacugggaaaccugccuuaggacuccuggagcugacucaggcugggagucucagagaaucacagccuuaaaacccaccaaguguccucaaagugaugagcuuguaagggcaacgccagugcccuggggcucuucacaggccugauugcucccuccuugcccccauguaaaagguaggauuggccgggugcaguggcucucgccugugaucccagcacuuugggaggccgagguggucggaucacgaggucaggagaccaagaccagccuggcuaacacggugaaaccccgucucuacuaaaaauauaaaaaauuagccaggcaugguggcgggugccuguagucccagcuacucgggaggcugaggcaggagaauggcgagaaugagccgagauggugccacugcauuccagccugggcgacacagugaggcucugucuuaaaaaaaaaaaaaaaaaaaaguagaauugauuuguacagacagggcgcaggccaagcugcagccucagacaugaucugggccugaauucugccaccuuaccccucuguccugaggaaccaccagcaagagaccuuacuuuucaacaccuccauuucucaucuuuaaaauggcaaugguuagggacaguuauuuugcagggguuuuugagaguucagugagaaaauguaugcaaacacaagguacuuggcccaaaaauggcauuuuauaaaugugaguuccauaucuaaguguagacuuuccccuuaauuagacggaagcagcagcauuuagugauuaaacacaugagaugggguugaauuccagcuuggcuacuuaccagcugacugaccuggggcaaguuacuugacuuuuuuugagccccacuuucccuuuuuaaaaauaggcaucauaauaguguucuuggcacauagccagcacucaauaaagguuagcuauuuuuacuguaugcuggggaaaaaaugcaaugcaaaagacuguccacguuggcucucauuguucacugcugcagucucucaguauuccuuuguuccauugccugaaccaggaaaucugauuggcacagcucucuuuuuacaucagaccagccuauguuguuaaacccacgaguuaaugcuuagcccucauuuuaccucacccaucagccacauguaacacaguugaagacuccuuccuuccugaaagacuuuacuugguuggcuuggaggacaccacacccucuacauucuccuagauucccucccuggcugcuuauccucagucugugucuugggugccucuauaacuccccaggaucuaaacacuggaguuuucuagggcucagucccuggacuucucucuauaccuacuccuuaggugaucuugucugggcucauggcugagagccugaugacuaccaaauguauaucuccagcccaaacucucuuguaaaugccaggcauauaugucuaacuguguauugaaaucucauucggauguuuaguagacaucucaaacuuaagauguccaaaacuaaacugcugauacacacacccuccacaauccccucccgccccuggcugccgcaguugcugcucuauccucugaauucuccauuucagauaauggcaacuuuauccuucuagaagcucugguuuaaaagccugaagucagucuugaccacuuucucucucucacaacucaccuccaauccuucagcugauccugcuggucccaccuuuaaaauauauccaggauccaaccacuccucaccaucuccacugccaccgguucuuccaggcaccauguccuuuugucuggacgauggcacugccuuguaguuggucuccuguauuugcucuugcuccacuucauccucucucauuacagcccacaugaucuuuaaaaacuauaaucacacucgcucuucuguucaaaacccucacguugcucagaguaaacaucaagaaccuaaccauggcuuucgaggccugcaugaccuggugaccucgcuggaguggagcugccucugaguuccucuccuaaggcuguuccccucccucccacuccagccacacuagacucccuagggcccuugcauuugccacuaccuuugccuggauguccccuucccagccacucccauggaucacuuccuaacuucuuucaggucuuuucccaaaugcccuaaaauuuuaauuuaacucucccuuuccaacauuuccuauuccccuucccuguacugucauuguugaggucuucucugucuucuuccuccugcucuuucuccuucuucuuagcacuuugcauuaucuaacaucacauauacuugacauauuuagccuggagguauggcuucuuauucuugcuuuauagaagaugaaauaaguuuaaagcacuagagaugucacccuauuaugucucauaauacuuuuuuccucuucagucuauuuuuuuuucguuuaguauuugccuaaaacaccuuuuuccaucuuuuacuuuaaagcuuuuugucuaugucucagguauauuuuuugaaaauaguuauagcuacauuuuaccuauauccauucugauaauugcuugagaguuuaguacauuuauauuuauugugauuacagauuaucugugauuaccccuuggccuaaaccuaggguagugugaugacccuagcccuaacccuuggguuuauuucugucaucuuauuuugugccuucuauuuaucuugccuuuggacuggugcuuuccugcuccuuugcugccuccuuuugguuugaguuuucuuuauucuucuccccaccaaaucccacacugguuuaauaguuauauauuguauuuuauucuuugugguuacccuuauaauuuucauaugcauauuugacuuaacgucugaagcugacaguuuuuucugugcuccuccuaaacaauacagagaccauaggacaguuugauuuugugugugugugugugugugugugugugugugauggagucuggcucuguugcccaggccagagugcaguggcuagaucucugcucacugcaaccuccaucucccggguucaagcgauucuccugccucagccucccgaauaacugggauuacacgugugcgccaccacaccuggcuaacuguuuuguauuuguaguagagacgggguuucacuauguuggccaggcugguucccaacuccugauaucaggugauccacucaccuuggccucccaaagugcuggguuuacagacaugagccaccacaccuggccgacauucugauuuugaugaccucuucccuucuuguucuucuuuuuuuuggcaacaaaaauuuauuuucucacaauucuggaggcuagaaaucugaccaaggugucagcuggagugguuuccacuauucaguaauuuguauuuuuauauuuuuuauguuguuguuuggagaacaaaacauuuuaaacuugaugaugcauaauucaucaauuuuucucuucuugauugugcuuugguguaaaauuuaagaaaucuuugucuaaugcaagaucacaaaaauuuacucuaauauuucuccuaagaauuuuguaguuuaacauuuauauuuagauguaugacccacuuugaguaguguguguguguguguguguguguguguguguguguguaugugugauucaaguuagggguccagcuuuauguuuuugaaugcggauauccaauuuucccagcaucauuuguugaaaaggcuuuuauguccucauugaaauuucuuggccccuuuuucaaaaccaauuuaccauaaaugcauguguuuauuaaugaaccuuaaaauuuauuccauuggucugcuugaaccuaucuuuaugcuauuaccacaugcuuugauugcuguaacugugugguaaggauugauuuugguaagcugaaauuauacaauuuuguuacuccuuuuaaagacugcuuuguguuuuguguuuccuuugcauauacacauggauuuuggguaggcuuguugauuucuauaaaaaauauaguugggaauuugaagggauugcucugaauguguagauuaauuuauggaguauuguauucuuaacaauauuaaguauuauuauccuugaauauuggauguauuuccauuuauucaguucuucuuugauuucuuucagcauuuauuuuacuuauuauuauuauuauuuuaauuuuuuuuuuuuuuugagacagucucgcucugucgcccagguaggagugcaguggcaugaucucggcucacugcaagcuccgcuuccuggguucacgccauucuucugccucagucuccggaguagcugagacuacaggcgcccgccaccacgccuggcuaauuuuuuuguauuuuuaguacagacgggguuucaccguguuagccaggaucgucucgaucuccugaccucgucauccgccugccuuggccucccaaaguucugggauuacaggcaugagccaaugcuccuggccuauuuuacuuuuaauuuuuauuauaaauugacaaauuguggguguauauauuuaugggguauaaaguaauguuaugacuuaugaauacaauauggaauaaugaaaucaagugaauugacauacccaucaccucaaauacuuaagugaucuuaggacacuuuaauuuccuugacuucuucccuucuuauguggacuuauugcccaguauuuuaguucuaccuuuuaaccugucaaauuagucucuauuauuauuguuacuuuuuauauuauuagcucuugauuguauguacucacaucucuaccuuuuuuacuccucacuuuaccuccuuacaucucauuguuuccuccuaaaguauauucuuuaguaauuuuuucagugaauaucuguuaguagcaaacuuggacuuuaacaaaaaauauauuuuacccauacuguuugauacaguuuagcuuauugugggaauucuagcuuaacauuuauuuucucuaaguguuuugaagauauucuuuugucaucugucuguuguugccguuaaggagucugcuaucauccugauugucuuuguagguaguuuuaauuucucucagguugcuguugagaucuugcuuugauuuuauuguucugcaguuuugcuaugauauauucaugugugugcuccauaggucuguggauucauguuuuucaucaauucuggaaaauucucucaugguauaguuugcauaguauaucuuuuccccauucuuuuacuuucaacuguuuguguuucagauuuaagguaugucuccuguagacagcaucuaaugguuuuuuuuuuuuuuuugcuuuaucuuaucacuaugccuuuugaaugaguguuuuuguccauucauguuuuauuuuauuuauuuaauuuguuuuugaggaagggucuugcucugucauuaagcuacaagguaguggugugaacauggcucacugcagccuugaccucccaggcucaaucaauccucccaccucaguuccccaaguagcuggaacuagagacacauaccaccaugccuggcuaauuuuuguauuucuuguagagauggggcuucacuauguugcccaggcuggucucaaaacuucugagcucaagugauccacccaccuuggccucccaaaguucugggauuacaggcaugagccaccaugccagaccuucacaucuuaaugugguuauugaugugguuggacugucauauuauuuuuugauccucuguuccuucuuuacugucuucuuuuguauuaaaucaauaaauauuuuaguguaccauuuauauuuauuuguuaauuuuuuacuauacaauuugaguuacuuucuuagugauugcacuaggaauuacaauguauaucuuagcuuaucaaaauauaauuaugguaaaauauaggagcauugcucuaauauaacucauuuucccccuuuuugcuauuacugucauauauuaccuauauauguuuuaaaccuaacacuuguuauaaaccaacauugguauuauaauaagugcuuuguguaaucuuacaucuuuuaaagaaguuaagagaggaagugaggaaaauauauuuauagaggcucuuguauuuacucacauauuuaccauuucuggugcucuuuauuucuucuucuguauuugaguuaccauuggcuauuacuuuauuuucccuuuagccugaaggacuuccauuagugcuucucauaauauaagucuccuggcaauaaauuauucagucuacauuuaucuggaaauguuuuuauuuuuacuucaucuuggaagaauaguuuugcuggauauaaaauuccuggcugacaguuauuuuucuuucagcacuuagaauauaccacuccacugccuucugguguucauuguuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccaccucggccucccaaagugcugggauuacaggcgugagccaccgcgcccggccguguguucauuguuuuugaugaaaagugaguuguuucccucuaugugaugaauuguuuuucuugugcugcuauuaagauuuucuguuuucagcuuucaacauuuugacuguaauuugugugaauauagaucucuuaguguuuaaccuacuuuagguucauugagcuucuuugaucucuaauguuuuuuguuuuuuaauuaaauuugguagguaggcacaguagugggcaccuguagcccuagccacuugggaaguggaggcaguaggauugcuuuagcccaagaguuugaccuguagugcacuauguuaugauugugccugugaauagccacugcacugaagccugggcaacauagugagaccucaucucuaaaaaaaacaaaaacaaaaaacgagaacaaaaacaaaaggaaaguuuuuggcuauugucucuccaaauauuuuuuucugcccuaucucuuccuuuuccucuuuuuuuccccuccuccuucuggaacucccaucacaugcauggugcuaugcuugauguugucccauaggccucugaggcuguguucauuucuguuuaauauuuuuucucuccauuauucauauuggauaauuuauacagauccaucuucauguuuacugaucauuuauuauggugagcuccucuacugaauuuuuaauuucaguuacccuacucuucagcuccagaauuuccauuuguuccuuuauuuaaucucucucucuuuguugugauuuguauucaugaagucauuguugucaugcuuuccuuuaaaucuuuaagcaugguuuccuuuaauucuuugauauauuuauaauagcugccuuguagucuuugucugauaaaagcaacauuuggggauaugcauaccuucuuguuuauuugcauguuucauaauuuuuuguuaaauacugaacauuuuagauaauauauuguaguaauucuagauuauguuuuccucuugaagauuguuauugcuuuguuuguuaaucccugaaugaaaucugugaaaucugucuucccuacaacauguggccucugauguuuccauucaguuuuauuuccuucuuauuuuuauuuuaagccuuguuucuuagggguuucccccauaucugcauagcuuaguguucagccagagauuuuucggagguugugcucaagaaccucaagcuaguuagacuuugugucugccuauaguucuaugugugagcuggggagggcaaaguucagguuguuuucaaaccuacccuggcuuuuacucuucaccagacucuuuuauuuccccugcacacauauauaagcuccauuggcuagggauguguggguggcucaggcuucucuggucucugcugugcauucacccagcuucgaguuaacccaagauauguggagagcuuaucaaacucccuuggucugucucacucccuggaauuuucugauaaauuccugguuaguuugccaguccauuguuuggcccaaacauugcugaaacccagccuaacagugcuucuggccuuuccuguucuugauauuauaacugacaaugccccaaauuaaguggagcccucuggcagaggcagugaagcagcugauuuuucacaggcggcaccacguuuguugaaguauugcaacugauagcauugggagccuggugaacgagagcagccucaggcaagaauacuauagagucgugcuauucuuacccaaaguccaguaauuuuuaugaauacauguuucuuuguuguaugucuuugauugauuugcagagugauaaaaugguggguuuugacaguuuguccugcuuuagagucguauuuucuucuguucucaguuuuaucuuuuaagcuuggaacuuuuaaacaucauuuaaaaguuauuuuauuuuagcuaagguagcacuggcugcuuuaacagagaaaucuugaauucucaauggcuuaacucaauaaaaguuaguuuuuguuuaugucacaauuuguauuuucuauugcuauguaaguuauccccaaauguaguaucuuuaaacaacaaauauuuauuaucucacaguuucuguggaucaggaaucugagugcagccuggcugggugcgacugggucaagugucucacaaaguugcaaucaagguguuggccaaggcugcagcaucucaaggcuucacugggugaagaucugcuuccaugcucacucacauggcuguuggcaggcuacagauccuugcuggcuacuaaccagggacaucaauuucuucuaugugagacucacuacagggcuacucacagcauagcagcuugccucccccagagcaaaggcuuugagagaaagagaauaagaaaaggugucuaagauggaagccacagucuguuuguaaccuaaucucagaagugauaucccauuguaucugccauauucuauucauuagaagugggccaauaagucugguccacacucaugagaaagggauuacacaagggugugaguuccaggagauggagaucauuaggagcuauuucagaggcugucucccacauaauacacucaccuucaauggaaauuuaucugugagaagcaugagcagcuuggguuaggagugaguuccccaggaaauauuuugcaguugcuucuguuggaauaugccugguuuggaacuauuuuaugcuaauuuuuaauuuuagggguguggcccaugaagguucaugcagauacacuguaccguggcugugugaggaccagcuuguagguacagauucuuaggggauuugccucuuuucccuucccgccaucccuguacuucagaccagcuuccuugucaucagccuguggugaugacuaauuuuuuuauucuagucuacauuuucaucaaagguuucacuuuuccuaacuuuaugcagguucuccuuuccaauuccacgcuucaugugggcccaaagccuuccuccuaugcccaaguggguguuaaaaccuaagccuuuaccaaaacgcugagaccaacagccccugcccccaccucccgccuccacugggcuguuugcagcauuggcucacacaguuaauauucugauuuuccagucuccucuuugcuuuuguccccuggggacuuaucucgcuuucuugugagcucagcuaugcauauaaagcaacauuuguuauauuucauccaauguuuugaaaugggagaguuuucuaaagguuaucuaaacuaaauaacacaaguaaaguauacacgauguugccuggcccccuguuggacccaccaacucuagucuggacaauuuccaauuagacacaaagcauuuuuacuuuaaauauuucaugagcuuggaaauggcuacugauuccagucugguuuggagaaaggcuaaggaucucaucccaagaggauucuuugacuuugagucuccuguaaauggauguugggggaagcaggguggaagucagugcagggauaauaggagcauucacaguacaauguuacaguuuuauaacuguaggauaguaaagaucaacauggguguaauauuucucugagagucucugaguccguguuucccuuguguccuggucuccuguuggaaccccagaagcuccucuuggccagcugagcuggcggguguaugaccccagggaguuguucaccuucuuuugucugccuuggauagaauugguugugaguauugccugugggugggauuucaagagcugcagaaccccagggaaagaggcacuucucauucugagugguauugucacugcgauuuaagagccucuuguugcuaauaauaguagcuauaguuuauugagcaucuacugugugccagauauuaugccuagugcuuuauacacagaagagggcuagagauacagaaauauacaacagagugagauuccuuucaucccuggugucuggacucgagaccagugugcuuucugcuaggguuagauuagcuccccugugcuccaagagggacacucugggcugcauuuguucuaauuggggagugucuugagccuagcccagaaauagcaggaguuaguucaguuccuguguuuuaggaaauacgcuggcaacuguugucuuuggugccccagaaauacagagacagaaagacugagagguagaugacagagcaucauggugaaagccacaacugucacacaaguguggcuugugucagucaaauaugagagaacuuaacuucugcggggucuuggauugauuuuccauggccugggauuuccauacacuuguaaugaagcuccuuuagaaaaagcuucaaaaaguucagacaauccuucuuuucaauuaguaggcccacauuggaaccaacgaaucuaaaucuccagcaaauuuggcucugagcuucuaagcagccaaagcaagagagguguuuuguuaaccuuggguucagauccuugggguggggccugaguuaauguagguuuaacaagcuccccaagagaaucuguugcucagucagccuuacaugggagccaggaagcaugacauuuaauuucaguuuuaucaccuaccagcugggcauccucagacaauucaccugcccucucugggucuuguuugcccauuaguagauuggaauagaaauggcucuauuugaaguagaauccagugaaaucauguuaugcuuuggaggcugaauuauggaaacacugagcugcaguuuacacauggaucaggccacuccuuugagccucuguugacugcacguaaauauaaugccgugaaucuuuccugggagaugucacaagaugcagccaugugauacuugcuguuauguuugccaugggaugcugucgaggaccuuauccaugacuucauccaauggacucuacauaaucauccacaggggaugauugucucuuagucucagggacaggaauuguugugguucucaugggcaucuggccuguguuuaccagggaggcccugagaccuucgcaugccgcuagccgagggcuuacuaugugccaguaccuguaccaaaaggcucacauguuuuucuuucaguccccucaauagcccuaugaagaugguaccauuaucacucccauuugacagcugagcaaacugaggcccccaaacuuuaacuuucccaggccauucugcuaggaagugguagagccagcacuugaaucuaggagaagucucacgcauagcccaugcaggcaacucugaggcuauacucccugaugcuuugccugcuuggaagcucaggguuaaacaugugcccaucuugagcaauguucaggacuuugucaccuguguucuggguguagcacuuaccucggguagcaccuuuuccugccuuuacuuuuucuuugcaccaguucucucuuguaaugugaaugaagcugcaaccucugugguauauuuagucuucaugugguggugugcggcacaguuccaccaacaaaauuuuuguuuugcuuuuuuucauacuuuaacuuuuuuuuuuuuuaacaccauggauucugcaccaccaaaauacgaaaaacaaaaccagaaccucauccagcaauggcuaagcuuuccucagugggggaggguagagaaggaacccacagguuaagccagaacccgagugaguggauagaagguuggggaaggcaagggccgggugcgguggcucacgccuauaaucccagcacuuugagaggccgagacgggcagauuaugaggucaggagaucgagaccauccuggcuaauacggugaaauccugucucuacuagaaauacaaaaaaauuagccgggcgucguggcaggcaccuguagucccagcuacuugggaggcugaggcaggaaaauggggugaacccgggaggcagagcuugcagugagccgagaucgcgccacugcacuccagccugggcaacugagcgagacucugucucaaaaaaaaaaaaaaaaaaaaaaaaaaaaagaaggugggggaaggcuugggacacugguagguuaauaacuuugcuccaucacuuacgcauuaguuuccauccugccaguugguauuuuauauauauauagcauauauacauguaguguauauauauaguauauauguaguauauauauaguacauguauguaguguauauauauacacagagcuuucaaucaauuuuguaauguaauggauuauaaauaauaaaagauguccuccaugaaguccccacccccauacugggcaggagggugcaugccaggucccugguccucucuguuggggucaggugagagaaacgucaggggaugggacuagguggagagaaaaacaugguggucugcagucuggagugcagccagccagacaccuggaagaggcauaggugggguggaggugggggugggggugggauauuuagaggaaagacugggccccaagacaagccuugggagcagaguggggcagagaugcccccaucuuucuuugcaaagaguuagaguuucuuuuaguucaaaugcggaagagucgccuacagccucugcagauauagagaggucuuccccuaaggcagagcaccccagggacuuccacccccucccggcaccuuauaacuguccucccgacccccugccccccagcucagcgaugaguugaaccagcagcuggaggccgugugcgggucgguguuuggggagcuggagucccaggccguggacgcccuggaccugcccggcuguuuccgcaugcggagccacagcuaccuccgggccauccaggccggcugcucucaagacgacgacugccugccccuccucgcuaccccugccgcugucucagggaggcccggcuccugugaguacaccuuccugccccuggcccggcccuaggcaggagagcgcccuggguccggguucuggccucccccucgacugugcugugacccgcgcagaucgcucgcucccggggucggaugacggggagagcguccguuggcgugugugcagcagcauguggagugcgcgccgcugcagggucccguagggccucuugagggugggagucgggcgcgggcccaggacccaggcagggccgcgagccucacccacugcgucucugcgcucgccggccacagccuucaacuucagaaaggccccgccccccaucccgccgggaagccaggccccgccccgcaucuccaucaccgcccagagcagcaccgacuccgcgcacgagagcuucacggcggccgagggccccgcccggcgcugcagcuccgccgacgggcuggacggccccgccaugggugcgcgcacacuggaguuggcgccggugccgccccgggccagccccaagccccccacacucaucaucaagaccaucccuggcagggaggagcugcggagccuggcgcggcagcggaaguggcggccguccauuggggugcagguauggaacggggaggcgcccacgagggcucugacccuggucggucggggcuggggugaggggcuggaagcggccuucuggauauaucgacauucuuucuggcuugcccugagcugcaagugaaccccgugccuggacaucgacggggcugcuccagccagcccccgcccacucccucgucccucguccuggcaccaucgccccuccugacuaauggagggcuggagggcugugcccagugguugccacuuugaggccugugaccgaccgccugggucucucaucuuguucaggcagauggucuuugcaggaccugccagcuggcuuggggcgcagccauugcuagccguucuccccgggaagggcuuucaccuuggcucgccacagccacugacuccuccacccugccaccagguggagacgaucucagauucggacaccgagaacaggagccggagggaguuccacucuauuggcgugcagguggaagaggacaagagguaaagucacggugggagugcccaggcuucgcugggagacaggaggagagagggcugcauaguguccccacuagcccagucucccugcacauccucuuuuccuggaagugagaccaagccuuuuuauagaggguggucagagcagccacaggggcuguuccauagagaugucaccagaggagucaucaaaccuagaguucuugugcccaugcccaccccaggugcucagaggcagacgggagauacacagcaguugcagggaaggagaggaugggaaagguuacauguaggugccgagcaggccuccagcaauuguccuuuccaggggaugauaggaucugccaaucccucauuacauccugugguguacaaguaugugagcucaaaaagaaacaaacgggaagauugccucucaggagccccuggcagauauaacacuccuccucacuuggcucacacaagcauuuaaccaguuggggguaccuauuacaugccugagucugugguguaccugagauaguacaauuagcagcagccacuauucuggcauuagguggccucagaaacauugacuccuuaauuuucacugaagaauuagcauugccagcucuggaggggauaccagaaagaggccucucuguuguugggugccuauggggagaaagggugucugggagcuugccaggggcuggccauaacgguuucaugguaucugagcuucccaggccauacgacuggaggaauaaaacuagugucccaggccaggugcgguggcucacgccuguaaucccagcacuuuggaaggccaggguggguggaucacuugaggccaggagcuugagaccagccuggccaacauggcaaaaccccaucucuacuaaaaauacaaaaauuagcugagcaugguggcacacuccuguagucucagcugcucgagaggcugaggcaugagaauugguugaacccaggagccugagguugcagcgagcugagauugcaccacugcacuccagccugggugacugagugagacuaucucaaaaaaaacccaaaacacaaaaaaccagugucccacuagcagugguuccucgcagcucuguucccaguugcuguccuucgcccagauuuccccagcuauuucugggauguccuugggaugucuuguguuugugccugaugaaguuuuuuugguguuccuaugggauucaccauuuuucucaacuucugauuuggcucccugaaguucugugugcuccuggggcuguaaaugccuucaucgaggguggcauaaugcugcccugguugccugcaugacuucuaaaccugcuguucaccaaacuuuuacugugccacaaagauuucagaaaaauagcauuuuauggcaaacccaauuugcaaaucugugacuugaauuauugagagaugggguaggagucauggauggaugcaacucuauguucugaauccuacccacccccaauucuagugcuaucccauggaccaccaagcccacucacucccuuuagaggcuuuuugguuccuugucuagauagguccagggggguggggguuccccacauuccuccuaauaacccuugaauccugggaagagugcugcaggccuucuagcugagacucuugcuaaaucagcaaacucuugucauugauugauugauucauucauucaucagauacuuacuaagcacguguuguaugacagcuccuaugcacuguguuaaaugcuucaggaaacaucaaagacaugacuucugcccucacagaagcuauggucuagagggaaaucaaggcaaugaauaaauaauccuugaauaaaaauaugacaacacauuaugauauaauagguagugggauuuuauugcauauuauguaggaauaugaaagaaaaaggaggagauaagagagaagaagggaccuuauuuagauuaacaggugacauuuaagcugagacuugaggauugacuaagaacucucaggugaugauuggaggaaaagcauucaggggagagggaauagcauauguggagguguuggggcaggaaagaguuugacaugcaucgggaacugaaagaagguccauguggcugguguggaguggggcaggggagugggaagggaguuaauuggagaacaggcaggggcagguuaugcagagcauggacaugauaaggaauuggaaucuaauuaugaguaaugaguagccauguaaagguuaaagaaggagugcaacaugaucuaacuuauguucaugaaagaucacaagcugcugaguggagaaugaauuugaagaaagcaauaguggaaacgagaaggcuaguuaggaggauuuuucaugauccagaagaaaggugauuguguuuugcaaugugguggcuauugugauugggauguuuuucuucuauugcauuuuacaacuaggcacugcuagugugugguagcacuguuagguuuauuuauuuuuauuuuaauuuuauuuuuuuugagauggcauuuugcucuugucguccaggcuggagugcaguggcaugaucucggcucacugcaaccucugccucccggguucacgccauucuccugcuucagccucucaaguaccugggauuacaggcacccgccaccacgccuggcuaguuuuuuguguuuucaguagagaugggguguugccauguuagccaggcuggucucaagcuccugaccucaggugaucagcccgccucggccucccaaagugcugggauuacaggcgugagcuaccacacccggccucuacuguuagguuuuguauguuuuguauguugauuuuguauucaguaacguugcugcugaauuaggucucucuuauuagucucauagguuaucugaaaaucaugaugggcuuccuauauagucaguuauuuuucugugaaugaagauauuucuuuuaaaucuguauuuucauuuauuuuucuuguaauauugcauugaauaggacuucuguucacuguucaguaguauugacuuuaguggcuauguuuuucaagaugauguuugcuacaaauuuugauggauaccauuugucagguuaaggaaauuccuuucuauuccuaguuggauaagcaucuuauuuuuauuuuuuaaaauagaaaauaugagugaaauuuuauugaauguuuucucagaaucuauuuagaugaucauagauuuuucuccuuccauguguaacauggugaauuauaugaaugaauggauuuuccauucuuucauuccugggauaaacccugcuugaucccauugucaguuuggauuaaauuuggcugugagucacagggccucaguagugucuuaaacaaguguauuuuucucucacuuaaaaaaaaaaagccagcuuagauguagggagugcagugucagaacuccaggcuccuucuauuuuguacaucacuucaugucuagggaccuuaaguucaagcucccccagucaugucugcauucugagcagugagaaggaguaaagaggaagagggaugcaguccauccuuuuuaaaaagacuuccugcaaguuacacacaaccaguuucaucacauuggcuaaaaucucaucacaugguggcaccuagcugcaagggaggcugugggguauagucuuuuagcugggaagcaauguggaggguguaaacuacauagcuaagaaucaggguucucaugacuaaagacaaagaauagcuauguggagcucuagggguuuuuguuacaguuuugcuauauuauuuuuauauacaguauuagauuuuugaacaguugcuacuuuaaaauuuuaaaucauuuagauuuaugaauguaucauaagugauauaucauaauaauuguaagccuacaauuuuuuacugcuuuucaauucagguauuagagcuaagauaggcuccuaaaaugaauuugguagguuucucuguguuuuuguucuuuggaacaauuuguguaagacaagacuuaucuauucuuuagguuugguaaagguugccuauaaaauuaucuaugccugaugccuuuuggggauaggagagacuuuuaaaacuacagcuucaguuucuuuagugauuauugaccuauucugguuuuauuuuuuuucuugaaucauuuuggugauuuauauuuuauuuaaaaaagaaacauaagaauugacaguuuucaaaguuuuuggcacaaauauucuuucucauaguauuaaaauguuaucaauauuuauugcaucucuauauugauaucucccuuugcauuucuucuucuuuuuuuuuuugagacagagucucacucuggagugcaguggugugaucuuggcucacugcaacuuccaccucccgaguagcugggauuacaggcaucugccaccaugcccggcuaauuuuuguauuuuuaguagagacggguuuucaccauguugacuaggcuggucucgaacuucugaccucaggugauccgcccgccucagccucccaaaguccugggauuacaggcgugagccacugugcuuggcucccuuuuuauuuccaauaccauguauuuaugucuuaccucucuuucuugagucagccuugccugagguuuguauauuuuauaauuaaacauauuuuuaggcuagaccuaguaacucauaccuauagucccaguacuuugggaggcugaggugggauugcuugagaucaggaguucaagaugagccugggcaacguagugagaccugaucucuacaaaaaaugcaaaaauuagcugggcaugguggcaugcaucuguaguuccagcuccuggggaagcugaggcagguggauaacuugaacccauggguuugagggugcagugaucucugaucacaccacuguacuucagccugucucugagacucugagaccuugugucaaagaaagaaaagggggggaaagaaaaaaauacauauguugaaacuuacauuuuauucgucuuugaaaaaaacuaguuuuuuguuuuggugagcaaucuuuaauauuuccuuccuucuacuuuugguuauuuucuuuugucugcuguguuugucuuucuuuaugccucuugaauucaucccuaacuuucaauauuuuuuauuuuuuaacaugugcuguuagggcuauaauuucccuuauaacuauauccuuuuauggcuauaucucauaaguuuugggaagcgguauuuuuauuguacauauugaauauguaacuuucaucuuucaucacuuuugucguaauuuccuuuuuaaccuaugaauuuuuagaauaauuuuuuuuuuuaguuuucaaaugaauuuuuuugacaagggacagccuuuucauuauugauuucuaaauuugcuacauuguggucauauuauguaccuauuauauuuauugcuuagaauuuguugagaccuccuucaucauauguauauauaucauguaucagggguccccaaaccccaggccagggacugguauuuguccauggccugucgggaaccaggcggcacagcaggaggugcgcagcaggugagugagcauuacugccugagcuccgccugcugucagaucugcgguagcauucgauucucauuggagccugaacccuauugugaacugcgugcauauguaagggaucuagguugugugcuccuuaugagaaucuaauguuugauaaucugucucccguuacccucagaugggaccgucuaguugcaggaaaacaagcucagggcucccacugauucuacauuaugaugaguugaauaauuauuuuauuauauauuacaauguaauaauaauaguagaaauaaaaugcccaauaaauguaaugugcuugaaucaucccaaaaccauccccuacuaugcccccccgcagcuucuggaauuuuuuuuuuucuuuuuuuuuuuugaggcagagucucgcucucgccccggguggagugcaguggcgcgaucucggcucacugcaagcuccgccuccuagguucacgccauucuccugccucagccucccaaguagcugggacuacaggugccugcuaccaugcccggcuaauuuuuuuuguauuuuuaguagagacgggauuucaccauguuagccaggauggucuccaucuucugaccucgugauccgcccgccucggccucccaaagugcugggauuacaggcgugagccacugcgcccacccagcuucuggaaaaauugucuuccacaaaacuagucccuggugccaaaaagguuggggacggcugucauauauggucaaauuuauaaauuauauuuuucaaauguuuaucuuuuuuuuguacauuugaucuaucaguucugagagguguguuaaaaaugucucaccaugauuguggauaugucauuuucccugguaacuuuguugauuuuuacuucaguuugagagugugcuguuuauaagcauucaagcuuaugauuguuguaucuucuugguggcuuggcucuuuuaauauuaaauaggcugcuuuucauccuuacuaauggcuuuugccuugaagucuuuuuuaccugauuuuuauugcuauggcugcuugcuuuugguuaauuuuccaauacaucuuuuuccauccuuuuauuuucaaccuuccuauauccuuauguuuuagauguguugcuuauuuuuuuauuuuuauuuuuauuuuuuugagaugagucuugcucugucacccaggcuggagugcauuggcgugaucucagcucacugcaaccucgcuuccuggguucuaguaauucuucugccucagcuaccuggguagcuggguuuacaggcaugugccaccacaccuggcuaauuuuuuuguauuuuuaggagagacaggguuucgccauguuggccaggcuggucgcgaacuccugaccuuaggugauccacccggcucagccucccaaaguguugggauuacaggagugagccacggugccuggccuauauguguugcuuauaagcgauuuauagcuagaguuuagacauauuuaauccauguauauauuuuucauuacugacuugaguuuauuucuaucaucuguuuaaaaauuuucuaguugacaugcuuuuucuuugcuuucucccuuucuuuuuaucuuauguugaacugaucaacaguaaauagaguuuacuuucucuucuucacuccacugguuuggaaguuuacauuuuaguagugauuucccuuaaacauuugacagauauacuuaauuucauauuuuccuaauaacgucuaacauuagucaguacuucuguccuucuuaggcacaaaacaagaaucuuggaacacuuuaauuuccuucuuaaguuucuccucccaucuuccauguuauguuuaucuaguaguuugauuauaccucuuaaaaagucucugugaaaucagcugcuguuguaucuuuuaugcuuuaacaguuuagauuuacauacguguuuccguaauuuguguguucacuauuguuuuuuacugcccucuucuuucuccugguucaguuuccuucaugcugaagcacugcuugaaguuuuaaaguuaauaucucccuuugaggcuugagguuucuuguguuucacagguaauacucauuugaaccccacaccuccacacaaggaagccuucauguuccgauuucccagcauccuccuuccaggccacauuccugcaucccuggcaugagcguuuugaguccaaguuugcaaaugaaacagaccuucuuggcugccgacuuugcgcacagggucucuuuccagcuccccuugcugcgcagguuuggggucucuccucucauccucccucagcguuuucauccagccucuagcauaugucuggucugaucucccugugguucacuuggcuuagacccccucucacuauauguucuuugaauuuccuuccuguuucugauaccuggacauuucucauuccuauuuucaaacccagcauuguagcaaaaacaccuuuuugauuuuuaaaaacccagcauuucuaugcguuuagggugugagugggagcuuccuaaguuaauucagucuacucuauugaucaguggucuggguaaggcugauagcaguggauacagagagaagugggccaauuugagcagcauuuuggagugaaagucagggaagggcagggacaggcagagaacguggccuuccuugcucuuguguaagugcuuggugaggucuugauguggcgggcugaggagaggacaugguguugaauaagcaucgaaagaaccaaacugccugggacaggugaucacacugggaauucagagggagugacagguggggagaggggaaaucuggcccaucucuuuggccaggcucccuggccugucugcugcaggcguccuuagucauacaccugcacaguccuuucugucccuuaugucccuggcacuuuaagucugacuccucacacaccaugccccaacuggugcauaaaagcgagccaugaauuccagcagccucgccuggccagcauucaggccuggcccgccacacacagcccagccccauuuucuuugacucucuuguccuuacugcugucucgcucaucccaguaucuguuucucucucuguaauuugguuuuaaaaauugcugagcaggaaaggucucuucucuucugccuuucaggguguucccugcucaccucuugggugaggauuuuggacuuauugucccuucugucugggaauugucugugaguccuuccaguugcccagugucagugaugacuuggcuuagaauauaaggggagggggcuggcaccccuucaguucuaucuccacugcacacccccacccccccgccaagauucaucuguccacagauauuuauuggaucuguauuauuugccaaacacugugcugggcacugaggaugcaaaggugagcagaaccagagacagcuccugcccaugcaaagcuuaccacgaaguuaaucuaagaaucucauuaaugauguagccgcugugccggcugccacaaaggagcggcaugugagccaugacaguguagacuauggggcuuugagucugccagaggggucaggcauggcuucccugggaagugacauuuggguggagauccgaaggaugaacaaaaauuaacugagugaaaaaugggagauaagguuccaggcagaaggaauagcauaugcuaaggccuuguggugagagagaacauacuuaaucaguuaccagccgugucucaacauguccuuauggcaccuguuucccuagacccagcacacucugggccaugauaaaaggaugcaucagaugucuugcugaauauuagcaaggggcccucugaagucauagaaaaugggauuuuugccuccaacucuuucuaaccauagggaucugccuguaucuuccaccucuaauuccucccagacagaccuuaucuuaaauuguaaauuuagcaaaaacaaaaccaacaacaucaacagcaaaacccaccaaaauaaagaaacaaaaaccaccaggaugcccaguuaaauuugaugaucagauaaauaaugaaugcauuuuaguaugucacaugcaauauuugggacauacucauaguaaaaacaucuguuauuuaucugaaauucaaauucaacugggaguccuauauuuuaucugacaacccuacucauaccugcuugugcccacgaagggccaccuggagaacucuguggaggaagaccugccuacccuuuccuuaacauuauggucauuucuagcuuugggaguuugggaaggguaugugcugaaagaauggccccuugaggccugggaaagaagcuuccauacccauuaaguuauauuccaagaacaguccugcaaaagcaauaagaagcugacugcccaaagcccugggcacagaugcuaccuccauuccugagccugcaaauuuaggacgguuucugacugacccucaugacuccuccugaaucucccacccuagccccaccuuggcaucccugucacagcccccaggcuggagugguggguucagugaccccugcuugauuauauguuuaggcucuuagaugccuucacacaggagcuucuauagaagcuaguuugaaggcuaugccuaguugaaaugacaccguccuucccccucccugcccacucccccucccacccuuccugccugcugccaaauacuccuggcaaaaccucuugacaacuucuggauauagagcuuuccuuggauacugugucucuugggauaauccagcuucuacccagaggcuuuuauguuaucccccagagaaucacaguagaaacucucccugaaguagaaucgcaguggaaacucucccugaaguaaccaugauaacaacuugcauuaucaucaggaauguaaucauugucaccuuggagcacucaaagggaggaggcuucugcagccacauuuaaaggcuugggagaaaauauugugaaugcauuguuacgcauuaaugacaauucacagcugaagccaguuuuuauccugugcugacagcuguugguggagaccacagcaaauacugccaaauccaaaacuaaauagcgacauaagcccuuaacuucacuauucuaaaaauucaucuguuauaguuaggaguggguuugacugugaguuauagaaaaccccccaaacaacagugauuuaaauaugauagaaguuuauuucucucuuacuuagaggaaauccagggagaguuaguugaggucugguagaugccccacagugucaggaccuggagccuucuaucuuuuccucaucccccaccccacuuagcacuucccuuuggucucauguuccagaauggcugcuugagguccagccaucaugucugcauucuggugaucgggaaggaggaagagacaaggaagggcauacccccuccuuuuaaggacacuuucuggaaguugcacaugccacuucuacuuuuaucucaugggcuagaacuuaggcacauggcuacauuuaguugguagggagauugggaaagaaucuuuauucaaaguagccauguguccagcauaaaauggugggguucuguuacuaagggggaaauggagaguggaucuuggaagacaguuaguggucucuaccauccuuccuuccaaccaaccaaccaaccaaccaaccaaccaaccaaccagugugaugaacugcccuauuuagugaggagacacuuaugcaaauaaccagccaugauacaaugugauauggaguauaaaagaguuuuguucaaagcgcugugggagaacagauggaaaugaucaacagcaaucauaauaauuaauaacuacaaugcccuagccggguucucagugcuacauuccgaugauuguguuuguccagcucccucucuuuucagugagagcugcaaaccauucuacuucucuagaauagcuaacacaaugggcaggcagggugcuguucugaguucuuuauggauauuaucucacaacaaucuuaugaacugcuacuauuaucauucucauuuacagaugggaaaaugaggcacaagccaccgagcuggguuuuggacccgggcaaggcuccagagcacacgggccuaaccgcucuguuccgcugcccccacccaaagcugcucauuuucauuccuuccccuacuccccagacaucuccagcagauaaccaccccccaucgcccacuucauugugaugauuggggucaacuggugggacuucuguccacuuccaagccaaaccccagcuuacuuagauaucuucccuugucucuuccaccagcccugccuucaucuuaggagucaaccccacuaagccucgguuuucugaucuacaaguagggcugacacuaacauccauagagugggacuguuugugaggauugagcauguuuauucauggaaagugcuucuccuggcacauacuaagugcuuagaagauguuauucuuuuuuauccauccuuauaucugguuccuccucucuucucucucuucauuucauuucucuuuacagguuguguuaauguuguauuccugcugaaacauuaucacaaauucagugauggaaaacaauacauauuuauuaucuggggucagagucucaaugggguuucaaacugggcucugggaggcucugggaagaauccauuugucaccuuuucccaguuuauagaggcuaucugcauuccuucacuugcagcuugcuucuaucuucagagccagcagugguggguugagucccuagguugcauuauuccaaccuugauucugucauuccauuuucuucucugacucuucuuccucccucuuucauuuauaaaaugugauuacaccaggauaauccaggagagucuccucuucuuaguauccuuaacuuaaucgcaucugcaaauuccuuuuugccguggaagguaacauauuccuggguucuggggaugaggauguggauuccuuugguggcuauuauucugccuacaccacagguucuuuccucuugggauacagcaagcaagaagcacccaaaacaaaauaucccucuuuaacaguacauucucuucugucuuccucccuucucagccaggcuuucugaggguugccuugacuaguuuucuccaccuccugacaaccugcugcagucugcaucugcccccacauuccaccaaacccacucuugcuuggaucacccguggcuuccagauugcaaaauccgugggcaccuuucauucuuaaccggcugcguuuuccauguuagcugcccauuccuucaugagaccuuucuguccccucucugcuuuuaugucacuuucuggugguuuucucccccuuccuuucuggcuuagucuccucuaugagcugcaccgucuccacccaccccugaaauguccguguucucccgggguuuggaucuuggauccguuguucuuuucuugggugagcuugucccacacugcugguuuuaaaugccacuugcacagggauaagcgccuccugcuugugcuguacacaucucuggcugcuggccaggagcguuggugaggacugugcuucuggucaucccaucagcuccucgacuuccuuggucuccuuugaggcagacaugugagagagcucacugaggcaguggcuugagaagcaugcagccuggggcacuugguccuucuguucccggcaguauggcuguuuccaucgcgauggaaugggauccucucaagacaucucagaggacaggcggaaggcagcgaacauggcagugccgaaggacacagcuguguuuagcaggggcgacaggaaagcacgcagguguggcagaucaucaggcacguauuuauuggagcaacccccuccuuuaccuuugugguuugcaacagcuguagcucugaaggagccacaagcuaacuagagcacaaaggcacaaaaacauucaaaguaagucaagaugcauccuaacagugcagcuagacauucaagacucucaccagaaagagaacaaucugccugaacggcagggcugccucugaagccaggagggcugcugagggaggugugguacucaggaguggucuugugggcaguggagggugaaacagguaaaacaggacuuaaggagggaauggacaaggagccaggaggaggaaggccauuucaggcagaggaguagcgugugcaaaggcuuggagucaggaucgcuuauagucgauucaaggaacaaggagaaugugggggagaugagguugaagaggaggacuguguccaggacaucagggccucagauaaugcugguacaggaagucugaacuuugucuuguugguaguagggggcuguggaaggguuuugagcaggggaaugacuuggcagagcucagcuuuaggaagacuauuccagucuuggguggacuggggagggccccagaucuuaaaauaugcaaaauauaauuuuagagagaggaacuaccuuggcaauuacuuaucuauuucuauaauuguauauauguguguauuuuuagauguauauguguguauauuuauaucuaauacauauauuuuaaauacauacacacauacacauuggaugaccuagauggagggugagugacaaaggcacacagugagaaagccagcauuagaacucagagcuaacuccuggccccgugcucuuccucugcaggguacugauggaggcagagguaucugaaaggaggccagucuaaucaucagggcagauggugaugcaaaccuugaccagggcaggacagggcagacacugaggggaagacugugugggaggcaaugaggauauguucucucuccuucucccucucuggguggggguugggacauagggcucguuggagacugcacaugagugcaucucuccuuccuggguccugcagcauccuucugggccugguuucuauggcaacaggcucccagcaggcagccugccagcuggagagaaguaggcaggcaggcagggagagaaggccugggcagcaagagaaaggcugaaguugcggggguugggagagucucuuggggagguggagggacccuagagcugggcccacaaucccuucugaccauguagggguggagguagcucaggacacacaggcuuuucuuuugugguccuugaauuuccaaaccuugaucuucuguuuaucccccaccucccacaucuccugacucccacuucuuaaaguauugccuggucccaaccucaugcaucuuaagcggccacugacuucuuuauagaaaagaacucugaauucagggaaaaaaugaaaacggccaguugacuuuuugguuugcauaagauuugcauauuauuaacucaaagacaagaaauuuccaggcccuaugucauuccugcaaacaacuuaauucagcuccacuggcacugacuuacugugucuggccaggcucugggcugagccaucggggucccuagagaaguccucccagcugcaggcccacuccaccuccagcugcuccaaggcauuucuuccugugauguucuagcagcuggugcagugggaagugcuuggacuguggagcccagcagcgcugaguccaaauccuggcucugcuacuuugaagcuggguuuacuuaguuuacucaucucuagguagagcugaggacacucuagugcagcugguguaaacuagcauagacauagaauuuguuaaaauauugaaauacuucggccaggcgugguggcucacaccuguaaucccagcacguugggaggccaaggcggguggauaaccugaggucgggaguucgagaccagccugaccaacauggagaaacccugucucuuccaaaaagagacaaaaggcgcaugccuguaaucccaguuacucgggaggcugaagcaggagaaucgcuugaacccgggaggcggagguugcggugagccgagaucgcgccauugcacuccagccugggcaacaagagcaaaacuccaucuccaaaaaaaaaaaaaaaaaaaaaaaaauugaaauaucuucugccuucacugguaaagagccaccacccuggcuccucccugaccccucuagcccaccccacaaucuagccucuccagggcacugcugcagcauuuuggucugugccugcucugccugguauaugccagcaucugcucuguccauggacugaacugguugcuaaauagcuuggauaucaccccuaucuagaggcagugcaauagguagguauauuauguacguagcuguugcaaggaccaauauauuuaaagugcauagguuaauguccaucacuuuguagguucccuuucucauucccuuccuuuuuuuugcuuggggugggggugagagcuggcaugagccugggcaaugggggaugacagccaccccucuccccaggcgagcaagguucaagcgcuccaauagugugacggcuggcgugcaggcagaccuggagcuggagggccuggcaggccuggccacgguggccacagaagacaaggcccugcaguuuggacgcuccuuccagaggcacgccucugagccccagccugggccccgggcccccaccuacucagucuuccgcacgguccacacgcagggccagugggccuaccgcgagggcuacccacugccguacgagccgccggccaccgaugggucgcccggcccugcccccgcccccacccccggcccuggggccggccgccgugacuccuggauagagcgcgguucacguagccuccccgacucaggccgcgcaucccccugcccacgcgacggcgagugguucaucaagaugcugcgggcagagguggagaagcuggagcacuggugccagcagauggagcgugaggcggaggacuaugagcuacccgaggagagugagucacggcaucggaacaaggggacucuggggaccauggccucgugugugcucaggagacccugauggggguggcuggggcugcaguguaacaggaggccccuucgguuggugccucacuggucuucugcacuggagcguggcgggucaacaucggcagcaagacaugcugggagcucuugaaagggagcagggugcacauggugcagcuuuagaggccagggcugggacugcagacacugcaggccaaagggcugggccuucuauggauggcugcuaguccaaaucaccaaguuuauggggacuaagggaacuccguucagaucuggacugguguggggauccagguggugcgaccaagauuacagagagggaggcaguucacaaugucagauccugucugaggcacagaagagggagauucagccagggagauguggcccuggcccgagggagagcauggcccuuccuguaagucagauccacugggagacacagucuuaccccagaaucucugaguugaggggacaguggcuaugaagauguguuauguacaugaaauuacuuggucauucuuaaagagccaaggagucuugcaugcacuggggagugaugaacaaagcuuagccaguggguggucauugagcuaaugcccuggccaaggcuauagggcuaggcuggggcugguuuccgucuguucucugauacgggagggagaaaggauaaagaaggaugagcacucaagaaauguaggcuguaugaaggagggaacaucagugucugaggauacagucuugguguaguggagcgagaacuuguuaggaacuugaggaugggauggggcuggggcuggaggagacugauggauacacagugccaagcaaccgaggggucagcgucauucagggcagacuucguggaggcuggggaaggagaugcaucauuucccucccugaauuuccuucugcuuucuaguccuggagaagauccgcagugcugugggcagcacacaacuucuccugucccagaagguucagcaguucuuccggcugugucagcaaagcauggugagugcccauaguaguagauccuaccagauacaugugacccagagugugugugugcuggaggugagacaggcaggugacccagagugaguguguaccagaggugagaccaggccugcaugccuucugggguagcugugagucuugugccuggagguaggaccagguguuugugcacaagaaggggaguccugggcucgcucuugucccccugucucccagcccccacccacucucccaggcugagcuuccuggcaguaaggguggauaggacuuucucuuguccuggcuggggcucagaccuccuugaccaaucacuuucccuccaucuuccucuguugcaggaucccacugcguucccugugcccaccuuccaggaccuggcggguuucugggaccuccuacagcucuccaucgaggaugugacccucaaguuccuggagcuacagcaacucaaggccaacagcuggaaacuccuggagccuaagguggggcuggggugccuucaggcaaagaggccagacucugggaaauuccccuccccagagagguggagggugggacgaacaagggggcaggggaagggauccaugggcagcaagggcagccuuggacaggugauaggugaccauccccuuccagagugaccacgcucguggccacugccgucugcuuggccccagugcucaucacugcuugagcugccagaaccccaaggcuuccucagcgcgggggagcgggguuggggggguggcggcggcugcagcuggagagagcaaaaguagaccuuacggaaggacagacuguccucaguucgggccuaggcaucgacggcagagccuugaggguccccucagccgccaggucccuggaccuugucugcgaugagggccagaggccugguaugugcacccucauugcggagccugggucgggaacucccuccuucgggucgggacccggagugaaaaaccggcucugcugcgagcuguugagaacggcgccaccagggggcgcucgaacgcgccgcgcuuugguggaaaauguggggauuugaccuugucggaacaggagcaccuggggcuucaggucacgggauccguggcggauucugagcgccaucgcguucggagccacgcggucgucagcacucugggcgcgggggugcgggggcggacaccuggguguugggaugguucggcgccccagcucagcgacgcccucugccccgcaggaggagaagaaggucccuccgccgauaccaaagaagccccugcggggccggggcgugccggugaaggagcgcucccuggacuccguggaccggcagcggcaggaagcgcgcaagcggcuccuggcggccaagcgcgccgcuuccuuccgccacagcucggccaccgagagcgccgacagcaucgagaucuacauccccgaggcccagaccaggcugugaccgguccggcccgcccagcccggcccgggcccgcgguucuccacccguacuguacacccagcgucgaggucacugugaacgcgggccgccccgugcgcccgccccaccggcaccggacgccccggcccccgggcccgucacacucucguggguuuuuuaccuuccugaucccacgcgaaggcgcccgggcugggcagggggccgugccucuccgcccugcgccccucaccuggauccccugcccaccugguccgacgcuuuguccccaccuccuccccaugggcaccaucucugccauucuuucccccacgggccaggccgggccgggucccucaucugggcucugcgucccccccucccccaccccgcggggcugggcuucguggggaucaagcuucguggcuuuuuaugaagaaucccgaacccugccuaggagcccgccccacccucccaggggcuccauccucagcccucugcccacugggcccagggaccacaguggcuggaccaacccaggaccagggcgccugggccucuccccuuucccagcggcuggggaggggagaugggggcuuccccucaccacaccuguggcuguucccacauccccuugaauaucccaggaaaaauaaaacggcagaacugca

SEQ ID NO: 192930 - RNA, 39948 nt, Homo sapiens
ugcaguucugccguuuuauuuuuccugggauauucaaggggaugugggaacagccacagguguggugaggggaagcccccaucuccccuccccagccgcugggaaaggggagaggcccaggcgcccugguccuggguugguccagccacuguggucccugggcccagugggcagagggcugaggauggagccccugggaggguggggcgggcuccuaggcaggguucgggauucuucauaaaaagccacgaagcuugauccccacgaagcccagccccgcggggugggggagggggggacgcagagcccagaugagggacccggcccggccuggcccgugggggaaagaauggcagagauggugcccauggggaggagguggggacaaagcgucggaccaggugggcaggggauccaggugaggggcgcagggcggagaggcacggcccccugcccagcccgggcgccuucgcgugggaucaggaagguaaaaaacccacgagagugugacgggcccgggggccggggcguccggugccgguggggcgggcgcacggggcggcccgcguucacagugaccucgacgcuggguguacaguacggguggagaaccgcgggcccgggccgggcugggcgggccggaccggucacagccuggucugggccucggggauguagaucucgaugcugucggcgcucucgguggccgagcuguggcggaaggaagcggcgcgcuuggccgccaggagccgcuugcgcgcuuccugccgcugccgguccacggaguccagggagcgcuccuucaccggcacgccccggccccgcaggggcuucuuugguaucggcggagggaccuucuucuccuccugcggggcagagggcgucgcugagcuggggcgccgaaccaucccaacacccagguguccgcccccgcacccccgcgcccagagugcugacgaccgcguggcuccgaacgcgauggcgcucagaauccgccacggaucccgugaccugaagccccaggugcuccuguuccgacaaggucaaauccccacauuuuccaccaaagcgcggcgcguucgagcgcccccugguggcgccguucucaacagcucgcagcagagccgguuuuucacuccgggucccgacccgaaggagggaguucccgacccaggcuccgcaaugagggugcacauaccaggccucuggcccucaucgcagacaagguccagggaccuggcggcugaggggacccucaaggcucugccgucgaugccuaggcccgaacugaggacagucuguccuuccguaaggucuacuuuugcucucuccagcugcagccgccgccacccccccaaccccgcucccccgcgcugaggaagccuugggguucuggcagcucaagcagugaugagcacuggggccaagcagacggcaguggccacgagcguggucacucuggaaggggauggucaccuaucaccuguccaaggcugcccuugcugcccauggaucccuuccccugcccccuuguucgucccacccuccaccucucuggggaggggaauuucccagagucuggccucuuugccugaaggcaccccagccccaccuuaggcuccaggaguuuccagcuguuggccuugaguugcuguagcuccaggaacuugagggucacauccucgauggagagcuguaggaggucccagaaacccgccagguccuggaaggugggcacagggaacgcagugggauccugcaacagaggaagauggagggaaagugauuggucaaggaggucugagccccagccaggacaagagaaaguccuauccacccuuacugccaggaagcucagccugggagagugggugggggcugggagacagggggacaagagcgagcccaggacuccccuucuugugcacaaacaccugguccuaccuccaggcacaagacucacagcuaccccagaaggcaugcaggccuggucucaccucugguacacacucacucugggucaccugccugucucaccuccagcacacacacacucugggucacauguaucugguaggaucuacuacuaugggcacucaccaugcuuugcugacacagccggaagaacugcugaaccuucugggacaggagaaguugugugcugcccacagcacugcggaucuucuccaggacuagaaagcagaaggaaauucagggagggaaaugaugcaucuccuuccccagccuccacgaagucugcccugaaugacgcugaccccucgguugcuuggcacuguguauccaucagucuccuccagccccagccccaucccauccucaaguuccuaacaaguucucgcuccacuacaccaagacuguauccucagacacugauguucccuccuucauacagccuacauuucuugagugcucauccuucuuuauccuuucucccucccguaucagagaacagacggaaaccagccccagccuagcccuauagccuuggccagggcauuagcucaaugaccacccacuggcuaagcuuuguucaucacuccccagugcaugcaagacuccuuggcucuuuaagaaugaccaaguaauuucauguacauaacacaucuucauagccacuguccccucaacucagagauucugggguaagacugugucucccaguggaucugacuuacaggaagggccaugcucucccucgggccagggccacaucucccuggcugaaucucccucuucugugccucagacaggaucugacauugugaacugccucccucucuguaaucuuggucgcaccaccuggauccccacaccaguccagaucugaacggaguucccuuaguccccauaaacuuggugauuuggacuagcagccauccauagaaggcccagcccuuuggccugcagugucugcagucccagcccuggccucuaaagcugcaccaugugcacccugcucccuuucaagagcucccagcaugucuugcugccgauguugacccgccacgcuccagugcagaagaccagugaggcaccaaccgaaggggccuccuguuacacugcagccccagccacccccaucagggucuccugagcacacacgaggccaugguccccagaguccccuuguuccgaugccgugacucacucuccucggguagcucauaguccuccgccucacgcuccaucugcuggcaccagugcuccagcuucuccaccucugcccgcagcaucuugaugaaccacucgccgucgcgugggcagggggaugcgcggccugagucggggaggcuacgugaaccgcgcucuauccaggagucacggcggccggccccagggccgggggugggggcgggggcagggccgggcgacccaucgguggccggcggcucguacggcaguggguagcccucgcgguaggcccacuggcccugcguguggaccgugcggaagacugaguaggugggggcccggggcccaggcuggggcucagaggcgugccucuggaaggagcguccaaacugcagggccuugucuucuguggccaccguggccaggccugccaggcccuccagcuccaggucugccugcacgccagccgucacacuauuggagcgcuugaaccuugcucgccuggggagagggguggcugucaucccccauugcccaggcucaugccagcucucacccccaccccaagcaaaaaaaaggaagggaaugagaaagggaaccuacaaagugauggacauuaaccuaugcacuuuaaauauauugguccuugcaacagcuacguacauaauauaccuaccuauugcacugccucuagauaggggugauauccaagcuauuuagcaaccaguucaguccauggacagagcagaugcuggcauauaccaggcagagcaggcacagaccaaaaugcugcagcagugcccuggagaggcuagauuguggggugggcuagaggggucagggaggagccagggugguggcucuuuaccagugaaggcagaagauauuucaauuuuuuuuuuuuuuuuuuuuuuuuuggagauggaguuuugcucuuguugcccaggcuggagugcaauggcgcgaucucggcucaccgcaaccuccgccucccggguucaagcgauucuccugcuucagccucccgaguaacugggauuacaggcaugcgccuuuugucucuuuuuggaagagacaggguuucuccauguuggucaggcuggucucgaacucccgaccucagguuauccacccgccuuggccucccaacgugcugggauuacaggugugagccaccacgccuggccgaaguauuucaauauuuuaacaaauucuaugucuaugcuaguuuacaccagcugcacuagaguguccucagcucuaccuagagaugaguaaacuaaguaaacccagcuucaaaguagcagagccaggauuuggacucagcgcugcugggcuccacaguccaagcacuucccacugcaccagcugcuagaacaucacaggaagaaaugccuuggagcagcuggagguggagugggccugcagcugggaggacuucucuagggaccccgauggcucagcccagagccuggccagacacaguaagucagugccaguggagcugaauuaaguuguuugcaggaaugacauagggccuggaaauuucuugucuuugaguuaauaauaugcaaaucuuaugcaaaccaaaaagucaacuggccguuuucauuuuuucccugaauucagaguucuuuucuauaaagaagucaguggccgcuuaagaugcaugagguugggaccaggcaauacuuuaagaagugggagucaggagaugugggaggugggggauaaacagaagaucaagguuuggaaauucaaggaccacaaaagaaaagccuguguguccugagcuaccuccaccccuacauggucagaagggauugugggcccagcucuagggucccuccaccuccccaagagacucucccaacccccgcaacuucagccuuucucuugcugcccaggccuucucucccugccugccugccuacuucucuccagcuggcaggcugccugcugggagccuguugccauagaaaccaggcccagaaggaugcugcaggacccaggaaggagagaugcacucaugugcagucuccaacgagcccuaugucccaacccccacccagagagggagaaggagagagaacauauccucauugccucccacacagucuuccccucagugucugcccuguccugcccuggucaagguuugcaucaccaucugcccugaugauuagacuggccuccuuucagauaccucugccuccaucaguacccugcagaggaagagcacggggccaggaguuagcucugaguucuaaugcuggcuuucucacugugugccuuugucacucacccuccaucuaggucauccaauguguauguguguauguauuuaaaauauauguauuagauauaaauauacacacauauacaucuaaaaauacacacauauauacaauuauagaaauagauaaguaauugccaagguaguuccucucucuaaaauuauauuuugcauauuuuaagaucuggggcccuccccaguccacccaagacuggaauagucuuccuaaagcugagcucugccaagucauuccccugcucaaaacccuuccacagcccccuacuaccaacaagacaaaguucagacuuccuguaccagcauuaucugaggcccugauguccuggacacaguccuccucuucaaccucaucucccccacauucuccuuguuccuugaaucgacuauaagcgauccugacuccaagccuuugcacacgcuacuccucugccugaaauggccuuccuccuccuggcuccuuguccauucccuccuuaaguccuguuuuaccuguuucacccuccacugcccacaagaccacuccugaguaccacaccucccucagcagcccuccuggcuucagaggcagcccugccguucaggcagauuguucucuuucuggugagagucuugaaugucuagcugcacuguuaggaugcaucuugacuuacuuugaauguuuuugugccuuugugcucuaguuagcuuguggcuccuucagagcuacagcuguugcaaaccacaaagguaaaggaggggguugcuccaauaaauacgugccugaugaucugccacaccugcgugcuuuccugucgccccugcuaaacacagcuguguccuucggcacugccauguucgcugccuuccgccuguccucugagaugucuugagaggaucccauuccaucgcgauggaaacagccauacugccgggaacagaaggaccaagugccccaggcugcaugcuucucaagccacugccucagugagcucucucacaugucugccucaaaggagaccaaggaagucgaggagcugaugggaugaccagaagcacaguccucaccaacgcuccuggccagcagccagagauguguacagcacaagcaggaggcgcuuaucccugugcaaguggcauuuaaaaccagcagugugggacaagcucacccaagaaaagaacaacggauccaagauccaaaccccgggagaacacggacauuucagggguggguggagacggugcagcucauagaggagacuaagccagaaaggaagggggagaaaaccaccagaaagugacauaaaagcagagaggggacagaaaggucucaugaaggaaugggcagcuaacauggaaaacgcagccgguuaagaaugaaaggugcccacggauuuugcaaucuggaagccacgggugauccaagcaagaguggguuugguggaaugugggggcagaugcagacugcagcagguugucaggagguggagaaaacuagucaaggcaacccucagaaagccuggcugagaagggaggaagacagaagagaauguacuguuaaagagggauauuuuguuuugggugcuucuugcuugcuguaucccaagaggaaagaaccugugguguaggcagaauaauagccaccaaaggaauccacauccucauccccagaacccaggaauauguuaccuuccacggcaaaaaggaauuugcagaugcgauuaaguuaaggauacuaagaagaggagacucuccuggauuauccugguguaaucacauuuuauaaaugaaagagggaggaagaagagucagagaagaaaauggaaugacagaaucaagguuggaauaaugcaaccuagggacucaacccaccacugcuggcucugaagauagaagcaagcugcaagugaaggaaugcagauagccucuauaaacugggaaaaggugacaaauggauucuucccagagccucccagagcccaguuugaaaccccauugagacucugaccccagauaauaaauauguauuguuuuccaucacugaauuugugauaauguuucagcaggaauacaacauuaacacaaccuguaaagagaaaugaaaugaagagagagaagagaggaggaaccagauauaaggauggauaaaaaagaauaacaucuucuaagcacuuaguaugugccaggagaagcacuuuccaugaauaaacaugcucaauccucacaaacagucccacucuauggauguuagugucagcccuacuuguagaucagaaaaccgaggcuuagugggguugacuccuaagaugaaggcagggcugguggaagagacaagggaagauaucuaaguaagcugggguuuggcuuggaaguggacagaagucccaccaguugaccccaaucaucacaaugaagugggcgauggggggugguuaucugcuggagaugucuggggaguaggggaaggaaugaaaaugagcagcuuugggugggggcagcggaacagagcgguuaggcccgugugcucuggagccuugcccggguccaaaacccagcucgguggcuugugccucauuuucccaucuguaaaugagaaugauaauaguagcaguucauaagauuguugugagauaauauccauaaagaacucagaacagcacccugccugcccauuguguuagcuauucuagagaaguagaaugguuugcagcucucacugaaaagagagggagcuggacaaacacaaucaucggaauguagcacugagaacccggcuagggcauuguaguuauuaauuauuaugauugcuguugaucauuuccaucuguucucccacagcgcuuugaacaaaacucuuuuauacuccauaucacauuguaucauggcugguuauuugcauaagugucuccucacuaaauagggcaguucaucacacugguugguugguugguugguugguugguugguugguuggaaggaaggaugguagagaccacuaacugucuuccaagauccacucuccauuucccccuuaguaacagaaccccaccauuuuaugcuggacacauggcuacuuugaauaaagauucuuucccaaucucccuaccaacuaaauguagccaugugccuaaguucuagcccaugagauaaaaguagaaguggcaugugcaacuuccagaaaguguccuuaaaaggaggggguaugcccuuccuugucucuuccuccuucccgaucaccagaaugcagacaugauggcuggaccucaagcagccauucuggaacaugagaccaaagggaagugcuaaguggggugggggaugaggaaaagauagaaggcuccagguccugacacuguggggcaucuaccagaccucaacuaacucucccuggauuuccucuaaguaagagagaaauaaacuucuaucauauuuaaaucacuguuguuugggggguuuucuauaacucacagucaaacccacuccuaacuauaacagaugaauuuuuagaauagugaaguuaagggcuuaugucgcuauuuaguuuuggauuuggcaguauuugcuguggucuccaccaacagcugucagcacaggauaaaaacuggcuucagcugugaauugucauuaaugcguaacaaugcauucacaauauuuucucccaagccuuuaaauguggcugcagaagccuccucccuuugagugcuccaaggugacaaugauuacauuccugaugauaaugcaaguuguuaucaugguuacuucagggagaguuuccacugcgauucuacuucagggagaguuucuacugugauucucugggggauaacauaaaagccucuggguagaagcuggauuaucccaagagacacaguauccaaggaaagcucuauauccagaaguugucaagagguuuugccaggaguauuuggcagcaggcaggaagggugggagggggagugggcagggagggggaaggacggugucauuucaacuaggcauagccuucaaacuagcuucuauagaagcuccugugugaaggcaucuaagagccuaaacauauaaucaagcaggggucacugaacccaccacuccagccugggggcugugacagggaugccaagguggggcuagggugggagauucaggaggagucaugagggucagucagaaaccguccuaaauuugcaggcucaggaauggagguagcaucugugcccagggcuuugggcagucagcuucuuauugcuuuugcaggacuguucuuggaauauaacuuaauggguauggaagcuucuuucccaggccucaaggggccauucuuucagcacauacccuucccaaacucccaaagcuagaaaugaccauaauguuaaggaaaggguaggcaggucuuccuccacagaguucuccagguggcccuucgugggcacaagcagguaugaguaggguugucagauaaaauauaggacucccaguugaauuugaauuucagauaaauaacagauguuuuuacuaugaguaugucccaaauauugcaugugacauacuaaaaugcauucauuauuuaucugaucaucaaauuuaacugggcauccuggugguuuuuguuucuuuauuuugguggguuuugcuguugauguuguugguuuuguuuuugcuaaauuuacaauuuaagauaaggucugucugggaggaauuagagguggaagauacaggcagaucccuaugguuagaaagaguuggaggcaaaaaucccauuuucuaugacuucagagggccccuugcuaauauucagcaagacaucugaugcauccuuuuaucauggcccagagugugcugggucuagggaaacaggugccauaaggacauguugagacacggcugguaacugauuaaguauguucucucucaccacaaggccuuagcauaugcuauuccuucugccuggaaccuuaucucccauuuuucacucaguuaauuuuuguucauccuucggaucuccacccaaaugucacuucccagggaagccaugccugaccccucuggcagacucaaagccccauagucuacacugucauggcucacaugccgcuccuuuguggcagccggcacagcggcuacaucauuaaugagauucuuagauuaacuucgugguaagcuuugcaugggcaggagcugucucugguucugcucaccuuugcauccucagugcccagcacaguguuuggcaaauaauacagauccaauaaauaucuguggacagaugaaucuuggcgggggggugggggugugcaguggagauagaacugaaggggugccagcccccuccccuuauauucuaagccaagucaucacugacacugggcaacuggaaggacucacagacaauucccagacagaagggacaauaaguccaaaauccucacccaagaggugagcagggaacacccugaaaggcagaagagaagagaccuuuccugcucagcaauuuuuaaaaccaaauuacagagagagaaacagauacugggaugagcgagacagcaguaaggacaagagagucaaagaaaauggggcugggcuguguguggcgggccaggccugaaugcuggccaggcgaggcugcuggaauucauggcucgcuuuuaugcaccaguuggggcauggugugugaggagucagacuuaaagugccagggacauaagggacagaaaggacugugcagguguaugacuaaggacgccugcagcagacaggccagggagccuggccaaagagaugggccagauuuccccucuccccaccugucacucccucugaauucccagugugaucaccugucccaggcaguuugguucuuucgaugcuuauucaacaccauguccucuccucagcccgccacaucaagaccucaccaagcacuuacacaagagcaaggaaggccacguucucugccugucccugcccuucccugacuuucacuccaaaaugcugcucaaauuggcccacuucucucuguauccacugcuaucagccuuacccagaccacugaucaauagaguagacugaauuaacuuaggaagcucccacucacacccuaaacgcauagaaaugcuggguuuuuaaaaaucaaaaagguguuuuugcuacaaugcuggguuugaaaauaggaaugagaaauguccagguaucagaaacaggaaggaaauucaaagaacauauagugagagggggucuaagccaagugaaccacagggagaucagaccagacauaugcuagaggcuggaugaaaacgcugagggaggaugagaggagagaccccaaaccugcgcagcaaggggagcuggaaagagacccugugcgcaaagucggcagccaagaaggucuguuucauuugcaaacuuggacucaaaacgcucaugccagggaugcaggaauguggccuggaaggaggaugcugggaaaucggaacaugaaggcuuccuuguguggaggugugggguucaaaugaguauuaccugugaaacacaagaaaccucaagccucaaagggagauauuaacuuuaaaacuucaagcagugcuucagcaugaaggaaacugaaccaggagaaagaagagggcaguaaaaaacaauagugaacacacaaauuacggaaacacguauguaaaucuaaacuguuaaagcauaaaagauacaacagcagcugauuucacagagacuuuuuaagagguauaaucaaacuacuagauaaacauaacauggaagaugggaggagaaacuuaagaaggaaauuaaaguguuccaagauucuuguuuugugccuaagaaggacagaaguacugacuaauguuagacguuauuaggaaaauaugaaauuaaguauaucugucaaauguuuaagggaaaucacuacuaaaauguaaacuuccaaaccaguggagugaagaagagaaaguaaacucuauuuacuguugaucaguucaacauaagauaaaaagaaagggagaaagcaaagaaaaagcaugucaacuagaaaauuuuuaaacagaugauagaaauaaacucaagucaguaaugaaaaauauauacauggauuaaauaugucuaaacucuagcuauaaaucgcuuauaagcaacacauauaggccaggcaccguggcucacuccuguaaucccaacacuuugggaggcugagccggguggaucaccuaaggucaggaguucgcgaccagccuggccaacauggcgaaacccugucucuccuaaaaauacaaaaaaauuagccaggugugguggcacaugccuguaaacccagcuacccagguagcugaggcagaagaauuacuagaacccaggaagcgagguugcagugagcugagaucacgccaaugcacuccagccugggugacagagcaagacucaucucaaaaaaauaaaaauaaaaauaaaaaaauaagcaacacaucuaaaacauaaggauauaggaagguugaaaauaaaaggauggaaaaagauguauuggaaaauuaaccaaaagcaagcagccauagcaauaaaaaucagguaaaaaagacuucaaggcaaaagccauuaguaaggaugaaaagcagccuauuuaauauuaaaagagccaagccaccaagaagauacaacaaucauaagcuugaaugcuuauaaacagcacacucucaaacugaaguaaaaaucaacaaaguuaccagggaaaaugacauauccacaaucauggugagacauuuuuaacacaccucucagaacugauagaucaaauguacaaaaaaaagauaaacauuugaaaaauauaauuuauaaauuugaccauauaugacagccguccccaaccuuuuuggcaccagggacuaguuuuguggaagacaauuuuuccagaagcugggugggcgcaguggcucacgccuguaaucccagcacuuugggaggccgaggcgggcggaucacgaggucagaagauggagaccauccuggcuaacauggugaaaucccgucucuacuaaaaauacaaaaaaaauuagccgggcaugguagcaggcaccuguagucccagcuacuugggaggcugaggcaggagaauggcgugaaccuaggaggcggagcuugcagugagccgagaucgcgccacugcacuccacccggggcgagagcgagacucugccucaaaaaaaaaaaagaaaaaaaaaaauuccagaagcugcgggggggcauaguaggggaugguuuugggaugauucaagcacauuacauuuauugggcauuuuauuucuacuauuauuauuacauuguaauauauaauaaaauaauuauucaacucaucauaauguagaaucagugggagcccugagcuuguuuuccugcaacuagacggucccaucugaggguaacgggagacagauuaucaaacauuagauucucauaaggagcacacaaccuagaucccuuacauaugcacgcaguucacaauaggguucaggcuccaaugagaaucgaaugcuaccgcagaucugacagcaggcggagcucaggcaguaaugcucacucaccugcugcgcaccuccugcugugccgccugguucccgacaggccauggacaaauaccagucccuggccugggguuuggggaccccugauacaugauauauauacauaugaugaaggaggucucaacaaauucuaagcaauaaauauaauagguacauaauaugaccacaauguagcaaauuuagaaaucaauaaugaaaaggcugucccuugucaaaaaaauucauuugaaaacuaaaaaaaaaaauuauucuaaaaauucauagguuaaaaaggaaauuacgacaaaagugaugaaagaugaaaguuacauauucaauauguacaauaaaaauaccgcuucccaaaacuuaugagauauagccauaaaaggauauaguuauaagggaaauuauagcccuaacagcacauguuaaaaaauaaaaaauauugaaaguuagggaugaauucaagaggcauaaagaaagacaaacacagcagacaaaagaaaauaaccaaaaguagaaggaaggaaauauuaaagauugcucaccaaaacaaaaaacuaguuuuuuucaaagacgaauaaaauguaaguuucaacauauguauuuuuuucuuucccccccuuuucuuucuuugacacaaggucucagagucucagagacaggcugaaguacaguggugugaucagagaucacugcacccucaaacccauggguucaaguuauccaccugccucagcuuccccaggagcuggaacuacagaugcaugccaccaugcccagcuaauuuuugcauuuuuuguagagaucaggucucacuacguugcccaggcucaucuugaacuccugaucucaagcaaucccaccucagccucccaaaguacugggacuauagguaugaguuacuaggucuagccuaaaaauauguuuaauuauaaaauauacaaaccucaggcaaggcugacucaagaaagagagguaagacauaaauacaugguauuggaaauaaaaagggagccaagcacaguggcucacgccuguaaucccaggacuuugggaggcugaggcgggcggaucaccugaggucagaaguucgagaccagccuagucaacauggugaaaacccgucucuacuaaaaauacaaaaauuagccgggcaugguggcagaugccuguaaucccagcuacucgggagguggaaguugcagugagccaagaucacaccacugcacuccagagugagacucugucucaaaaaaaaaaagaagaagaaaugcaaagggagauaucaauauagagaugcaauaaauauugauaacauuuuaauacuaugagaaagaauauuugugccaaaaacuuugaaaacugucaauucuuauguuucuuuuuuaaauaaaauauaaaucaccaaaaugauucaagaaaaaaaauaaaaccagaauaggucaauaaucacuaaagaaacugaagcuguaguuuuaaaagucucuccuauccccaaaaggcaucaggcauagauaauuuuauaggcaaccuuuaccaaaccuaaagaauagauaagucuugucuuacacaaauuguuccaaagaacaaaaacacagagaaaccuaccaaauucauuuuaggagccuaucuuagcucuaauaccugaauugaaaagcaguaaaaaauuguaggcuuacaauuauuaugauauaucacuuaugauacauucauaaaucuaaaugauuuaaaauuuuaaaguagcaacuguucaaaaaucuaauacuguauauaaaaauaauauagcaaaacuguaacaaaaaccccuagagcuccacauagcuauucuuugucuuuagucaugagaacccugauucuuagcuauguaguuuacacccuccacauugcuucccagcuaaaagacuauaccccacagccucccuugcagcuaggugccaccaugugaugagauuuuagccaaugugaugaaacugguuguguguaacuugcaggaagucuuuuuaaaaaggauggacugcaucccucuuccucuuuacuccuucucacugcucagaaugcagacaugacugggggagcuugaacuuaaggucccuagacaugaagugauguacaaaauagaaggagccuggaguucugacacugcacucccuacaucuaagcuggcuuuuuuuuuuuaagugagagaaaaauacacuuguuuaagacacuacugaggcccugugacucacagccaaauuuaauccaaacugacaaugggaucaagcaggguuuaucccaggaaugaaagaauggaaaauccauucauucauauaauucaccauguuacacauggaaggagaaaaaucuaugaucaucuaaauagauucugagaaaacauucaauaaaauuucacucauauuuucuauuuuaaaaaauaaaaauaagaugcuuauccaacuaggaauagaaaggaauuuccuuaaccugacaaaugguauccaucaaaauuuguagcaaacaucaucuugaaaaacauagccacuaaagucaauacuacugaacagugaacagaaguccuauucaaugcaauauuacaagaaaaauaaaugaaaauacagauuuaaaagaaauaucuucauucacagaaaaauaacugacuauauaggaagcccaucaugauuuucagauaaccuaugagacuaauaagagagaccuaauucagcagcaacguuacugaauacaaaaucaacauacaaaacauacaaaaccuaacaguagaggccgggugugguagcucacgccuguaaucccagcacuuugggaggccgaggcgggcugaucaccugaggucaggagcuugagaccagccuggcuaacauggcaacaccccaucucuacugaaaacacaaaaaacuagccaggcgugguggcgggugccuguaaucccagguacuugagaggcugaagcaggagaauggcgugaacccgggaggcagagguugcagugagccgagaucaugccacugcacuccagccuggacgacaagagcaaaaugccaucucaaaaaaaauaaaauuaaaauaaaaauaaauaaaccuaacagugcuaccacacacuagcagugccuaguuguaaaaugcaauagaagaaaaacaucccaaucacaauagccaccacauugcaaaacacaaucaccuuucuucuggaucaugaaaaauccuccuaacuagccuucucguuuccacuauugcuuucuucaaauucauucuccacucagcagcuugugaucuuucaugaacauaaguuagaucauguugcacuccuucuuuaaccuuuacauggcuacucauuacucauaauuagauuccaauuccuuaucauguccaugcucugcauaaccugccccugccuguucuccaauuaacucccuucccacuccccugccccacuccacaccagccacauggaccuucuuucaguucccgaugcaugucaaacucuuuccugccccaacaccuccacauaugcuauucccucuccccugaaugcuuuuccuccaaucaucaccugagaguucuuagucaauccucaagucucagcuuaaaugucaccuguuaaucuaaauaaggucccuucuucucucuuaucuccuccuuuuucuuucauauuccuacauaauaugcaauaaaaucccacuaccuauuauaucauaauguguugucauauuuuuauucaaggauuauuuauucauugccuugauuucccucuagaccauagcuucugugagggcagaagucaugucuuugauguuuccugaagcauuuaacacagugcauaggagcugucauacaacacgugcuuaguaaguaucugaugaaugaaugaaucaaucaaucaaugacaagaguuugcugauuuagcaagagucucagcuagaaggccugcagcacucuucccaggauucaaggguuauuaggaggaauguggggaacccccaccccccuggaccuaucuagacaaggaaccaaaaagccucuaaagggagugagugggcuuggugguccaugggauagcacuagaauuggggguggguaggauucagaacauagaguugcauccauccaugacuccuaccccaucucucaauaauucaagucacagauuugcaaauuggguuugccauaaaaugcuauuuuucugaaaucuuuguggcacaguaaaaguuuggugaacagcagguuuagaagucaugcaggcaaccagggcagcauuaugccacccucgaugaaggcauuuacagccccaggagcacacagaacuucagggagccaaaucagaaguugagaaaaauggugaaucccauaggaacaccaaaaaaacuucaucaggcacaaacacaagacaucccaaggacaucccagaaauagcuggggaaaucugggcgaaggacagcaacugggaacagagcugcgaggaaccacugcuagugggacacugguuuuuuguguuuuggguuuuuuuugagauagucucacucagucacccaggcuggagugcaguggugcaaucucagcucgcugcaaccucaggcuccuggguucaaccaauucucaugccucagccucucgagcagcugagacuacaggagugugccaccaugcucagcuaauuuuuguauuuuuaguagagaugggguuuugccauguuggccaggcuggucucaagcuccuggccucaagugauccacccacccuggccuuccaaagugcugggauuacaggcgugagccaccgcaccuggccugggacacuaguuuuauuccuccagucguauggccugggaagcucagauaccaugaaaccguuauggccagccccuggcaagcucccagacacccuuucuccccauaggcacccaacaacagagaggccucuuucugguauccccuccagagcuggcaaugcuaauucuucagugaaaauuaaggagucaauguuucugaggccaccuaaugccagaauaguggcugcugcuaauuguacuaucucagguacaccacagacucaggcauguaauagguacccccaacugguuaaaugcuugugugagccaagugaggaggaguguuauaucugccaggggcuccugagaggcaaucuucccguuuguuucuuuuugagcucacauacuuguacaccacaggauguaaugagggauuggcagauccuaucauccccuggaaaggacaauugcuggaggccugcucggcaccuacauguaaccuuucccauccucuccuucccugcaacugcuguguaucucccgucugccucugagcaccuggggugggcaugggcacaagaacucuagguuugaugacuccucuggugacaucucuauggaacagccccuguggcugcucugaccacccucuauaaaaaggcuuggucucacuuccaggaaaagaggaugugcagggagacugggcuaguggggacacuaugcagcccucucuccuccugucucccagcgaagccugggcacucccaccgugacuuuaccucuuguccucuuccaccugcacgccaauagaguggaacucccuccggcuccuguucucgguguccgaaucugagaucgucuccaccugguggcaggguggaggagucaguggcuguggcgagccaaggugaaagcccuucccggggagaacggcuagcaauggcugcgccccaagccagcuggcagguccugcaaagaccaucugccugaacaagaugagagacccaggcggucggucacaggccucaaaguggcaaccacugggcacagcccuccagcccuccauuagucaggaggggcgauggugccaggacgagggacgagggagugggcgggggcuggcuggagcagccccgucgauguccaggcacgggguucacuugcagcucagggcaagccagaaagaaugucgauauauccagaaggccgcuuccagccccucaccccagccccgaccgaccagggucagagcccucgugggcgccuccccguuccauaccugcaccccaauggacggccgccacuuccgcugccgcgccaggcuccgcagcuccucccugccagggauggucuugaugaugaguguggggggcuuggggcuggcccggggcggcaccggcgccaacuccagugugcgcgcacccauggcggggccguccagcccgucggcggagcugcagcgccgggcggggcccucggccgccgugaagcucucgugcgcggagucggugcugcucugggcggugauggagaugcggggcggggccuggcuucccggcgggauggggggcggggccuuucugaaguugaaggcuguggccggcgagcgcagagacgcagugggugaggcucgcggcccugccuggguccugggcccgcgcccgacucccacccucaagaggcccuacgggacccugcagcggcgcgcacuccacaugcugcugcacacacgccaacggacgcucuccccgucauccgaccccgggagcgagcgaucugcgcgggucacagcacagucgagggggaggccagaacccggacccagggcgcucuccugccuagggccgggccaggggcaggaagguguacucacaggagccgggccucccugagacagcggcagggguagcgaggaggggcaggcagucgucgucuugagagcagccggccuggauggcccggagguagcuguggcuccgcaugcggaaacagccgggcagguccagggcguccacggccugggacuccagcuccccaaacaccgacccgcacacggccuccagcugcugguucaacucaucgcugagcuggggggcagggggucgggaggacaguuauaaggugccgggaggggguggaagucccuggggugcucugccuuaggggaagaccucucuauaucugcagaggcuguaggcgacucuuccgcauuugaacuaaaagaaacucuaacucuuugcaaagaaagaugggggcaucucugccccacucugcucccaaggcuugucuuggggcccagucuuuccucuaaauaucccacccccacccccaccuccaccccaccuaugccucuuccaggugucuggcuggcugcacuccagacugcagaccaccauguuuuucucuccaccuagucccauccccugacguuucucucaccugaccccaacagagaggaccagggaccuggcaugcacccuccugcccaguauggggguggggacuucauggaggacaucuuuuauuauuuauaauccauuacauuacaaaauugauugaaagcucuguguauauauauacacuacauacauguacuauauauauacuacauauauacuauauauauacacuacauguauauaugcuauauauauauaaaauaccaacuggcaggauggaaacuaaugcguaagugauggagcaaaguuauuaaccuaccagugucccaagccuucccccaccuucuuuuuuuuuuuuuuuuuuuuuuuuuuuuugagacagagucucgcucaguugcccaggcuggagugcaguggcgcgaucucggcucacugcaagcucugccucccggguucaccccauuuuccugccucagccucccaaguagcugggacuacaggugccugccacgacgcccggcuaauuuuuuuguauuucuaguagagacaggauuucaccguauuagccaggauggucucgaucuccugaccucauaaucugcccgucucggccucucaaagugcugggauuauaggcgugagccaccgcacccggcccuugccuuccccaaccuucuauccacucacucggguucuggcuuaaccuguggguuccuucucuacccucccccacugaggaaagcuuagccauugcuggaugagguucugguuuuguuuuucguauuuugguggugcagaauccaugguguuaaaaaaaaaaaaaguuaaaguaugaaaaaaagcaaaacaaaaauuuuguugguggaacugugccgcacaccaccacaugaagacuaaauauaccacagagguugcagcuucauucacauuacaagagagaacuggugcaaagaaaaaguaaaggcaggaaaaggugcuacccgagguaagugcuacacccagaacacaggugacaaaguccugaacauugcucaagaugggcacauguuuaacccugagcuuccaagcaggcaaagcaucagggaguauagccucagaguugccugcaugggcuaugcgugagacuucuccuagauucaagugcuggcucuaccacuuccuagcagaauggccugggaaaguuaaaguuugggggccucaguuugcucagcugucaaaugggagugauaaugguaccaucuucauagggcuauugaggggacugaaagaaaaacaugugagccuuuugguacagguacuggcacauaguaagcccucggcuagcggcaugcgaaggucucagggccucccugguaaacacaggccagaugcccaugagaaccacaacaauuccugucccugagacuaagagacaaucauccccuguggaugauuauguagaguccauuggaugaagucauggauaagguccucgacagcaucccauggcaaacauaacagcaaguaucacauggcugcaucuugugacaucucccaggaaagauucacggcauuauauuuacgugcagucaacagaggcucaaaggaguggccugauccauguguaaacugcagcucaguguuuccauaauucagccuccaaagcauaacaugauuucacuggauucuacuucaaauagagccauuucuauuccaaucuacuaaugggcaaacaagacccagagagggcaggugaauugucugaggaugcccagcugguaggugauaaaacugaaauuaaaugucaugcuuccuggcucccauguaaggcugacugagcaacagauucucuuggggagcuuguuaaaccuacauuaacucaggccccaccccaaggaucugaacccaagguuaacaaaacaccucucuugcuuuggcugcuuagaagcucagagccaaauuugcuggagauuuagauucguugguuccaaugugggccuacuaauugaaaagaaggauugucugaacuuuuugaagcuuuuucuaaaggagcuucauuacaaguguauggaaaucccaggccauggaaaaucaauccaagaccccgcagaaguuaaguucucucauauuugacugacacaagccacacuugugugacaguuguggcuuucaccaugaugcucugucaucuaccucucagucuuucugucucuguauuucuggggcaccaaagacaacaguugccagcguauuuccuaaaacacaggaacugaacuaacuccugcuauuucugggcuaggcucaagacacuccccaauuagaacaaaugcagcccagagugucccucuuggagcacaggggagcuaaucuaacccuagcagaaagcacacuggucucgaguccagacaccagggaugaaaggaaucucacucuguuguauauuucuguaucucuagcccucuucuguguauaaagcacuaggcauaauaucuggcacacaguagaugcucaauaaacuauagcuacuauuauuagcaacaagaggcucuuaaaucgcagugacaauaccacucagaaugagaagugccucuuucccugggguucugcagcucuugaaaucccacccacaggcaauacucacaaccaauucuauccaaggcagacaaaagaaggugaacaacucccuggggucauacacccgccagcucagcuggccaagaggagcuucugggguuccaacaggagaccaggacacaagggaaacacggacucagagacucucagagaaauauuacacccauguugaucuuuacuauccuacaguuauaaaacuguaacauuguacugugaaugcuccuauuaucccugcacugacuuccacccugcuucccccaacauccauuuacaggagacucaaagucaaagaauccucuugggaugagauccuuagccuuucuccaaaccagacuggaaucaguagccauuuccaagcucaugaaauauuuaaaguaaaaaugcuuugugucuaauuggaaauuguccagacuagaguugguggguccaacagggggccaggcaacaucguguauacuuuacuuguguuauuuaguuuagauaaccuuuagaaaacucucccauuucaaaacauuggaugaaauauaacaaauguugcuuuauaugcauagcugagcucacaagaaagcgagauaaguccccaggggacaaaagcaaagaggagacuggaaaaucagaauauuaacugugugagccaaugcugcaaacagcccaguggaggcgggaggugggggcaggggcuguuggucucagcguuuugguaaaggcuuagguuuuaacacccacuugggcauaggaggaaggcuuugggcccacaugaagcguggaauuggaaaggagaaccugcauaaaguuaggaaaagugaaaccuuugaugaaaauguagacuagaauaaaaaaauuagucaucaccacaggcugaugacaaggaagcuggucugaaguacagggauggcgggaagggaaaagaggcaaauccccuaagaaucuguaccuacaagcugguccucacacagccacgguacaguguaucugcaugaaccuucaugggccacaccccuaaaauuaaaaauuagcauaaaauaguuccaaaccaggcauauuccaacagaagcaacugcaaaauauuuccuggggaacucacuccuaacccaagcugcucaugcuucucacagauaaauuuccauugaaggugaguguauuaugugggagacagccucugaaauagcuccuaaugaucuccaucuccuggaacucacacccuuguguaaucccuuucucaugaguguggaccagacuuauuggcccacuucuaaugaauagaauauggcagauacaaugggauaucacuucugagauuagguuacaaacagacuguggcuuccaucuuagacaccuuuucuuauucucuuucucucaaagccuuugcucugggggaggcaagcugcuaugcugugaguagcccuguagugagucucacauagaagaaauugaugucccugguuaguagccagcaaggaucuguagccugccaacagccaugugagugagcauggaagcagaucuucacccagugaagccuugagaugcugcagccuuggccaacaccuugauugcaacuuugugagacacuugacccagucgcacccagccaggcugcacucagauuccugauccacagaaacugugagauaauaaauauuuguuguuuaaagauacuacauuuggggauaacuuacauagcaauagaaaauacaaauugugacauaaacaaaaacuaacuuuuauugaguuaagccauugagaauucaagauuucucuguuaaagcagccagugcuaccuuagcuaaaauaaaauaacuuuuaaaugauguuuaaaaguuccaagcuuaaaagauaaaacugagaacagaagaaaauacgacucuaaagcaggacaaacugucaaaacccaccauuuuaucacucugcaaaucaaucaaagacauacaacaaagaaacauguauucauaaaaauuacuggacuuuggguaagaauagcacgacucuauaguauucuugccugaggcugcucucguucaccaggcucccaaugcuaucaguugcaauacuucaacaaacguggugccgccugugaaaaaucagcugcuucacugccucugccagagggcuccacuuaauuuggggcauugucaguuauaauaucaagaacaggaaaggccagaagcacuguuaggcuggguuucagcaauguuugggccaaacaauggacuggcaaacuaaccaggaauuuaucagaaaauuccagggagugagacagaccaagggaguuugauaagcucuccacauaucuuggguuaacucgaagcugggugaaugcacagcagagaccagagaagccugagccacccacacaucccuagccaauggagcuuauauaugugugcaggggaaauaaaagagucuggugaagaguaaaagccaggguagguuugaaaacaaccugaacuuugcccuccccagcucacacauagaacuauaggcagacacaaagucuaacuagcuugagguucuugagcacaaccuccgaaaaaucucuggcugaacacuaagcuaugcagauaugggggaaaccccuaagaaacaaggcuuaaaauaaaaauaagaaggaaauaaaacugaauggaaacaucagaggccacauguuguagggaagacagauuucacagauuucauucagggauuaacaaacaaagcaauaacaaucuucaagaggaaaacauaaucuagaauuacuacaauauauuaucuaaaauguucaguauuuaacaaaaaauuaugaaacaugcaaauaaacaagaagguaugcauauccccaaauguugcuuuuaucagacaaagacuacaaggcagcuauuauaaauauaucaaagaauuaaaggaaaccaugcuuaaagauuuaaaggaaagcaugacaacaaugacuucaugaauacaaaucacaacaaagagagagagauuaaauaaaggaacaaauggaaauucuggagcugaagaguaggguaacugaaauuaaaaauucaguagaggagcucaccauaauaaaugaucaguaaacaugaagauggaucuguauaaauuauccaauaugaauaauggagagaaaaaauauuaaacagaaaugaacacagccucagaggccuaugggacaacaucaagcauagcaccaugcaugugaugggaguuccagaaggaggaggggaaaaaaagaggaaaaggaagagauagggcagaaaaaaauauuuggagagacaauagccaaaaacuuuccuuuuguuuuuguucucguuuuuuguuuuuguuuuuuuuagagaugaggucucacuauguugcccaggcuucagugcaguggcuauucacaggcacaaucauaacauagugcacuacaggucaaacucuugggcuaaagcaauccuacugccuccacuucccaaguggcuagggcuacaggugcccacuacugugccuaccuaccaaauuuaauuaaaaaacaaaaaacauuagagaucaaagaagcucaaugaaccuaaaguagguuaaacacuaagagaucuauauucacacaaauuacagucaaaauguugaaagcugaaaacagaaaaucuuaauagcagcacaagaaaaacaauucaucacauagagggaaacaacucacuuuucaucaaaaacaaugaacacacggccgggcgcgguggcucacgccuguaaucccagcacuuugggaggccgagguggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaacaaugaacaccagaaggcaguggagugguauauucuaagugcugaaagaaaaauaacugucagccaggaauuuuauauccagcaaaacuauucuuccaagaugaaguaaaaauaaaaacauuuccagauaaauguagacugaauaauuuauugccaggagacuuauauuaugagaagcacuaauggaaguccuucaggcuaaagggaaaauaaaguaauagccaaugguaacucaaauacagaagaagaaauaaagagcaccagaaaugguaaauaugugaguaaauacaagagccucuauaaauauauuuuccucacuuccucucuuaacuucuuuaaaagauguaagauuacacaaagcacuuauuauaauaccaauguugguuuauaacaaguguuagguuuaaaacauauauagguaauauaugacaguaauagcaaaaagggggaaaaugaguuauauuagagcaaugcuccuauauuuuaccauaauuauauuuugauaagcuaagauauacauuguaauuccuagugcaaucacuaagaaaguaacucaaauuguauaguaaaaaauuaacaaauaaauauaaaugguacacuaaaauauuuauugauuuaauacaaaagaagacaguaaagaaggaacagaggaucaaaaaauaauaugacaguccaaccacaucaauaaccacauuaagaugugaaggucuggcaugguggcucaugccuguaaucccagaacuuugggaggccaagguggguggaucacuugagcucagaaguuuugagaccagccugggcaacauagugaagccccaucucuacaagaaauacaaaaauuagccaggcauggugguaugugucucuaguuccagcuacuuggggaacugaggugggaggauugauugagccugggaggucaaggcugcagugagccauguucacaccacuaccuuguagcuuaaugacagagcaagacccuuccucaaaaacaaauuaaauaaauaaaauaaaacaugaauggacaaaaacacucauucaaaaggcauagugauaagauaaagcaaaaaaaaaaaaaaaaccauuagaugcugucuacaggagacauaccuuaaaucugaaacacaaacaguugaaaguaaaagaauggggaaaagauauacuaugcaaacuauaccaugagagaauuuuccagaauugaugaaaaacaugaauccacagaccuauggagcacacacaugaauauaucauagcaaaacugcagaacaauaaaaucaaagcaagaucucaacagcaaccugagagaaauuaaaacuaccuacaaagacaaucaggaugauagcagacuccuuaacggcaacaacagacagaugacaaaagaauaucuucaaaacacuuagagaaaauaaauguuaagcuagaauucccacaauaagcuaaacuguaucaaacaguauggguaaaauauauuuuuuguuaaaguccaaguuugcuacuaacagauauucacugaaaaaauuacuaaagaauauacuuuaggaggaaacaaugagauguaaggagguaaagugaggaguaaaaaagguagagaugugaguacauacaaucaagagcuaauaauauaaaaaguaacaauaauaauagagacuaauuugacagguuaaaagguagaacuaaaauacugggcaauaaguccacauaagaagggaagaagucaaggaaauuaaaguguccuaagaucacuuaaguauuugaggugauggguaugucaauucacuugauuucauuauuccauauuguauucauaagucauaacauuacuuuauaccccauaaauauauacacccacaauuugucaauuuauaauaaaaauuaaaaguaaaauaggccaggagcauuggcucaugccuguaaucccagaacuuugggaggccaaggcaggcggaugacgaggucaggagaucgagacgauccuggcuaacacggugaaaccccgucuguacuaaaaauacaaaaaaauuagccaggcgugguggcgggcgccuguagucucagcuacuccggagacugaggcagaagaauggcgugaacccaggaagcggagcuugcagugagccgagaucaugccacugcacuccuaccugggcgacagagcgagacugucucaaaaaaaaaaaaaaauuaaaauaauaauaauaauaaguaaaauaaaugcugaaagaaaucaaagaagaacugaauaaauggaaauacauccaauauucaaggauaauaauacuuaauauuguuaagaauacaauacuccauaaauuaaucuacacauucagagcaaucccuucaaauucccaacuauauuuuuuauagaaaucaacaagccuacccaaaauccauguguauaugcaaaggaaacacaaaacacaaagcagucuuuaaaaggaguaacaaaauuguauaauuucagcuuaccaaaaucaauccuuaccacacaguuacagcaaucaaagcaugugguaauagcauaaagauagguucaagcagaccaauggaauaaauuuuaagguucauuaauaaacacaugcauuuaugguaaauugguuuugaaaaaggggccaagaaauuucaaugaggacauaaaagccuuuucaacaaaugaugcugggaaaauuggauauccgcauucaaaaacauaaagcuggaccccuaacuugaaucacacauacacacacacacacacacacacacacacacacacacacuacucaaagugggucauacaucuaaauauaaauguuaaacuacaaaauucuuaggagaaauauuagaguaaauuuuugugaucuugcauuagacaaagauuucuuaaauuuuacaccaaagcacaaucaagaagagaaaaauugaugaauuaugcaucaucaaguuuaaaauguuuuguucuccaaacaacaacauaaaaaauauaaaaauacaaauuacugaauaguggaaaccacuccagcugacaccuuggucagauuucuagccuccagaauugugagaaaauaaauuuuuguugccaaaaaaaagaagaacaagaagggaagaggucaucaaaaucagaaugucggccaggugugguggcucaugucuguaaacccagcacuuugggaggccaaggugaguggaucaccugauaucaggaguugggaaccagccuggccaacauagugaaaccccgucucuacuacaaauacaaaacaguuagccaggugugguggcgcacacguguaaucccaguuauucgggaggcugaggcaggagaaucgcuugaacccgggagauggagguugcagugagcagagaucuagccacugcacucuggccugggcaacagagccagacuccaucacacacacacacacacacacacacacacacaaaaucaaacuguccuauggucucuguauuguuuaggaggagcacagaaaaaacugucagcuucagacguuaagucaaauaugcauaugaaaauuauaaggguaaccacaaagaauaaaauacaauauauaacuauuaaaccagugugggauuugguggggagaagaauaaagaaaacucaaaccaaaaggaggcagcaaaggagcaggaaagcaccaguccaaaggcaagauaaauagaaggcacaaaauaagaugacagaaauaaacccaaggguuagggcuagggucaucacacuacccuagguuuaggccaagggguaaucacagauaaucuguaaucacaauaaauauaaauguacuaaacucucaagcaauuaucagaauggauauagguaaaauguagcuauaacuauuuucaaaaaauauaccugagacauagacaaaaagcuuuaaaguaaaagauggaaaaagguguuuuaggcaaauacuaaacgaaaaaaaaauagacugaagaggaaaaaaguauuaugagacauaauagggugacaucucuagugcuuuaaacuuauuucaucuucuauaaagcaagaauaagaagccauaccuccaggcuaaauaugucaaguauaugugauguuagauaaugcaaagugcuaagaagaaggagaaagagcaggaggaagaagacagagaagaccucaacaaugacaguacagggaaggggaauaggaaauguuggaaagggagaguuaaauuaaaauuuuagggcauuugggaaaagaccugaaagaaguuaggaagugauccaugggaguggcugggaaggggacauccaggcaaagguaguggcaaaugcaagggcccuagggagucuaguguggcuggagugggagggaggggaacagccuuaggagaggaacucagaggcagcuccacuccagcgaggucaccaggucaugcaggccucgaaagccaugguuagguucuugauguuuacucugagcaacgugaggguuuugaacagaagagcgagugugauuauaguuuuuaaagaucaugugggcuguaaugagagaggaugaaguggagcaagagcaaauacaggagaccaacuacaaggcagugccaucguccagacaaaaggacauggugccuggaagaaccgguggcaguggagauggugaggagugguuggauccuggauauauuuuaaaggugggaccagcaggaucagcugaaggauuggaggugaguugugagagagagaaaguggucaagacugacuucaggcuuuuaaaccagagcuucuagaaggauaaaguugccauuaucugaaauggagaauucagaggauagagcagcaacugcggcagccaggggcgggaggggauuguggaggguguguguaucagcaguuuaguuuuggacaucuuaaguuugagaugucuacuaaacauccgaaugagauuucaauacacaguuagacauauaugccuggcauuuacaagagaguuugggcuggagauauacauuugguagucaucaggcucucagccaugagcccagacaagaucaccuaaggaguagguauagagagaaguccagggacugagcccuagaaaacuccaguguuuagauccuggggaguuauagaggcacccaagacacagacugaggauaagcagccagggagggaaucuaggagaauguagagggugugguguccuccaagccaaccaaguaaagucuuucaggaaggaaggagucuucaacuguguuacauguggcugaugggugagguaaaaugagggcuaagcauuaacucguggguuuaacaacauaggcuggucugauguaaaaagagagcugugccaaucagauuuccugguucaggcaauggaacaaaggaauacugagagacugcagcagugaacaaugagagccaacguggacagucuuuugcauugcauuuuuuccccagcauacaguaaaaauagcuaaccuuuauugagugcuggcuaugugccaagaacacuauuaugaugccuauuuuuaaaaagggaaaguggggcucaaaaaaagucaaguaacuugccccaggucagucagcugguaaguagccaagcuggaauucaaccccaucucauguguuuaaucacuaaaugcugcugcuuccgucuaauuaaggggaaagucuacacuuagauauggaacucacauuuauaaaaugccauuuuugggccaaguaccuuguguuugcauacauuuucucacugaacucucaaaaaccccugcaaaauaacugucccuaaccauugccauuuuaaagaugagaaauggagguguugaaaaguaaggucucuugcuggugguuccucaggacagagggguaagguggcagaauucaggcccagaucaugucugaggcugcagcuuggccugcgcccugucuguacaaaucaauucuacuuuuuuuuuuuuuuuuuuuuaagacagagccucacugugucgcccaggcuggaaugcaguggcaccaucucggcucauucucgccauucuccugccucagccucccgaguagcugggacuacaggcacccgccaccaugccuggcuaauuuuuuauauuuuuaguagagacgggguuucaccguguuagccaggcuggucuuggucuccugaccucgugauccgaccaccucggccucccaaagugcugggaucacaggcgagagccacugcacccggccaauccuaccuuuuacaugggggcaaggagggagcaaucaggccugugaagagccccagggcacuggcguugcccuuacaagcucaucacuuugaggacacuugguggguuuuaaggcugugauucucugagacucccagccugagucagcuccaggaguccuaaggcagguuucccaguuuccccagagccaggccugagcucucuccacaggcagacccucugauuuuaaguccuaagcugagcaugggacugaaucccuuuuucacucuuuccuccaggcauacugggccucucccuaccuguccaguggugagggaacggcuguagccagggauggagcuccggggguggauccggggugggacacagcagcuggaaaagggcaaaauuccggagucagaacaguggacugcuaggaggugggggaggggagauaauagcacuggggccccugaguaaguccuauuccucagaacccccaaagagagaucccuuaggagacccuggguaaagagacucccaaagaggcaccagagaaggacucccaccaagacccucccuuuacauggaguggagugagacaccccaguugaaaccuaagcaggacuaccugacuggcacccacucuacacacaucucccgcaggaguccagcaucagccuccugaccccgcaccccccggcccucccuguccuuacuugauccuggccugguccacgcuggaggagcgacggguggugaagcgucgggcgacugcuuugggagaugucuuggggcugccgucugagucuccgcucuccucaucccccauggcuuugauguagcugccgcuccgcauccugcggcaggggaucuccccauccuugccaccggugggguaacccccccagucaucuugcggcaccugcaggaacaggggucucugucucucagacaugacccuaguaaaucuagaggccaggacucuuuccccacugccagugggagaugcccugcccuggcuugaacaggcacacucagguacaugcagaggcagaaggggagguagggucucaggcuguccccgucccuuacaagagacaccucgucauccuccacagaccuucugcacuuaauuaagggccaccuagagagucugagggagugacauggcaggcgucaagcgguugaugaucagaggccaaagugaccugugucaaucccaugcccagcagucaggcaucaccugaccucagucaaccuucuaccccuccuucuccuucauccuuucaaccugcuuacauuccaaauccucucuccuuccccgcuguggggagccacagagggcuucaugcaggggagugacaucagauuuguguugcagaaagagcucucccacaguccaaacagaggcuggauuguggagggccaggagcagggcagaggcucaaguggcgagaggacgaccaauuaggaggcugaugcuguuauccaggcaagagaugaugaggccuaaauuaagacaaugacaaugagggggaagaggaggagauggaaaugagagguguuaaggagcaucagugagccugauuagacgugggggaugagggggcgggaggagucgaggaugacugccaggcugcuggcugaggaccugggggagggugcugccgcucacugagccauagaaccccagagaaacaagucuggggaaaggugguagggucgggguugagcaccuugagcuuggcauagaacuguugagcaggugguuggauguuugguucugggauucaguggggagaucggggcuggaggcggacaugugggagucaugggcggcagcugaauccauagcagugaaugagacagcccaggggagagaagaagagagaugagcagagauccacugacauuuaaaaagggacugugaagaaaggaagaggagccugugaagucaccugagaaggagugggcagagggguaggagggaagucaggaaaaugccaugucauagaaacaggagacauuucaagaauaaaaggagucgauuaugucaaaugccacagugcguucagagguuaguaacucaggcucgggaauuagaagauccaugugcaauucuggccccaucacuugcuggauaggugaacuuaagcaaaacagauuaaccucuaagugucaguuuccuugucugcgaguuggucaugauacuuaugccuacaucagaggguugguggcaaagauaaaugagccaauagagaguuuccaggacauagaaagugcucaauaaaugguaacaauuauuauaggcacugaaaaguagcuuuugaagauagcgcucaagagaucaucuguggccacugccaggacaugucaaugacagggaguuuggaaaucagaccacagugaggggagaauugaagggaagugaagaguaggugucuaugcucuaagaacucgauuaugaaggacauggaaggugggauggggcugcagaaauauuuuuuaggaugcaagcgacuuuggacauguuuucagaaugauggaaagagccaguaaaaauagucuuuaaaccucagaagggagaacaguucagggauggagggggucaugaugagaugggaucaagcccuggaagaaggaucggccugggauggguggucccagcuuuuccuaugagccaaggaaggggacgaggguggcugggaauuuggaugcgucuagagagaugcugucaggaagcugagggaguccgugaugucagccuacacuucggaaaaugagguguaagugaagacgugggggagaggacugggggagguagggaggauuuaaaacacuuguguaaagaacagguuaaaugggguagggaugggagcuccaaaagggguaacgccucagggacagcauaggguucaggggaaagguggagacucuggggaugagauggggucccuugaaggaacccacgggcaggagcagggcucuucaaggggcuagggcucauuuggaugaugggaaacaaagagaugaggcuccauaaagaaacaggggcucagaguggacagagggauccuggaaaaggcuuaagagaaagcugguacccagugggagaaacagggcuuugacaaucagaucgggaguccagcaaagacaccuggccucauggggccagccuccccugcuuuuguaccaggggagugcgaggcugucuggagggucccuauagcccuuugguucuuccccacaugggcucagacuucccaguccucagaugcccuggaacuccagaccggagggaucauuccccuuccccauucucuacagagagcagcaggcagguggagagaggcaggccagcagaugggaaggccauacugcaggguucccauucuagccacugcagagcuccucugcaggacacugugaggugcauguuaaaaaggaagcccccagggaggucagggcagcccugaagcagcagcagggagcagcgaaauggcaacaagucuucagggauggcaaggaaucggcuaugggggagaaaggaugggugcugccucccugcacccugcaguucccagcuuagagcaccucccuacccagggagggggcaaaccaggccaauccagaagucccuucuugcuugcacuguggcccuaugugcucccuugggccuucaugaguucuccaggagagcccuaacuugugugcaacuuacccagcaaggccaaugccccacaaagacacacacagccucuauucuccauaccuuugaacaugcuguauagucucuucccaauacacguuuagccagcacucaacaacugcaacuccuccacugagauucagcucaggggacauuccucacccaggucagugaggugucuccucuguguucccaagaugcccagggcucuccccuaucacagccucaucacacuguauucuaucugcuuccuugucuauucccacucuacacugugagcuccucacaagcagcaucuguaucuucaucuuuguauccacagcacccagaaaacgcucauugaauaaauagaucuguaucaacuaugucgaaugcggaaauacacuggaccuccagaacuuguauugacuuuuucuccuaaaauuacggcaggacuuaagaaaacgaugugggcuggaugaggcuggggugaaggcuccauaaaaaguaggaaucagaguuccuggccucaccugcagagaccauaaaugugguaagacaagaugagaacagcaugccagcuaucaccugcaccauccacucccgggaggcccugccugaauuguaucagggcugaaacccaguuugucccccagccuaggaaaacacaugagacacaugaaacucccaggaccccuccacagcuucggcugucccaccaccgguaccccggaaugacaaaccucagcagaggcacauucuagaaauaacugaucuucauauucaaacaugugggccauccggauuauagcagaaaagagggcuggagaaggcuuuggggcaggagaacugcuuuccaacugccgaccuucaaucuugagagcagcuacaacuaaggugcaccucucuauccugucuacugccugcccucaacuucauuaugccuccaaccuccgaagacagauaucagcacagccuguccaaaacaguaggucaagggaaaaucucuagggacagacacaucauuagaacagaagggccccuucauugcacaaauggggaaagugaagccccaaaggagcucagagugacccaauggggcagggcagagccucccuacacccaggcccuccaucacagggacagcuggcucccacccaacccuuuccacugcucccuaguugacaagacuggugaaggcuaaggacucuguuccccaaccccaaaaaagccucaccugcagauagugauaaguccuggcuuuggccuuggucuccggacccaggagccccuugccuggcccggcccccggguauccaucccggcccuggcugaccaucaugguaugccaggcacuucgcuugaccgacuguccauccagugacauggacaugccagugcaggcaaggcagcggccuuccgacccgcccgagcgccccuugaagcucaagucccgguaggacccaucuggacccuccaggcagaagggaccaccaggcuccccagggggccucccacccgccaggaagccgcuaucacuguccaaguugucaucggaacuccaccagccuguggacuuggccuggugccgcccaucccccuugcgguccuugcucuugcuccucuugccgugccgggacugguggugguggugauggugguggugaugguggugaugggaggugugggggccuccagagcccgggccgggguagcugucuccuccagagccaccucuucccucagccuugggcccauuauagucccgcuuccccggcgccuccagagagugggacuuggcaaagagcuucugcacagaaugaaccaggugccggaugcggcuagggcucucacugcggggcucuggggcagugcccgucccuggcgcuggcccgggcccugccccugcuggcccucgcugguaugguaguguguggaagccaucuuguugaacuggcaacugcuuuucaaacugauccaggaguguaggaggcaggcggggggcacccuugcccuguggguggcccacacagucuucacaggugucgaaggggcccuggccaggguacauccuggggaaggugcugcuaccccccccaaccccggcccccgcuggcccucccucagggccuaccgacggccccucacucaggcucaggggcccuucaggagaaaugugucccaggccagcucucggggcacagaagcggggcucgguggagaaggccucccuggagcccagcagguauggggcccuggcagcagggcccacguccauaugcuguuggucagcaaagcgggcugggcggggauggcugccucggucgccaugguaaccccucau

SEQ ID NO: 192931 - RNA, 134212 nt, Homo sapiens
agugggccgccauguugucggagugaaagguaagggggagcgagagcgccagagagagaagaucggggggcugaaauccaucuucauccuaccgcuccgcccgugaguauccgcaccccaccggccccaaacgcugcuccggaccccuaacgagcagauugucccuucauauugguguuugagagugguugugggggugagaagggcuuuggaaaagccgccggggcccuggcugaggcuucucacucgcuguuccucguacauguuuuggagucagcagcaaggccccuauuguuaucaaaggagggaggggguggggagcggggucgaagcuaggaaaaugcuggggguuuaggcccgagcccagggcguagacgugccucuacauuuuugccuggcccuguugggaaccaccgaagauugauguugccauucggguugcuuuuuuugauggguuugcgaagccccgagucuucuguguggccaugaaguguaauucugugccaccccgauuucuucgacuucuugagcuuccguggcagcgccggaggaggaggaacaauaaaucgcuuuagaagcagccguggcccuuguccacaggcgagauucaccgugggggaacuuugcgagccuuaaauguggagaaguggcgaucaggaaguuucagaaugcuuuuuaggcuccuggguugcuguggccuuuuguuuccgugugagcuuguguuuuugguggguucuuccuuuuugagccucccgguguuggugucucucuucacucaaagagggguucaccccuugcuaguaggaaaaucuagauacacaauacuaguuuuaguccucacaaacaugcuugguaaacauagaucauuuguuuuacuugucaguaccauucccacgucaagugaggaauacacuccuguaacuuuucccuccuauagcccccccccccccccccgcugaaaaaacaaagccagaaacccacacacagcauuaccagagaaggcuuuauucucccguaacuuagauuguuaccuuuuauuguucaauuaagaaaacacuguucucagcccucgauaccauuuugcucaauuccuguuauuacugggauuaauuaagaauaagauuuuaugaagcuuuuccuggguucuguuuuaaagucaguuaacuucugaaacaauaggcuuagcauuuuguuucuugaaagcaccuaaaaacuuacuaagacaggcccaaccccaagaaauguggcuuccgaugcaguuuucguaagcaaaauaaacauuuugacccuuugcuaauuuuaacuuuauaaaacacuggggggcuguugauucuuuaucugggcucuugggaaacgcucuccggauucugaacuuugaguuaguguuuugcuuuagcgacaauugaauucauuuuguucaaggccacagcuuuuugaaguuggaauuuguuuaguuuagguuuaaaaugaacuguuuuaagauaaauuuaugaccacagaauguuuguuaagugugguaaaaauaaacaccuuuuaaaccacuaagcauuuuaguaaaaggugagccauggaaauaaaguaaaccguguuccuuugaauucaacucaauuagugauauuuuaaaaaacuuuguaaacauuugaaagcugugaaagaguagcuggacugagcacuucuaguugcuuaaaguacuuauaaggugucauuuguaaaaaaaucacauuuuaaaugcuacacguauuagugagcuuuucugauauuuaggauacugaguuuuuaauuuuugugccguauuugccaaaauaccacaaaacuacccaagauaacauguuaauugcuuagguauuugcucacuuugaaacuguucugccagguuuucucugguuugagaaacugccuugccucuuuagguaaagcaggaagucuuagggcauacagauagcuuuacaaaagccaauuguuucguuugaacauuuuuauaggagucuuuucuuucccccauuccuuuuagaaugaagguguguuuagugugcgucagugauaaacuccucuuuuauguggauauucuuuguuagauaacuuuuuucuuuuaaaaauuuuuauuuguauaauuugugagguacaaguguaauuuguacaugcguguauugcguaguggugaagccagggcuuuuuguguguccaucacuggaauaacguacauuguccuccuuagguaaucucucauuauccuucucucagccuccuagauaacuauuuugagaaggcuuuuauuucagaaaagauugcauuugcuguuuuaggaauucuguuagggacuggaguugccuuaacuagggguaacuaaauucuaagagucuuaagcacgaugacuuuaaauuuaccaaaaacuuuuauauuuaucucauuuucauuaagaaaaacccaaaacauugagagucauagaggaaggauuucuuucauuuucuagaugaggaaacagguaguuuuguuuagugaaagaacuuggguuuuggaacucuuggccugcucuagaacaaagauuguuaggucgagauuuccuuuuagaacagaaugggacugucuaguauuaguacuaagagaguaaugaauucuuuaaaaaaccaagcagggaggcauuaggcugguuugcacuuuugaaagaccgauggugaaaccgggcuaugacuuuuugguuuugguacuugagcagggacuagugucuagguuagacuacuccaguacccugcuaagguucugauggauuggaauucuuaaccuagacuaggcauuuccaaauuaggcuuuaaacaaauuacaaauuccauugugucuucuuaggcuggcuucaaaaacaugaauuuaguugugagaagcaaaugcuacuuuaucagaagguuuauuuauucaacagagagauaguagauuuguuauucauguguuuuugaagcaucacaguggggguugggagaagagauaaagcauuuguagcaguagacuguuaggccgauggcuuugaaauuagaccguggcuguggacagguguguccuaauugguaacugauuuauuuacuuuguagcuuuuuuuuuuuuuuuuugagauggagucucacucugucguccaggcuggagugcagugccuugaucucggcucacugcaaccuccgccuccuggguucaagcgauucuucugccucagucucccgaguagcugggacuacaggugcgugccaccacaccuggcuacuuuuuauauuuuuaguagagacgggguuucaguauauuggccaggcuggucuggaauucugaccuggagaugcgccugccuccgccucccaaagugcugggauuacaggcguaagccaccguguccggacacuuuguagcauuuuuuaaaagcacccacaggcuggcaaguguucuaucuuaaguacagaugcaguuuuugguuuuaaggaacuuuaguguuucauaguaacauuugagggauucuuuguuggucuuccagaggaguagaggauacaaaugagacauauuguugaguuacuccugcaagggguuaguagaaagaaguaagcuugggaacgauuaggguuugaauccuuucucugcuacuugcuaguugaauggccuuggaaacaucccauuuuccuccuguaccuuaguguuuucauuuguaaaauagaaauaauaauggcuaccuuucaaugcuuuugugaugagacaaugucugcgauauauucauuacacuauuaccguguugaagcuucuguuuguuuguuuguuuuugagacaggaacucacucugucgcccaagcgggugugcagccucccgcuccugggcucaaaugauccucccaccucagccucccuaguagcugggacuauaggcacaugccaccaugccuggcuaauuauuuuuaguagagauaggucuugcuauguugcccaggcuggucuugaacuccugggcucaagcugucugcccaccucagccucccaaagugcugggauuguagguaugagccaccacacccaacugaggcuucugguuuguauagugaggcuuucuuuuuuuuuuauaauuuaaaaaaauuauuuuauuuauuuauuuauuuugagacagagucucgcucugucgcccggcuggagcacaguggugcgaccucugccucccugguucaagugauucuccugccucagccucccaaguagcugggauuacaggcgcgugccaccaagccuggcuaauuucuguguuuucaguagagucgggguuucaccauguuagccaggauggucuugaucuccugaccucaugauccacccgccucggccucccaaagugcugggauuacaggcaugagccaccgugcccaaccuccauuggccuucuuagagccuuauuuuuuaauaaaauaauagagaugggggucucacuguguugccuaggcuggucuucagcuccuggcucaagcgauucucccugccuaagucuccgaaggugcugggaugacaggagugagccacugugcccagccuguagugaggcuuucuacacuaauaugaaguguuuaaauuugguuuggucucauccuguuuauaguaguugaaguacuaauggcauaaugugauuacaguuaauaguuguaaguuacugguaaaaauauuaaugcuuuuaaaaaucagugacaacugaggagagggcuuaggcuaaaagcauucugcugcuguucuuggucagaggguuuuauuguuucuuuaagaaauauccuaucaauauauuggagguuuuauuuauuuauuuauuuauuauuuuuuuuuuuuuuacugaaacagagucucgauuugucgcccaggcuggagugcaguggugcgaucuuggcucacugcaaccucugccucccggguucaaacgauucuccugccucagcuucccaaguaguugggauuaaaaguguguaccaccacacccaguuaauuuuuguauuuccaguagagaugggguuucauaauguuggccaggcuggucucgaacuccugaccucaagugauacaccugccuuggccuccgaaguguugggauuauaggcgugagccaccucgccuggccaauauguuggacacuuuaagggauccuuucaaauuacacaaucugagccauugcuacuuauauauggguuuaggcuuuuguuuaguuauuagcauaugucugcuccagcuguaaaguugugauugauugauugauugauuuuuugagagagagucucgcucugucacccagguuggaguacaguggcaugaucucggcucacugcaaccuuugccuucuggauucaagccauucuccugccucagccucccgaguagcugggauuacaggugcccagcaccauaccuggcuaauuuuuauauuuuuaguagagaugggguuucaccauguuggccaggcuggucuugaacuccugacgucaggugauccacccacuuuggccucccaaagugcugggauuacaggcaugagccaccacacccggccgaaguugugauaguuuuaaaaaggcuuuuggggcugggcgcgguggcucacgccuguaaucccagcacuuccggaggccgagguggguagaucaccugaggucgggaguucgagaccagccuggccaacauggugaaaccccgucuuuacuaaaaauacaaaaaauuagccacccgugguggugggcgccuguaguaccagcuacucaggaggcugaggcaggagagucgcuugagucuaggaggcggaggcuguagugagccgagaucgcgucauugcacccuagccugggcaacaggggcaaaacucuugucucaaaaaaaaaaaagcuuuuguucauuuaaaaacugucaguugguuugagguauaaguaaguuggguagacugauagaagucuaauucuguauugcuauguguugguuaacaacauaaacuucucugaagugguaguauugaguucugaucccaauaccuugccagagugcaugccaccaacgacauuuauuuauuguaaaagacaugggguucauguuuuuaucuuaguguguuuuauguuucaaaagauggaaauauuaaauauuuguaaccuguuuguccuuagguguugguggaaugagcguugcaugugucuugaagagaaaagcagugcuuuggcaggacucuuucagcccccaccugaaacaucacccucaagaaccagcuaaucccaacaugccuguuguuuugacaucuggaacagggucgcaagcgcagccacaaccagcugcaaaucaggcucuugcagcugggacucacuccagcccugucccaggaucuauaggaguugcaggccguucccaggacgacgcuaugguggacuacuucuuucagaggcagcauggugagcagcuugggggaggaggaaguggaggaggcggcuauaauaauagcaaacaucgauggccuacuggggauaacauucaugcagaacaucagguaaaaaaaaguucacuauuuuagcuuugacauuccuuuauaaucacuguccacuuaggauaucugcuuucaaugaaugucuuuaaaaacuuaaauugcugauuucauuugguacaaacaguuacuuguuauaaagguugaucauuguaauacuguuacugggucauuuaucauucuggugcuaaauaguaaauagccaauucauucauucauucauucauuugagacagagucuugcucugucacccaggcuggaguguagucgccugaucucggcuugaucucggcucacugcagcugcugccucccagguucaagcaguucuccugccucagccuccugaguagcugggacuacaggugugcaccaccacgccuggcugauuauguauuuucaguagaaacaggguuucaccauguuguccaggcuggccucgaacuccugaccucaagugaucugcccgcuucggccucccaaagugcugggauuacaguugugagccacccacgcccggccuauagaaugcauuuuuuuuuuuuuuuaagacggagucucacucuuuugcccaggcuggagugcacuggcgcgaucucugcucacugcaagcuccgccucccagguucaugccauucuccugccucagccucccgaguagcugggacuacaggugcccgcaccaugccuggcuaauuuuuuguauuuuuuuugguagagacgggguuucacuguguuagccaggauggucucuaucuccugaccucgugauccacccaucucggccucccaaagugcugggauuacaggcgugagccacugcgcccggccuacaacgcauuuuuaagaacacuuuuuuuggaacaaaggauucuuuuuuuuacuguugacauaagaacugcuaggguuguuuauaggauagauacauauuuuugaaucuuuucucuugggugugggugacuugauuuuaagauguuguaguugaaaguagggggaaguugauaacaucagcugcucaagugaaauuuauuugaaaugggacugauauauugugucagagagaagugguuguggcuuuuagguuuuaaccaccuuuguccucuuguuauuguuuaauuuuuaauuuuaacauguucagucuuauuaaucuaaaaccauagugggaaucauagcauauuuuacugagaagagagguuagccuuauccauguuuccugauuucuugauaaugaccaaccaaaagauuagacuguuuugaucaggguauucuuugaaauuggguauagguugaauuuggaaagguucauuuugugucacccgucaguacugauuagcgagaacugacauuuuucauuaggcuucuagugcuucuguuuuacuucagaaaaaaucagguacaaacauaccugcaagucugauuuuauuauacuuccucugauccccccaaaagugaaccauaguuguuuuuuuuuuuuuuuuuuuuuuugagauggagucucgcucugucgcccaggcuggagugcaguggcacaaucucggcucacugcaaccucccccucccagguuuaagcaauucuccugccuuaccuucccgaguagcugggauuacaggcacccaccuccauaccuggcuaauuuuuguauuuuuagcagagagaggguuucaccauguuggccgggcuggucuugaacuccugaccucaugugauccaccugccucagccucccaaagugcugggauuacgggugugagccaccaugcccagcccuuuuuuuuuuuucuuuuucuuuuuuuuuuuuuuuuugagacaaggucuggcucugucauccaggcuggaguguggugauaugaugauauuggcucacugcaaccacggucucccugguucaagcgauccucccaccucagucuccugaguagcugggacuacagguuugcaacacuacacccggcuacuuuuguauuuuuuguagagacgggguuuugccauguuggccaggcucuacuuugagcccaggcucacagugauccaccugccuuggacucccagagugcugggauugcaagugugagcuacugcaucugaccaguucuuuacuauagucgaaacaaagacaggcugggugcaguggcucaugccuguaaucccagcacuuugggaggccgagguggguggaucaccugagguaaggaguuugagaccagccugaccaacauggugaaacccugucucuacuaaaaaugcagaaauuagccaggcgugguggcgcaugcuuguaaucccagcuacuuggaaggcugaggcaggagagucacuugaaccugggacagggaguuugcagugagcugagaucuugccauugcacuccagccuaggcaaugggugaaacuccaucucaaaaaauaaaguaaaaaauuagcugggcgugggggcacaugccuguguuuccagcugcuugggagccugagguggaaggauugcuugagcguggguggcagaaguugcagugaacagagaucaugccacugcacuucagccugggcaacagagugggacccugucucaaaaaaaaaaaaaaaaaaaaaaaaaaaaaaaaaaagaaaagaaaaggaagguuuucagcuguaaggcugaaagaaggcucaccccugcaaucucaacacuuugggaggucaaggcagguggaucaccugaggucaggaguucaagaccagccuggccaacauggugaaaccccgucucuacuaauaauacaaaaaaauuagccuggcaugguggugcacaccuguaaucccagcuccucgggaggcugaggcaggagaaucgcuugaacccgggagguggagguugcagugagcagagaucacaccauugcacuccagccugagugacaagagcgaaacucugucuccaaaaaaagaaaaaagaaagauuuucucuuucuuugggaugaagauaugcacagaauuuggugauugaauuagaaaucuuauauccuggaaagaugaaguaauggaggaaaaguacagagugccucugguuugggacacagugauuacauuugauaggacaccuguugaguuugagguagaagcagaauaucuggguguauacuguaggcagcucuaccuguagcaggaaaucaagguaggagguauuugauuuggguggcaucuguguaguggggcaaaaacaaacccuguaaucucuguacuauuuggcuaaauguuauucaaaaaucauaaacauugguuuuuuaaaaucuguaauaaagaucuauaagaucuuuuguuguguuuccuaaugauagacugauggguggaagcugaaaggagagucaaggugccuggcagguucuuugcuaggugagcaaaucaaacucuaggucaguccuuggcagagcucuaagaucugauuauugcugugcaaguuaagaagcguuuauugaaggcuuacucaggccucugucuuacacugagcccuaucauaaggaaucacaucugacuuacugagcaguuuuauccaggucaguuagcaaacuugaguuaauaauaguaaauggcaaaaccuguuucccacucagguggccuaaaccagugaccuuggaauuggcauucaucauuacaacacaauucuuugggcuggacgcaugaaauaaugaacaacguuggggaacucaggguaguugguauauugcaguuguggaccacccacagguuacuuuucuguagucauuauaguguauuguacugguuuuaguguuguucucaccuucuggacugaacuauucuagaucagagacuuguguuuuucaugccccuuuuccaggagguauuaugaaacuuucguguugauugaaugagggaagacgagagguucuucaguuuugcgcucagguaaaggagugggucuuacagcucagucauccugcugggaaacacauggcaacagguagaggccacuugauaggcagcugugcuaaggguagcauaauugaagagcaaaggggcacaucucuagguggagaaucucugcccuuauuagccacuguuacggauaggagguguaagagggugccugaucugucaugugggucagagugaaaaagagguugagaaccacugaugauaacggaaauauuuauauguucuaggcauugggcuauuguauuuccuauauauaauccuuacagcaauccuaugaaggagauaaauacccuuuuuugaaaagugagaaacugaggcuuuguuaccagguaauaccugguuuuugaaaucagucuuugauuccaguguccacguucuagaucuguuucugcuucccuaggcaagauaaaccagacaaaacugugcaaccaaguggcacauuacagggccaaagaauuguuuugccauaauuuugcuugaaauuuagagacuguaaacuuaauaaugagaugaauacaaauguugaccauucuccuauaauugcaggaguacuugcccccaacucccaaaagcaguaaugguaaaguccauuuuucuucaguucuguuuuuuauuacauauguguucuaagugguaauguggauggaaaauuaucucuguagagacagaaugacucaauauaaagugauccuauugccagcucauucuacccuaccacugggccuuuuuuuuuuuuuuuuuuuuuuuaguggcccuuuggcauaauggaacaaaguuugagaucgaauuggcaggaugcuuucacuagugaacuagcgaaguaaagaauaucacaggcugugaugccaguagcauuggagggaggggaacucuuugucaugccagguacuuuauuucucucguaauuacucccauuuaagagcaauugcuuuuacacuuuuuucuuuuuauuuauugagacaggguuucacuccuguugccgaggcuggagugcaaugggcaccaucuaggcucacugcaaccucugccuccucggcucaagcgauucuucugccuuagccucccuauccugggaccacaggcacacgucacaacaccuagcucaucuuuguauuuuuuguagagguggaguuuugccaugcucaggcuggucucaaacuccuuuuuuuuuuuuuuuuuuuuuuuuuuugaaauaaagucuugcucuguaguccaggcuggagugcagugacgcgaucucagcucacugcaaccuccgccuccuggguucaagugauucuccugccucagucuccccaguagcugggacuacaagugugcaccaccacgcccggcuaauuuuguauuuuuaguagaaacaagguuucaccauguuggccaggcuagucucgaacuccuaaccucaggugauccaccugccucggccucccaaagugcugggauuauaggcaugagccaccguuccugggccacuuguauacuuacauuaaaaaguuuuucauuuuuuggcuggacgcaguggcucacaccuguaaucgcagcacuuugggaggcugaggaggguggauaguuugagcccccaggaguucgagagcagccuggacaacauggugagaucaugucucuacaaaauauacagaaauuagccaggcaugguggcgcugugccuguggucccagcuacuuggagggcugagguaggaggaucacuugagcccaggagacguagguugcagugagccgagauugugccacugcacuccauuuugggugacagaguugagacccugucucaaaaaaaaaaaaaggccucccaaagugcugggauuacaggcgugagccacugcgcccggcagagagcccucauuuuugggccaaacugaggucuucggagggaagugagggaaagaagucucaugaaaaaaauuuuuuuuuuuuuuuugccuguaaaauuauacccauaguauacaauuaagauaauguggacugggcgugguggcucacgccuguacucccagcacuuugggaggcugaggcagguggaucacgaggucaggcguuugagaccagccaacauggugaaacccugucucuacuaaaaauacaaaaauuagccaggugugguggcacgugccuguaaucccagcuacucaggagaggcaggaaaaucgcuugaaucgggggcagagguugcagugagccgagaucccgccacugcauuccagccugggugacagagggagacucugucucaaaaaaaaaaaaagaugauggauauugggccaggcgugguggcuuaugccuguaaucccagcacuuuuggaggccgaggugggcggaucaguugaggccaggaguucgagacuaaccugggcaacaugaugaaaccccgugucuacuaaaaauacaaaaaucagccgggcgucguggcgcguuacuguaauuccagcugcucgagaggcugaggcaugagaauugcucuaacccgggaagcagggcagagguugcagugagcugagaucgcacaacugcacuccagccugggcgacagagcaaggcucugucucaaaaaaaaaaaaaaaagauaauggauauggagcaaaauacuagaaaauaaagcuggguacauuggcuccugccucuaaucccagauacucaggaggcugggucaggaggguugcuugaggccaggaguuugagaccagccugggcaauauagugagacacuguaucuacaauaaaaaggaaaaaaauuagcugggcaugguggcauaugccuguaguccuacucaagggaggaucacuugagcccagggaguucaggcacuccagccugugugacagugagauccugucucuuugaaaagaaaaaaaaaaugaaaaaaaggaaauuuaaaaaacaaauacuaggaaacacuagacacaucuucccacccaaaugaguuauguauuugaaaauguuacucauuuugggcugggcacgguggcucaugucuguaaucccagcacuuugggaggccgaggcaggcggaucacgagaucaggagaucgagaccauccuggcuaacacggugaaacccugucucuacuaaaaauaugaaaaauuagccgggugugguggugggcgccuguagucccagcuacucgggagucugaggcaggagaauggcaugaacccgggagguggagcuugcagugagccaagaucgcaccacugcccuccagccugggcgacagagcaagacuccgucuccaaagaaaaaaaaaaguuacuuauuuugacaguaauuuuuauaccuuuagauuuuuuucuuuccugaauaacauugaaaauuucauuacuaaaagccuaaggucaagucuuugacuugagaguguuuuauucuuguauugugaaaucuguuuucucuguaaacugcugugggauagauaaacugguugaugaaauagggcaaaaaaauuaaagucgauugguugaacuguagccucuguacuggauuaugagggacagagguagaagcuuugcccugggggaagggaaauuuggaggacaguuccacagagcuuacccacuuugcuugcacucuuuuagcacuaggauauaucaguauccaucauagauugacagccuauaggagauaauuccagagaaccaggcaaaaaaaaaaaaucagugggugaggccaggugcaguggcucauaccuauaaucccagcacuuugggaggccaaggcaggcggaucaccugaggucaggaguuggagaccagccugaccaacauggagaaaccccaucucuacaaaaaauacaaaauuaguggggcgugguggcgcacgccuguaaucccagcuacuuggguggcugaggcaggagaauugcuugaaccugggaggcagaguuugcggugagccgagauugugccauugcacuccacucugggcaacaagagcgaaaugccgucucaaaaaaaaaaaaaaaaaauucaguggaugaauauauuuugacuccacuuguaccuucuuuuucuuucacuugguguggccaucuuaacaaugauauucugauacccaccccugacaugucaaccagucuuacucuucagugcuguuagucuuuuuuuuuuugaaggguuuuaaaaauuuuauuuuuauuauguauuaaaaaagagcuaucaugguuucuuucauugggguggaugccuuggauaauccauucaaggaagaucacuucguccaacuuaaugcagcccaauuuaaugaaacccauuuucuucgcuuacugacagaaacacugguggggcauauugaggccguaauuuggaucagaucuugcuggucugagcauacgcaacaagagagagaacccuggcugaauuuuugcgaguggcuccaguagagcugcuggugacccaucuugcucucaggagugcagugagacaaaaggaaagagcuccaguuaauuuuuauaccuuguaauuaacagggacuacuauguuaaacugggagggagcccaaguauuucccaaacuggggagucuugacauucccuagaaaugucuuucuguuguaccugcugauggacucucuuagacaaugaaucuugucuaccuggguagauugccuuagcauuugugcuaguagcauuugguuaacauguuaaagcugaauaauccaucuuucauauuuuguuucucuuacacauguacucuuagagccuuuucauuaugcucagaauucacaaggcuuaacauuaugugcuuggucaaaggaaucaucagcaggccuucuucaacuauaacuuuuucuuuuuuuugagacagagucucacuuugucacccacuggcacuaucuaggcucacugaaaccucugccuccuuuguacaagcaaucuggugccucagccuccugaguagcugggauuacagggguguaccaccaugccuggcuaauuuuuguauuuuuaguagagacaggguuucacaauguuguccaggcugguuuuaaacuccuggucucaagcaguccucgcaccuuggccucccaaaguacugagauuaaaagugugagccacguaccuggccugacuauaauuuuaaccuagccugauuauaacuuuaagaauuaccuuguuccaguguaaacaaaagaaguucggcugguugcaauuggcucacgccuguaaucccagcacuuugggaggcugaggugggcggaucaccugaggucaggaguuugagaccagccuggccaacauggugaaaccccgucucuacuaaaaaauacaaaaauuagccagguguguuggcgggugccuguggucccagcuacuugggaggcugaggcaggagaaucacuugaaccugggaggcggagauugcagugagcugagauugcaccacugcacuccagcuugggcgacagagcaagacucugucucaaaaaaaaaaaaaaaaaaaaaaaaggaaguucagucagaugcucuucucuaaugcugaaugguacuugauuauauaugccucugaaauggcaacuuguagagauauuuaugauguaucuuuaccuuguuuaauuuuagaagguuuuuuaaauuuaauuuuauuuuuuugagauggaguuucauccuuucaccuaggcuggagagaaguggcaggaucucagaucacugcaaccucuuccuccuggguucaagcaguucuccugcuucagccucccaagcaguugggauuauacguguccacuaccaugccuggcuaauuuuuuuuuuuuuuugagacggaaucuugcucuguugcccaggcuggagugcaauggcgcgaucuuggcucacugcaaccucugccuccuggguucaagcacuucuugugccuuaacuuccugaguagcugggauuaccggcacaugcuaccaugcccggcuacuuuuucuguuuuuaguagagacaggguuucaccauguuggccaggcuggucucgaacuccugaccucaagugauccaccugccucagccucccagagugcugggauuauaggcaugagccaccgcccccagccaauuuuuguaguuuuuuguuuuuuauuuuuucagacagaguuucgcugucacccagacuggagugcaguggcacaaucucggcucacugcaaccuccuccucccagguucaggugauucuccugccucagccuccugaguagcugggauuauaggcaugugccaucaugccagcucauuuuuguauuuuuaguagagacgggguuuugccauauuggccaggcuggucuugagcuccugaccucaggugaucuacccgccucagccucccaaaguacuaggauuacaggcgugagccacugcgcccggccucaaaagguuuuugaugugaaauuaguaaaauuguaugauaggugguagugagaugugacuaugggaauaaaaggucaugauaggaaaauaaauuggaguaaaguuagaaauaugcaccagaauaauggguuauagaauuuacccugaugggccgggcaugguggcucaagccuguaaucgcagcacuuugggaggccgaggcaggcggaucaugaggucaggagauugagacuguccuggcuaacacagugaaaccccgucucuacuaaaaauacaaaaaauuagcugggcaugguggcacgcgccuguagucccagcuacuugggaggcugaggcaggagaauugcuugaacuugggaggcggagguugcagugagccgagaucgcaccauugcacuccagccugggcgacagagcgagacuccaucucaaaaaaaaaauaaaaaaaauaaaaauaaaaagaaaaaagaaaaaagaauuuaccuugaugguccugguggcuaaagaaaagaggaaagcauaaugauuccugagauucuuacuuagaggaaaaaacagcaguuagggagaguuguguuuggaauuucaguuauagaugugguugaagugcuuuguaaacuguaaaguaauaagauuuuuuuuauuucuuuuuuuuauuuuuuauuuuauuuuauuuuauuguuuuugagacagucucguucuguugcccaggcuggagugcaguggcgcgauaucagcucacugcaagcucugccuccuggguucaugucauucuccugccucagccucccgaguagcugggacuauaggcgcccgccaccaagcccagcuaauuuuuguauuuuuaguagagaugggguuucacuguaucagccaggagggucucgaucuccugaccucaugauccacccgccucggccucccaaagugcugguauuacaggcgugagccacuguguccggccuuuuaaaaaguuuuuuagcggagucucacucuuguugcccaggcuguauagugcaguggugcgaucucggcucacugcaaucuccaccuccuggguucaagccauuccaaugccucagccuccccaguagcugggauuacaggcaugugccaacaugcccagcuaauuuuuguacuuuuaguagagaugggguuucaccguguuggccaggaugucucgaacacgugaccucaggugauccacccaccuccaccucccagagugcugggauuacaggaaugagccaccaugcccagccagugggauguuauuacuuguuuuucaugacaccuuucuguauuuucagaagacacacaugucuuuugugcauguguccauuuucucucaggcaacagcauuugcugaauacucugcaggcuaagccugaguacaaaauuagguuucuggguguguggaaagaauacuuuaacaauuagaaucuaucuaguuauucacucuugugaaaggacuuaaacauucauacaggaugaaagaacugacaacauagugccaggagagaagucagugcugaagugcugaggauaggguaaaucaucuuuuuuuuuucuuuuccuuuugagagauuucugaucuccucuuuguuuuuuacauucaguuucuuugacuucuggauauuguaaagagccauaauagcacuguggcuucagcucaguguguaguuguuggcugcccuggcauuuugcuccuugcugugaauguacucuuuuuuugagauugggucucuaucugucgccuaggcuggagugcaauggugcaaucucggcuuaccacagcuuccaccucccggguucaagugaguccugccacagccuccugaguagcugggacuaggggugugcaccaccaugccuggcuaauuuuuguauuuuuaguagagaugagguuucacuauguuggccaggcugauuuuugaacuccugaccuuaugauccacccgccuuggccuuccaaagugcugagauuacaggcgugagccacugugcauagccugcugugaauauaaucuuacaccuccauguaagaagugguggggucagugauuggcaauagguuggguaaguuuaauacuugggaauuugguuaaagaacuuggcccugaaugguguaaauguguugguacuugcaguugggccuugugugguggcucaugccuguaaucccagcacuuugggagacggagguggguggaucacgagguuaggaguucgagaccagacugaccaacaugcugugugugguggcaggugccuguaaucccagcuacuuaggaggcugaggcaggagaaucgcuugaaccccggaggcggaaguuacagucagccaagaucgcgccacugcacuccagccugagugacagagcaaggcucugucucaaaaaaaaaaaaaaccaaaaaaacaaaaaaaaaaaacccaaaaaccccgcugcaguuauuagacuucuccagaggaaugcgcuucauguuuuuuguguaauauuuuuuugaaaacuguugauuuuuuuaauuuuguuuugagagagaguuucacucuuguugcccagguuggagugcaguggcacgauuucggcucaccgcaaccuccaccucccggguucaagcaauucuccugccuuagccucccgaguagcugugauuacaggcgugcgccaccacacccagcuaauuuuguauuuuuaguagagaugggauuucuccuucuuggugaggcugguuucgaccucccgaccucaggugaucugcccaccuuggccucccaaagugcugggauuacaggcgugagcuaccgcccccagcccuuuuuuuuuucuaaauuauuuugagacagagucuuacgcuguugcccaggcuggaguguaguggcacgaucucggcucacugcaaucuccaccuccuggguucaagcgauucuccugccucaggcucccgaguagccgggauuacaagcaugcaccaccacguccagcuaauuuuuguauuuuuaguagagacuggguuucgccauguugaccaggcuggucuugaacuccuggccucaagugauccacccgcuucagccucccaaagugccaggauuacagaugugagccagugggcucagccugaacuauugauuuuuguugauagcuuauuaaugguuuuacuagauuuaguagauguggauuugucuguugccauuaguaagugcucuuuuaugguccaaguaccuuucuuaauauuuuuaugagucucaucaggaaaacuguucuagguuuuuggaaauugggggcccuaaauauuuuuaaauucauuuuuauucauuaauuaauauuaucaucuuguacagauggggucucauguugcccaggcuugucuugaacuucuggccuccagcaguccuccugccuugaccucccaaagugcugguauuacaggugugagccaucaugccuggccuguuaaagauuuuuuaaaauagcagcuuuggccagugcaguggcucaagccuguaauucccagcacuuugggaggcugagguggguggaucgucugaggccaggaguucgcgaccugccuggccaacauggugaaacccugucucuacugaaaauacagaaaaaaauuagccgggugugggggugggcgcuuguaaucacagcuacucaagaggccgaggcaggagaaucgccugaacccugucggggcggagguuacagugaacugagaucgcaccacugcacuccagccuaggugaugacuucgucucaaaaaaaaaaaaagcagcuuuacagauuuguaguuuauccauuuaaaguguauaauuccagcugggcacggugggucacuccuguaaucccagcacuuugggaggccgaggcggguggaucacgaggucaggagaucgagaccaacauaugaaaccacaucucuacuaaaaauacaaaaacuagcugggcgugguggcgcaugccuuuaaucccagguacucaggaggcugaggcaagagaguuguuugaauccgggaggcggagguugcaguaagccgagaucgugccauugcacuccagccugggugacacagcuauacucugucucaaacaacaacaacaacaaaaaacaaaacaaaacaauaaaaauuagcugggcuggagccugaggcggagcuugcagugagccgacaucaugcaauugcacuccagccugggggacaagagcaagacuccaucuuaaaaaaaauauauaguucaguaguuuuuaguuuuuaguguauucauuguugugcauauaucauaaucauuaauuuuagaauauuugcauuaccccaaaaauccuuuacccagcagccgucacuccccagucuuaggcaaccaccaguccacuucugucucuuuauuugccuauucuggacauaagugaagcauguuuugugacugccuucuuuuacuuagcauaauguuuuaaggguucaucuauguuguauguagcauuuaucaguacaucauuuauuuuuauuuuuuauuuuuuagauggagucucgcugucgcccaggcuggagugcaguggcacgaucucagcucacugcaggcuccgcccccugggguucccgccauucucuugccucagccucccgaguagcugggacuacaggcgcccgccaccucgccuggcuaauuuuuuguauuuuuaguugagacgggguuucacaguguuagccaggauggucucgaucuccugaccucgugauccaccugccucggccucccaaagugcugggauuacaggugugagccacugcgcccggccuucuuuuuauuuuuguauaauauuucauuguauagaucugccacauuuaauuuauccauuuaucaguugaugggccuuuuuuucuucuuuuuuggcuauuauggauaaugcugcuaugaacauuuguguucaaguuuuuuucuguagacaugcuuucauuucucagguuugagaguauauaaauuuguaauguauagguacaaaaauaacaaauuucuucacuaggggcaggugcucauuagaaaugggggaugggaggauuaguuuaucuacaacuuacacuauggauuuggaauuuuuccaagccacacauuuuacuggggcuaaugacuacuuucuuuucucucugaaggaaguauuuggaggcuaacacuguaaauaaacuuguuuacaaacccgggaagaggagugcuuaaacuguagagaacagguguuuucagugagcuccguaaacucuuuagaugcaaugaauaugcaguugauugaucugcuggugacaauuuuucuuuauuaaagcaaguucccuaagaauuuuaacaaggggacaguucauuaaccuagucuugguuauuauauguauuuaaaaucaccaaauuggguguuaauuauuaagaaauguucucuguaaucccagcaauuugggaggcugaggcagguggaucaccugaggucaggaguucaagaccagccugaccaacauggugaaacccccaucucuacaaaaauacaaaaauacaaaaaaaaaaaaauuagccggacaugaugggggggugccuauaaucccagguucucagguggcugaggcaggagaaucacuugaacccuggaggcggauguuguggugagcugagaucgcaccauugcacuccaaccugagcaacaagagugaaacugucucaaaaaaaaaggaaauguucuuuaauuuguuagaguuuauugagucaaauugcuucccccacccaguugucccaaauuagggagauaccacuuuuaagggucagaagccuuguaaaauacaaaacaaugaaauuaauaugucguuccuuuggagaaacuuaguuucauaaagagaggagggaauuauaaagauaauuguuucuggcuaggcgugguggcucaugccuguaaucccagcacaugaggcaaguggaucaccugaggucaggaauucgagaccagccuagccaacauggagaaacccugucacuacugagaaaaaaaaagaaaaaucaucuggugcaugccuguaauggcuugacucuuggagguggagucugcagugagccgacgucgugcuacugcacuccagccugggcaacagagcgagacccugucuuuuaagaaaauggucuuuaaguucaguguagcccuuaaaagugauguacauggauuaaggacuggaagaaaguacugcaaaguguuuauauuuguaugcauggagagauuacagguaguaugcuuugcucuuguccauuuuguauuuucugaauuucaaacaguuaaaaaagaaaaaaagacaaaccuuauaccaucuguuaagagcuuggucugccauuuugagugaaagcagaugguuuacacauuuccaguggaguuuagauguuagaaaagaccuuggaaaucgaaauuauuuagcuuuuuuccccugaugaagugcuguccuuugcauuaguuaucucucuuuuaauuuuuaaaaaaguuaguagauauguugaauauagguugcugaaauagguuggguguauucaaugagaucuagaggcaauuuuauuuuauuuuauuuuauuuauuuauuuauuuauuuauuuauuuuugauacagagucucgcucuguugcccagguuggagugcaguggugcaaucucggcucacugcaaccucugccuccuggauucaagcgauucucaugccucagccuccugaguagcugggauuacagggaugcaccaccaugcuuggcuaauuuuuauaguuuuaguagagacaggguuccaaccauguugaccaggcuggucucgaacuccugaccuuagaugauccaccugccucggccucccaaaguccugggauuacaggcgugagccacugggccuggccuagagaugauuuuauuuuaguauuauuuccuuucuguaucuagaauuaauaacgaguaaucauaugcuuuguccuggaaguguucuaauauuuuuacaugauuugagccacucaguacuguaugcacauuuuuaucuuucucauuuuuuuuuaaaaaaaguauguuaguccauuuuguguugcuauaaaggaauauaggagacugggcaauuuauaacaaaaagagguuuauuugucucaguuuugcagacuguacaggaaguaaguuacagcaucugcugcuggugaggccucaggacacuuuuacucauggcagaaggcacagugggagcacaugugucacauggucaagagagggagcuggagagagaagagguuccaggcacuuuuaaacagccagcucuugugugaauuaauagagugagaacucacucauuaccauggggaggauaucaaguacuuccugagggaugggcccccaugacccagacacuacacacuagguucaccuccaaccuuagaagucacauuucagaugagauuuggaggggacaaacauccaagcuauaucaaaguauaauauccuuuccccacaccccccgccccccagaggauagcuuuucuuuaaaaaaaaaauuuacuuuuugacuggccgugauggcucaugccuguaauccuagcacuuugggaggccaaggugggaggaucacuugagucuaggaguuggagaacagcuggggcaacauaccaagacccccauaucuguuaaaaaauauuuaaaaagccuaggaguuuaguuuucauaagugcucagugaauggcaugaugcuauucaaaauugaauuuaauuauuuccuucaauuccuguacuguauucuguuucugugguugauauauccauuuguggcauguuaggagcuauccuagauuucugccuccuguuucugccgacaauaguuccgagauuauaccuauguugcuuuauuugauaggcucauguuucuugccuggagauguucaguagucuucucacuggcuuuccugcaucucccguuuucuucuuuguagccauugucugugccacugccaaauugauguuuuugaagauacgaucugcuuauuucucacccuuuugcucacgcacucgugugugugugcguuuucuuuccuguugcuuuugggauaacuucuaagcuccuccucauagcauaggagaccuuucauguuauuuuuuuuuuaaagauaaaauaaauuuuuauuuuaaauuuauuauuaguuuuagagaugaggguguucacuuuguugcccaggcuggacuugaacuccuggccucaagcagucccuucccccuuguguagcuggcacuacaggcauaugccuucgcaugcccagcugucuuuuguguuuugguccagcuugccucuccaguccuuacuggcgcuccauuucggcuauacuaaaguauuuguaguuuugugaauacccauccuauuuuuauaguuugugcaguuucucagcauacuagugcuauuuuuauuuauguaguuuucucuuuggaauccccuaccuucuucauuuaccuggccuuuuccucaucuuucaagcuucaacuaauguaucuucaucucugauaaauguacuccuuuacucccacuuuucuccaagguugggugccugccuuugaugccacuauuguaugucauacacaucucauugaagcuuuaucuuccuguauuggaguuuaauauuuacuuuuucccuuaacauccggugcuaggaagcuguuucaauaaagagauucuuggcggggcaugguggcucaugccugugaucccagcacuuugggaagccaaugugggaggaucgcaugagccuaggaguucuagaagagcuguggcagcauagugagacccuugucucuauuuuuuaaaaaaaagagauucuugggcuuaaguccaguccugcugaauuagaauucucaaugauaagacacaguucauguauuuuguuuuuaauauuuauuauuauuauuuuugagauggaguuucgcucuugucgcccagggauuacaggugugagccacugggcccagcaugaguuuuuuuaaauuucuugugagauagagucuugcucugucucccaggcuggagcacaguggcagcaucucagcuuucugucucacugcagccucugccuccuggguucaagcgauuauccugccacagccucccagguagcugggauuacaagugcgccaccaugccuggcuaauuuuuguguuuuuaguagagacgggguuuuaccaugucagccaggcuggucuugaacuccugaccucaggugauuagccugccucaaccucccaaaguguugggauuacaggcgugagccacuggguccagccuaacaucuuuuuauauacacccaucuauagccuacguuauagaauccuuacacauacauaacauuuuucuguguuuaaaaaguuuuagccuggguaggcugggugcaguggcucaugccuguuaucccagcacuuuggaaggcugagguggguggaucacaaggucaggagauugagaccauccuggcuaacacagugaaacucugucuauacuaaaaauacaaaaaaauuagccgggugugguaucaggcgccuguagucccagcuacucgggaggcugaggcaggagaauggcacgaacccgggaggcagagggagcuugcagugagcugagaucgugccacugcacuccagccugggugacagagccagacucugccucaaaaaaaaaaaaaauuuuuuuuuuguuagcguggguaacagggagaccucauugcuauaaaaaaauuaaaaagucagccaggcauggugacauacacguguagucccagcuacucaggcagcugaggugggaggacugcuugaaccuggcagguugggacugcugugagcuguauuugugccacugcauuccagccugggugacagaaugaggcauugucucaaaaagagaaaaggaaaaaaaaaaaaaaaauauauauauauauauauauauauauaaaauuuuaaaacauuuuaaauggcuauauaaauucucuaaguauaugcuuuaauaauuacugcuguauuuagacuguuuccaucuuuuccuauuacaguaccagguuaaagauguuuguuaacaaaucugugcccauauuucucaugauuugcuuagguuaaauuccuagaaguggaauuaccagaucaaagggcaugaauauuaaucaaacccauauuacauauugucagauguccagaaaagucaaauaaagcaagguaaaguuguguguauuuguaugcguguuuuaaagaaggauaagaaucaucuuaaagaaccuagcucuagcaguacuauuucaccacuuguaugacuaagggcaguuucucacauuacaaauauuuguauguaaugccugucauguuuuugauacugugcuagacgcucaagggauuauuuuuagggagauaagacaaaucaccauagcacuguuaauaaggugcgguuugguacuuggcggguguuacuucagauguuaaggagaguguagaaaguagugucuaccauggucuuugaacaguagucuacauuucugcaaugccuaguccaucgcaaagggagagcaaaucaacuagagaaguaaucgcagguuaaaguuuuucccccuuguuuaaauaauuucuacccccucaguucauggagacuaacacuguaggcaugccugguagcugauaguucuccucugaacauauuucucucucucuuuuuuuuuuuuaaccuuuagcuuuaaagaucaucugcauuuucuucuguaauaaaagguauccacccauuuggccauguuuauuuauucuuuagcaguugaaguauuaaaugaugccaggguuuuuuuuuuuuuuugagauggagucucacucuauuuccgaggcuggagugcaguggcgaaaucucggcucacugcaacuuccgccuccugaguucacgccauucuccugccucagccucccaaguagcugggacuacaggccccugccaccacgccuggcuaauuuuuuuguauuuuuuaguagagacgggguuucaccguguuagccaggauggucugcugaccuccugacuguguuagccagaugaucuccugaccucgugaucugcccaccuuggccucccaaagugcugggauuacaggugugagccaccacgcccggcccuaaaugaugccaauuuuuauuuuaaauccugaauaaucuuauauuccuucuuucuuuuuuugagacugaaucgugcuuugucgcccgggcuggagugcaguggugcaaucuuggccgcuuccuugguucaagcaguuauccugccucagccugcugaguagcugggaauacaggugcccgccaccacgcccagcuaauuuuuuguauuuuuaguagaggcaggguuucaccauguuggccaggcuggucucaaacuccugaccucaagugauccgcccgccuuggccucccaagugcugggaggcaugagccauuguacccagccuaaauucauuauguuuuagaucuuuaacuuucucauggggagguagauacccagacuuaauaaaccuuuucacuguccaccugcuagucuuggaaaauaauuuuaaugaagcgucaccgauacuuggacaguuucugucacgucagcagagaaauaucaacaggagugauuguaaaguggcuagucuuaugguccaaguguuacgaucuuugauccacuuuucaauuuauuucaagaucugaucuauauuauuuucuagcucuucugguuuauugcugaauaguugaugccugguuuuuccuuguaggauauuguggcuucauaaagagugagaaaucucacacugaguauugucuuuuaguuucuucugaccuuaaccccuuguuuaagucuuguguacaauacacugguugguaucuguucucagcacaaaaaacuaugugaagccaguguucagggaagaaaccacaaccaugguaaucagcaguaucuuuaccuucucucauaugguuaucugacucaucaauuacucuuaucuucaucugaaaugggacagucauacucuucuucauuauagcuaucagacaacugcccuugugcugaaccacccacauuaauguauuuuaggccuggucuugauguaaguucuuugccucgugugguuuuuccuacccuucguguacucugaguguggcuccaaagaccuaaacguguccucauguauagccaggaacuucauagcauucuucaaaacagaacacuaagcugcuccccaguggagagcucgaggccucagagcacuccgaaucccugccuccccugcuguccaaucccauuuuuagccaagugccuugacuggggagcaggauguuugccugaacauauuuuuuguagagaugagagucugcugugcugcccaggcugaucuugaacuccuggccucgccucaagugauccuccugccuuggccucgaaaguacuggccauguagaggugugagccacccuguauggucugcucuugccuuugaugacaacaggaacaagugguaaaaggcauaaagagcugaauuugggccgggcaugguggcucacaccuguaaucccagcacuuugggaggccgaggcaggcggaucaugaggucggaguucaagaccagccuggccaacauggugaaaccccaucucuacuaaaaaauacaaaaaauuagccaggugcaguggcacgcacucguagucccagcuacucgggaggcugagguaggagaauugcuugaacucgggaggcagggguugcagugagccgagauagugccacugcacuucagccugggcaacagagugagacuaaaaaaaaaaaaacaaacuugaguuugaauucuauuucggaucuuuaucaguuacaugauuuuggacaaguaauuucuguaaaccuugguuuccucguauauaaaauggaauaacgucuguuucgcagugccagugccugguguuuaguguuguuguuauugacaguuaauaaaugauaugaacauucauucauaacaucaugcaauagguuuugcagccauuuauaccaaaagagguuuuuugguuuuuuucuccuccaguaauuaggaaagaaugauuuaucuauauuuuguuuaagggcuguaauaacuucuugcuauucuuuucuuuuuuuuuuuauuugagauggaguuucacucucguugcccaggcaggagugcaguggcgcuaucucgguucacugcaaccucugccucccagguucaagcaauucuccugccucagccuccugaguagcugggauuacaggugcacgccaccaugcccggcuaauuuuguauuuuuaguagagacgguguuucuccauguuggucaggcuggucucgaccuccugaccucaggugauccgcccgccucggccuccgaaagugcugggauuauaggugugagccacugcgccccaccaacuucuugcuuugcuuccaaaaugggaauaauauuaucuguguuuucaggguaguuaugacuuuuuuuuuuuucuuuugagacagacuuguuuugucacccagguuggagugcaguggugcagucucggcucacugcaaccuccgccucucgggcucaagugauucuugugccucagccucccaaguagcugggauuacaggcaugugccaucaugccuggcugauuuucauauuuuuaauagagacaggauuuuucucauguugcccaggcuggucgcaggcucaagggacccacuuaccucagccuccuguguaguuaugacuauuaaaagagaugauaaaguguauaaaguauuuaugggaucaggaccagacacaaaguaagucuuaguaauaguuguuauuaauacagauauaucgugugcagaagaugcuguagaacagauuuacuagguuuuuuucccuuuguugauuaaauucaaauuagauuaauucuuauauucucuuuccuuuucucauugcucaaguuucuccucuuugccugccauuuucucacugguauuuccuuuccauaaugguuccuggcaucaacgauucugauuauauuguucugaucucuuuuagugaaauggaaccaucaugaucuagguuucuguaugcaaaaaauccuugagaacaaaaguagguguggagaugaagagccuaucuuuaugaggaaauaaucuagcaaaggcaguuaaaaguauggaaaucuacucuaguuaacaaaaauucaggggauuuagugaaagaacacuaaggacucucugaaccucagagcaagaaauauauaugugggcuuccugaauacuuggaggcuuucuguuuuuuuaaagggcacuguagucccuugucucugcuucuuucagcacauuucuuuucucuauguugacugcuaccuuuugcuuauacgucaauuagccaccacaccuggguaauuuuuguauuuuugguagagacgggauuucaccguguuggccaugcuggucuugaacugcugaccucgagugaaacuguccaccucagccucccaaaguucugugauugcaggugugagccuguacauuuguuuuaauauggaaauuuucagugugauuuaaugaacuccccaacucagugauacucuguuguaacugaguuugguuucucuaaucaggcaacagacaacuagucaaaucggcuccaguaaagggacguucauuguaaagacacacugagcaguucaggacaagaaugccaguaaagcaaguacaagaacugaaccagaaugcuagcaaaaccugugucguuuuuagugauuuuauuccagaaugcaugguuuaacauaauguuugcuuuauucugcuuuuuaagauucaauguucaauaauaccugcuugaaaaauggauaaauuguaauuauucaaauaauugaauuucuauuuggaucauuaacuucuuacaauucagaauuccuuugugcccaagucuguuugaauuuauuuuccauggcugggugcgguggcuaauaccuguaaucccagcacuuuagaaggcgggaggauugcuugaggucaggaauucaaaaccagccuagaugacauagugaaaccuugucucuacaaaaaaauuaaaaacaauuagcugggugugguggugugugucucuaguccuggcuacucgagaggcugaggugggaguuugaggcuguagugagcugugauugcgccacugcauuccagccuagguaacagagccagacccugucucaaaaaaauaaaaugggcugggcgugguggcuaacaccuguaagcccagcacuuuaggaggccaugcuggauggaucacuugggcuuagggcuucgagaccugccugggcaacaugguaaaaccucgucuucuucaaaaaauaugaaaauuagcuggauacucgggaggcugaggcaggagaauggcgugaacccgggaagcagagcuugcagugagccgagauugcgccacugcaguccgcaguccggccugggcgacagagcgagacuccgucucaaaaaaaaaaaaaaaaaaaaaaaaaaagaaaauuagcuggaugugguggcacauaccuauagucucagcugcucaggaggcugagaugggaggaucacuugagccuggaagguggagguugcagugaggugagaucgcaccacugcacuccagccugggcaacagccagacuccaucucaaaaaaaaaaaggaaaaaucaguaaggucgucuucuaaacuuccuuuauuuuuuggcucgauaaccaauauggucuccuaauucucuuccuagcccuguauuuagauuuccaccuuuuauuucugccagccuacacuguagucaaggaaaauaacguuuuuuuuuuucuuuuuuuguauuuuuuuuuagagacaggauucaagcgauucuccugccucggccucccgaguggcugagacuacaggcaugcgccaucacgcccagcuaauuuuuguauuuuuaguagagacggaguuuugccauguuggccaggcuggucuugaacuccugaccucaggugaucugcccgccuuagccucccaaagugcuaggauuacaggugugagucaccacgccuggcccacuuuauuuuauuuuugaaacagggucucccucuauggcccaggcuggaguguagugguguuaccuuggcucauugcagccuccaucuccgaggcucaagcaguccuccugcuuuagccucaugaguagcugggacuacaggcacaugccaaaagauuuguaaagugauacuuuuaauuuuucauuuuccaaaaugugguaauguaguuccagguuuaucuauuugauuaaaaaccuuuuuuuuuuuuuuuaaaaaaaagaucacgccacugcacuccagccugggcaacagagcaggagucucaaaaaacaaaacaaaacauuaaccugagacucaaauagauugcuagagaaaagggaaguguagaaggaacuugaaaggcuuauucuaccuugaugggagcauuuacucugauuauaauugacagcuagcuuuucuccuuuaucauggaaaauacuucucccuucuaaaauauuucuuacaaauauuucuuacagugccuucauuuuuugauuucucuugauucuugagcaucuuuuucugaguauuaguuuuguuuccuaggaagaauuuugucuggagagucugcccuguggcagugacuguacaaaauacagcucccaguaugaauaaauaaguucccaaauaguuaaaaacuuuugugagagaaugacuugguuuaucucauguagucaacgugggugacugguuuaaaauguaguuucugcacuagcaaaacucuuagaaguugagccuccuuucucaacaauugacuguaagagguagggcaggagggugguauacagggauagggaaagagugugguucuuauauaaaugaggcagcgggagauacccugaaagagggagguggggagggugaguagagagaaaaagagagggagagaagaaaccagagagagagagagagagagagggccaggggaggcagggagcgagagugcgcauauccaaaagaguguaaauagauggugaaagagaaugguggcaggaagauaguguagaaaggaauggaaaaugcuacaagggcaggaugagcaaguuuugaagguaggggaagagauagugaaaagcaaaggcaagaccaagagagcacauucaucgaagcccacagcagaaacugacagcaguuuuauguaguaaaauaauagaauauuggagguggaaacuuccuuugacugccagggggcagcuuggugguacagaaagggccuugaacuuuaaaugggaagacuuggauuaagauccuggcagugccauguaagugcucugagccuuaguuuccuccuaugcuuuucccuaccuaacaaugguuggagaaggcauuucuuggaggaucaguuuccuaaucucuaaaaugggaauaaucacugugagguuguugugauggcuacauaaauauacacagugcauacuuuuuuucuuacuccuccuacuuaguuuccuugggacauauaaauagaauuuuuaauauuucugguugaaacuguauuuguagguuuuuggauuuccaagaaaugucuagcucuauuuaaauguauaauuagauuccacagaaagagcuagauacagagcuuugugcauuugauuuacaugcuuugucaauguuaaugcuggccuaaagguuuaucauuucauauaacguguagaguuccuagcuaacauccugucuucauccucccuacccuccuuuauuuuuauuauauacaguuuaugagucuauuuauugugcucaucuaauaaucuaaacaccauguaaaaugaucauagcuccuauuucagggccuuuuuaaaacaccacaguauuauaagccuugucugucucuuugugcucauguaacuaacugaacuuuacucuuacuuugaguuuuauaaauuucaauuuuuagugagcauucccaaucuuuuguaucuuagugauacggugugucucauuuguagcauaguauuggcugugcguuuuuaaaauaugugacugaaaacaauaaugcaacuguaucuuuuugcaguguuaguucugacaguuaagauucuuaggugauauaauguauaggcagcuaggcagcauguuauuaaauccuuuuuuuuuuuuccggacacugucucacucucacccaggcuagaguguaguggcgugauuucugcugacugcagccucgacugcccgggugcaggcuaucuucccaccucagccuccggaguagcugggaccauaggcgugcaucaccgugcccagcuauuuuauuuuuauuuuuauuuuuuaaauuuuuguuuguagagacaggguacucuacuacauugcccaggcuggucuugaacuccugggcuuuagugaucuugccucaaauaaaauucuuaaacugauucucuuaauuguauucuggcucauguucuccauacucuuuucuccauugcuuggcccuaacuugacccucaauacguuuauccagugguagaaauuguaaacagacauuggaagguaguggagaucagaggagggaguuugagagacuccugcuucagguagucaacauuguuuuucauguaggcagaagagcaaagccuacaucuuuuuuuuguuuuguuuuuuuuugagacagaaucucgcucugucacccaggcuggagugcaauggcgcgaucuuggcucaccgcaaccucugccucccggguucaagugauucucccaccucaaccuccugagauuauaggcgccugccaccacgcccggcuaauuuuuguauuuuuaguagauaacaggguuucaccauguuggccaggcuggucucgaacuccugaucucaagugauccuccugccucgcccucccaaagugcugggguuacaggcuugagccacugcgcccagccuuuuuuuuuuuuuuuuuuuugaaaaaggaucucccucuguuaccuagauuggaguccaguggugcgaucacggcucacugcagccucuagcuccugggcuuacgugauccucccaccucacccugcugaguaucugggugugugccaccacagcccaacuaauuuuuauauuuuuuguagagaggggaauuuugccauguuccccaggcugggagccuacgucuuuaauaaacaaaggaauguacucuugaaucccuugcccagggguagguggugacucuagccucagacagcagagacaugcuugcugcucauaacaaagaagaccaguaaacuaguugaauuauaacuguuuugaauaaucuauuucacacaucauccuugauguuauuaccuuguaggaauggcuuuggagauagauagguaaauugaagccuaaagagauuguuaugcuguagguaggauuacauuuaacaauuaguaagguuuggagggauucuugugacauguuauuuucucccccugguuagguuuggggagcccccagggaucucccaauauggagagauauugggauacuucauuauaggguuugcaucccccuuuccugagguuuaccaaagagaaauaguggauugaaucaaaugcacucccuaauuuaacuuaacuguucacaacuggggaggagccaugaucuuuugacucauuaggucacauagucaucuugaaggcaucauugcucuucagaauguuggucuuauuaaauuaaaaaguaugagaaauagcuaacauaauucucaugauggaauuugcuuuuucauucauuuggauuuuguguuuuucauguuuugaaaauauaagggaaugggaggggagaaaguaggggucauugcugaacccugaugguuaaagguaagugaauguuuaaucucuuagucacuugaucauugcuauugucuuugccaaugucugaaaguaaacauagaauaaauuuucaauuguguguaauguguauguaaaauucaagaugcugacuugaagauuuuuccuucucuauucuaaacaauaggugcguuccauggaugaacugaaucaugauuuucaagcacuugcucuggagggaagagcgaugggagagguaagugaacuggugugucagaaaagugggucuguuuuuaagggaagguuggaguugucuuucaucaaauguguccaaaucuagucuccagaaauaugugcuugcuuuuccuuguugccauucucaugauaggaacgggaugcuggagaauuuugccaaaacuaugucauuaaaagaagaauguuaaccauaaccuaaugucuuaaaagcaaaacaaaguagccaaaaugugagcacaaauuauugaauauuaaugucagcuauaaauugagacauuuuaaguuuaagaaguauuuuaauuuuauaugcauuaaauaaaaggccaaccuuuacuucauuuuccaguggcuagguuuucccccaacccaccccccccgccaauggcaaagggagucuuagauuggcugcuaaucagaaaaugucaguaaccuauuuuuagaguagugccuuuuuuugaggaaguuguuuagagcuccauugugaaagggaaguuguuagguuucuaguggaggaauuacagaagguagagagcugagccagucauccauuacaggaaauucagaaauaagaauuuugcuuugacuguaauguuuaaaauuugcagaaacaaaauuuacuuuuauccauuacaucaauagagaggguugcuguaagucuuaaaaaggaaggggaguauagauaucuaacauguagccaacugcuggcuauuguagcugugacaauaagcauguauugaugacaaagguagaauauacaguuugaauuaacuacuuaaaauaccacaggcccacaagugacauuuguuguggcucucuuguucuggaaagugacguuagguuuucucuuccauuucauuuuuuguguaucuaauauuugauagcuccuacaucgauuuuaauauuucacaagagggagaauuacuuuauucuaggguccucauuuauaccauuuauuagauacauuuguucuuugauucagcaaauguuugauccccaggcacugugcuagguucugaggucaaaauuaggauaauuacucuucugaguuugaagcaaauauuccuugauugccuuugugguuaggcagugaacaguuaaaaauuguugauguuuaaacugagauccuugcuuucuuuguuacaagauuuuguuuccaacuuucugaaucuucuuguggccacagaguccaguguccuaucaucuugaguucaugcauuuuuggucuguuuuccuccuagagcuuuaggagaugauugggagauguccuuguguuuccugugccugccuaaugucacugacacaaugcaaaucaauaaacccuguaugguuuagaaagucuaaaagacuuugucacuaaguuuuuggagcagauuugaacagaaaguuaacauauuuguuggauauuaaguauagaaagagaaacuauauguauugucuuucuuacuccuauaauucuaagcugguguauuccaccaaaaauccaauuccagguguuuuucuuucuuuuuugaauuuuuuauaaaaauagagacagagucucacuauguuguccagacuaaucuugggcucaagugauccuucugccuuggccucccaaaguguugagauuacaggcaugagccacuguguccagccuguuuuuauuuuuaaaaaauuaaugauacaagauaagaauaaugcccuauuauuguuuugugagcaacaguuuauaaucacugaaugcuuaauuuuaauugaauagcaaacaauuucaguagaggguaaaguuuauuuaaaugacaaguugacaguguuaaauucuuuuuuuaucauuuuuuucuucuuccagaaacgccuuuuuuuuuuuuuuuuugugguauauguauauaauuccgugggcaugaauauaggcauauguuaauaacaaaacaguauauuccaucaguaaugcugugucauucuucuuccuuuccccacuauucacaaguaacaguaacaacuaccauuuaucaaucauagguagaugcuaaggggcuuuuaugcauuaucugauuaauaacucuaugaggacaguucuauuauccggauaaggaaaaaggccaagagagaugaaauaauuugccaaagguaacacaucuaguaagugauaggauucuucccuggcuuccucccacugcaaggcaugugcccuuaauuaggguaaaugaaguuaauguuuguaaaauaauugagagguaaaacauuuccuaaguguggagugagguuucuguauucaaggaguucuuucuuuagcuaguuaaggaaacaaugaauauacauauaaacagaaagaguaaauuuuuuucuauguaugguuggaguucagagaaggcaggaucauuauugacaggacuaguuagacuuuaauggaggaggagagauauuccuuaaaaagcaucuucuaguuuaguuaggcuuuggauagguacagauuaagagaauuuuuuuugcagcaacgggagaacagcacaaaagaaaaaaugaaaauaagcuuuuuuuuccuuuucuuuuuuuuuuuuuuaagagacugagucucacucugucacccaggcuagagugaaguggcacaaucucggcucacuguaaccuccgccuccuggguucaagcaguucuccugccuuagccuccugaguagcuuggacuacaggugcaugccgccgugcccggcuaauuuuauuuuuguauuuuaguagaaacaggguuucacuguguugcccaggcuggucuugaacuucugagcucaggcagucgccugccuuggccucccaaagugcuaggauuacaggcuugagcuaccgugcccgguggaagauaagcuuuuauaauaaaaaagaacagcuucuaauuaacuucauuaaauuuucuuccuuuuuagcaauaaaacaucucugagagggaguguguauaaauacaguauuuacuggccgggcgugguggcucacgccuggaaugccagcacuuugggaggccgaggugggcagaucaccugaggucaggaguuugagaccagccuggucaacauagugaaaucccaucucuacuaaaaauacaaaaauuagcugggcgugauggugugcgccuguagucccagcuacuugggagacugaggcaggagaaucacuugaacccaggugguggagguuguacugagcccagauagugccacuguacuccagccugggcaacagagugagugagacuccgucucaaaaaaaaaaaaaaaaaaaaaaaagacaaaaaacaaaccaguauuuacccauauaaacacuagaaguaaauugcaugacuuuuaagcuaggcaccauaucuucguuugaguuauuugguuucuuuguggaugugugggcaccuaugcgcgugugcaucugugugagucauuaggguaaaugcuaguuauguaaagaauguauggagucuuuagaauucaaauagaauugguuccauucaaaguaauugauuucuaguaguugaaaauuagugcugguugacucuuguuacguuuuuuucuucaaagccacuguuggccucuuggugucacuuugaaagguuuagaguauuucuuagaagaaaucuugcuaagaggugacuacuuaaaaauaucacucuccaagcuguucuuagcugaaggacucauaguacaagugcuuuaugugcuuccuauucuacaaagcuaauauaaaaaagaagauaggaaaagaucuuaggaucaaggccacaaauuauuuaaaaauuuugucuacuuuccuuguuagccccuuucauuuggcuuaaagcccugagaaguuuaaaggcacauacuuuagcagcuuuuauuuauauaugaagagaucagucugcuaaucgaugauucuagaaaaggauguuuguaguagagaggaaggcucacugaccuugggcuucugggcucuauuucuaaauugguuugguuuaugaucuugcauaaccuguuugcuccaccuuuagguuggcagcauuguuacuguucaugaccuagaaaaggauggauuuuuaaaaaagaagcuguaguuggaaaguacuuugagagguugacagaaagguacuuuguucgcauaauugguuuuuuaacuuuuaaaaaucaaggaccuuuuuuucccuuaagauucuuuaauguuuuauguguagugaacuugacaacuuccagggaaguuaaaauaguagugaauacuagcuuauuucuacaacaaauggauuguauuuagauaugugacucuucaccuuugucuuagaaagcugaagcauagaaaaacauacccuugauuauaacaaguuuguaaaccugacaaaggaaaucuagaaagugcuccuauauacagagugauaacaaauccuaccuuauucacaggaauuaggauaaccugagauauauuuaaauuguagcuuuauauucucauuagacauuauauaguacuugauccauaggugugggauagcagaguggcuuauagagggaggaauuggauagugauuugggugagcuguuaauccaaagaaaggcaaaauuuggugggauagagguagcauuggauugggccagaacucugacgccacaacuucuuagagccuagguucaaacauucaucuucuuugcacuuacuuuuuucuacccguaagacaaagauguuggacuagauaguuuccuaggaccuuuucaggucuaagauucugggagcuugcccuucuuucucucuuuaaaaagauagaaaagaggaauuguucuggccuuuuuaggauauaguagagagugucuaaaagauauccuuuuagauugacuuuccccccugugauuuagagauuuuguaacuuuucauugggguuuuuuuuuuuuuuuuuuugagacagagucucgcucugucaccaggcugaaguguggcgcgaucuuggcucacugcaaauuccgccucccggguucaagcgauucuccugcuucagccucuugaguggcugggaguacagaugugcaccaccacacacccagcuaauuuuuguauuuuuaguagacgggguuucaccauguuggccaggauggucucuaucucuugacuucgugauccauccaccuuggcuucccaaagugcuggaauuacaggcaugagccaccgcgccuggcuucguuggguucuuuaaagugacuuauucacugucugcagcugcccaagacacugaaguguccaucagaguucgugggaugguaauacuggagucaaggcaaguauuagccugacuccaguauggagacuaaaucuguuaaauuuuuuucccacaucuuucuauuauggcaaacagugucuuaauagaauuggaggcuuuugaauagcuaaaaguacuucuagaauccacagcucugggagggcuaccuuaaauuaacacuggcaguucuuugcaauuagggugccauaaaagcagcacaguugacuccaaaauggacugaguuuuggaaagaugucugccagcaaaaucauauagacuuucuugcugaagggaugaaaaauuaauaaugccuugagguauauuaauauaaaaauaugugaccaagcaguguaauuaauuccccuuuuuccucaaaauguagccuuuuuuuuuuuugagauggaguuucacucugucacccacgcuggagugcaguggugcgaucucagcucacugcaaccucaaccuccuggguucaagcaauucuccugccucagccucccaaguagcugggacuacaggugugugccaccauucccagcuaauuuguuguauuuuuuuuuaauagagacaggguuucacuauguuggccaggcuggucucaaacucgugacuuccagugauccaccugccucugccucccaaagcgcugggauugcaggcgugacccacugcgcccagccaaaauguagcuuucacguacaauaggaauaguaaaaacacccuaguucccuuaacuuuauguuuuuuggguauuuuuuugacaucuuguucuugaaauguuuauuuuagaaaaaacagcuaaccacgccaaguggucuggaggaacaagaucuugguagauggcuuauuuuagguuaaugacuguuagagguaaagugaccuuuuuaucaguauuguuugaggaaguuccugggacccaaaauaauaauuuugggauugggauugggcacuuugaggaacgagauaggagaagguguuuucuaacccaggaaauguggucauaacugauuuggaacguaguucccaggucuguccugacuuugagaccaaugugcaaaccccacccauucuucugucugucuucuaaccugcacugggaagaccaggaacauacuacuguauguagauguuaagcugucuuggaauguuugaaugcagcaaaucauacucuugcagcagaagauccacaugcugcuuacuuugucuucauuaaauuucuucccuuucaucaaccuccuuuggcuaaaauguuacucuuuuauccauacuagcaugcuuuauuggagggaagacuaauaaaugguaacacuuuucaauauaaugaucuauaugauaucauuaucgauaugaaucucccaguagguuuuugagagguauuauucccauuuuuuuuuagaugagcagaaugagcccuaagauuaaaugacuccagcuaaauucuuaagugucaagauggggauuaucuucaaauucuguuuuuuuuuuuuuucuaggcucggaaguaauaauagcuacaaaauauugaguguauacaauuuucccagaacuaugcuaaucaccucauguauguuacaguuuuuagggugguccugcaauauuaugaugccuuuuuuuuuuagauggggugaacaaggauuagagaaguuaauguaaucauuaagccucuguuugaacccagaucucuuauaacucaaauccugaguuuuucugguugguuucugcauauucacagucuacuuauucaagauuuagcuucagauaucagcuccccuauuaaagcuuuuuugcucccucccauuagaagcugugaaggggaauucaaguagcaagugauuuguaguauucuuacaaagaugauacaaaugaugaucuguggcuuaucaaagccccagaugauacccagauggucugggcuuuaucuuuugcaugcuggacucuaaaguacuguuucaacaaucauggcccaguuuguuuuauacauaaugauuuguguauauauggugauguuuucuuuuuucucauacaaaaguuuguugaggguggggcuucagcuaauaaugugcuuuguaaacaauagcugcuaaauauauuguauugaaagaaucauaucaguaaauauuuuuuccuaagcauaguuuccucuuuauuuuuccuuuuacaucagaaauugguauccuugucuaucccccaagggagcucaguucaauuuaguaaauauugguuguauuuucuguucacaugacuuuucugcucucagggauguuggaguguacagggagagaauaaagaacagacaaaacugaaagcauauauucaggcugucugcaaauauguacauuuaaaagcuauucauuagcuacuuuugcaaaaauauagaagacaaacaauaaaucagcagugcuguuacccaaauugaauccgauauauaaaggcauuuuuaaauaaaggaucuuuuguuuaauauaguuguuacguuguuacagaucgaugguacuuucucugggccaucuguuggagcauggaaauauauccucauuauauauacaguaaccagacauaaugauguuuagaaaaauagaauuacuuuuguuccauugcuuucucaagcugguauuaaacuauguuguguguaauuccuucuugguuacuguaaccuugcuaauaaggaaccauaacaucaaagcaaauccauuguauuuugauuaauuggugcaugaugugguucucauugaggugaagcauguagcaaaaguuuauuuucuguguuguauucccuauauacauagcaggcauaucuaugaaauauuuguuuccuauaaugaaggaaaaggggaacucaggguugagauccuugucuuuuucagaucaaaaauuuaaaauucccugaggcuaacuggguguggguuuauuagaguauuuggucccaucuugauguggaguauucuuuguuaucucagucgggcuguuugcuuccugcuuugggggugugagggggucaugaagcaaucuagauguuuucaucauuguauuugugaacuuuacaguauccugaggggucuggagcuuaucuuuuguauacugggcucacaaguacuguaauauguaauuauuaaagugaauaccuauuauaaaaugaaugugguuaugcuauagaucaaaccauguagucaaaauaaauuguuauaccaaaaagacacuugcgcuugcauguuuauugcagcacuauucacaauagcacagacguggaaucaacuuaggugcccagcaacagugaauuggauaaggaacaugugguacaccuacacccauaaaaaaagaaugaaauuauguccuuugcagcaacaugggugcagcuggaguccauuauccuaagugaauuaaucacuggaacagaaauccaaauaccacauguucucacuuguaagugggaacuaaacauuggguacacauagacauaaagaagggaacaguagacccugaggacuccaaaaagggaaagggaaggagggaggcaaggguugaaaaacuacuuauuggguaacuauguucacuauuugggugacagguucaguugaagcccaaaucucagcaucacacaauauauuauagccauguaacaaaccugcacauuugcucucugaaucuaaaaaaaaaaaaccuuguguaguuuauucauauguaaaaacacgugaccuuauuuauagguaaccuguagauaacauaacaucccuuauaugcuguuccuguaucaugcagaaaagcccgauucacucugggaauuucaucauuuuaucaacauacuuuacugucagucugucagguuuuaugaagacaguagagaagagaaguuucuuggcucuguuccauuaacaaaaugugaagguauaaagaaaccuuuacuuucagauucagaagggcacguguaugggagccuguucagguuaauucaugacaaaauaacauggaguguaaggugcuaacaguauuucugaauguucuuuaauggacuugcuuuaugaaaguaugaaugauaucuuuugaugugcuugguuucuaggaugaagucguugacagacaggguuguauucuuuggugugugcagaaaacaggaaaccccugugcguuuugaaguuuaaugguagucaucaaguuugcaauucuaucuaauaucuaauuugugguuguccuaaaauuuguuuauuuauuuauguuuuugaaacagagucuugcccuguugcccaggcuggagcgcagcggcacuauguuggcucacugcaaccuccaucuccuggguuuaagugauucucgugccucagccucccaaguaacugggaucacaggugccugccaccacaccuggcuaauuuuguacuucuaauggaggcgggguuucaccauauuggccagguuggucuugaaaaucugggcucaagcgauucgcucgccucagccucccaaagagcuaggauuacaggcaugagccaccacacccgaccugguuguccuaaaauuuaaaagcuaccaaauucuuaucucaacuugauugcucuuuuugcucuuacugucgcccagcagccuauagaggaucuucagggcagccucaauacccuuugaaugcauaaaacuuaaacuuuugauacuauaugcacacauuuggaucuguuuguguuuuuauuuuuuauuuuugaauuuucuuuuucuucauguaccccacaggagacuuaauggauucuguuuucauuuagcuuuugcacucagcugucucugcagaauagauuccuaauuaaaagaacuccaaugauagacuggcuuauguauacuuagugaauucauucuugaucaucauaaugggcaaugacucuucugaaauuuauagcuuuuauuuuguuuuacuuuauuuaaaauuuuugagauggagccuugcucugucacccaggcuggauuacggugccaugaucuuggcucacugcaaccuccgccuccuagguucaagcaauucuccugucucagccucccaaguagcagggacuacgggugcaugccaugacaccuggcuaauuuuuuguauuuuuaguagagacgggguuucaccacauugguuaggcugggucucgaacuccugaccucaggugauccaucggccucccaaagugcugggauuagaggcgugagccaccacgccucgccagccuuuaauuuuuuucauuuuuauuuuuuugagauggagucucucucugucauccaggcuugagugcaguggcgagaucucggcucacugcaaccuccaccucccaggcucagaugauucuccugccucagccucccaaguagcuggaauuacaggcaugugccacuacacccagcuaauuuuuguauuuuagcagagaugagaguuuaccauguuggccaggcuggucuugaacuccugacuuuaggugauccaccaccucggccucccaaagugcugguaauucaggcaugagccaccgcgccugguaaaauuauauagcuuaaaaaaacaaaaacaaaaacacuugcuuugaaaagagucucucagcagcaauuuuguccuugccccuacuuccacaguuccuuuucuuaccauuucacaucuggauuacuacauuggccucuuugcuuagacucccaauauucauuugcuuuccuucaccccauuuuauggaggacugucagaucaaucuuuuaaagauaaauuuuauaauguuacuacuguugccuauuggauuagagcccuaggggugcuuuuuguagucucacugacagcugacauuagugauuuuucacccucuucuuauugcuacccuguguugauggccaguuuccaggugggcaccugcuccacuugcuuucauuucugccuaccuugguucauuguagaagguccuuugcacugucucacucacucuaaaucaggguuguccagucuuuuggcuucccuggaccacauuggaagaaugugaucuugggccacacauaaaauacacuaucacuagugauagcugaugaacuaaaaaaaaaaaagaagaaaaaaaucgcaaaauaaaaucucauaauguuuuaagcaaguguaugaauuuguauugggccacauucaaagcaguucugggcugcggguuggacaagcuugcucuaaauucuguccccuucuuuaagauacuucuugaccauccuaucccagguucauuucuucauuggugugguugguuacucuuccuuucuucaucuguaguagguugugaauuuuagcagucuauacuccauuauuaggcagugugcuuaucuuaaaauuacguguccguuugacucugguuuuucuuuuuaaucuuuuaaguuccuucagggcaaagaaugucuuuuacugcuuuuuuuguuuuuuccaauaguggcuaaugcaggcugugcauuuuagggugugugcaaguaguacuuuugggcaucagcaaguacuucaaauacugaaauuuauuuuuucaauagucagaaaagcaguguugauuucccaguugugggagagaagaucagauuaccucaucuuguccuauacucugcgaucuccuugauuucauccuuaguggaggaaguguuauuuaaaggcauuagauacagguaucaacagugcuuauaaaaggugcuuaauaaccugggaaaaccuuuaaaaaaucuguuaauuuauauacugcauaauuauaauuaugcaacagauuaaaguuugcuuuuuuuaaaagcaguauauuagauuucagccaaaagaggcauuuuguuaagacaccaccaugucuaugguaaucuguuuucaguaguaaccauuugaaacaacaggguaaaaauuuuaagcaguaauuacugcaugccagauugugaugauaccuaguagagaaauaugaagaaaauuauuggagauguugauucuuagacaguuuuuuuggugauuugaauuaaauuaaugagaacacaaauuuuaacauuuaacaucuuuacauguaaguauugaguaacugauuaaaguggaugcacuucacucugcuuauauguagauuauuuuuaauaccaugaauauauacauauauauaaaugcaaaacgagaauuuggaagaucuuauuccuucacugaaagagaaggugaaaacuuaaaaauucuuugcuuuauauacuuauuuuuaauuaaaaaaacuggcuugugauggaacacucaacauuuuuaacauuccuuauuuaagcaacaauuuucaaaaugaguuggaaguuuauuacagguuggguaucucuuacccagaauacuuggggccagaaauguuuuggaauuuuuugauguuuggaauauuugcauaauaauuacuagcugaacagcccaaucuggaaacgugaaaucugaaaugauccagugagcauuuccuuugacugucacauuggcaaucaaaaaguuuuggauuuuagagcauuucaaauuuugcauuuuuuuggauuaaggaugcuaagccuguaucagcuugcuuaaaaauauuugaaauuuaggacaugagcucucuucuuaaaauugcuauuaacuuuugcccuuuugaaauuguauugaaguggccaggcgcaguggcuuaugccuguaaucccagcacguugggaggccgaggcggguggaucaccugaggucaggaguucaagaccagccugaccaacauggagaaaccccaucucuacuaaaaauacaaaauuagccagguaugguggcgcaugccuguaaucccagcuacuccggaggcugaggcaggagaaaugcuugaacccaggaggcggagguugcggugagcugagaucgcaucauugcacuccagccugggcaacaauagagaaacuccaucucaaaaaaaaaaaaaagaaaaaaaaagaaaaauaaauaaauuacauugaaguggcugggcgugauggcucacgucuguaaucccagcacuuugggaggccgaggugggcagaucacgagaucaggagaucaagaccauccugaguaacauggugaaaccccgucucuacuaaaaauauaaaaaauuagucaggcgugguggcaggugccuguauucccagcuacucgggaagcugaggcaggagaauggcgugaacccaggagguggagcuugcagugagccgagaucaugccacugcacuccagccugggcaacagagcgagacuccgucucaaaaaaaaaaaagaaaaagaaaaugaaauuauguugaagugaaauguaucugcuugagagauaugccuuauuuauuugcagugaauuucagaccaccauaaucucaguuuuauuuauuagagaauuaguugaaaaucauaacaaaaguauauuuugaauuaaguaauccacaaucccagugcacuaacaaacacucuucugcuuuuauuuuucuuuccagucuugauccaaaagggaagaaugcaugaggagaagcagucuuuacauguacaauuuuguauuuuacuuuuaaaauuuaauguuauuuuauaaauauuacauguagucauuauggcuauuuuuggugagcuuacauuguuguacuacaacuuguuugcuugcuuauuuauuuauuuaaagagacagggucucacuauguugcacaggcuagucuugaauuccuggccucaagugauccuucugccuaccaauaugcugggauuauaggugugggccacugcaccaggcccacagcuaauuuauuguugaauacuuaguuugcaguuugcuuucaacuuuuuuuuuuuuuucugagacacagucuugcucugucgcccaggcuggagugcaguggugcgaucuuggcucacuguaaccuccgccuccuggguucaagugauucugcuaccucagccucccgaguagcugggauuauaggcgccuggccacuacgccuggcugauuuuuguauuuuuaguagagacagguuuucaccauguuguccaggcuggucuugaacuccugaccgcaagcaauccgcccgccucagccucccaaagugcugagauuacaggccuacuuucaacuuuuuuaauucuuuuuuuuuuaauuuuaauguuuaaaaauagagauugggucuuggcauguugcucaggcuggucuugaacuccucaagugacccucccaccucagccuccuaaagugcugggguuacaagcaugagccacugcauccagccucgacuuuuuuuuauuuuuacaagcacuuugaauguagauuuuuuuuuuuuuuuuuuuuuuggagacuggaucuugcucuguugcccaggcuagagugcaguggcacaaucauggcucacugcagccuugaccuccugggcucaggugauccucccaccuaggucagccuccugaauagcuaggaccacaggcaugugcuaccacacuuggcuuuuuuaaguuuuuguagagaugggcugucacauguuuuccaggcuggucuuuaacuccuagacucaagcuauccuccugccucaccucccaaagugcugggauugcaggaaucagccaucauaccuggcugugacuuuugauacguauguaguuucugaggcccuuccaaaagaauuacgcuaaccaggaaugaaugaacuuggcuuuucuuaaagauauguuuuaauaaguuaaagcuuuaaauaaagcuuuaguauaacuuaauaucaguauaguucuuaguauuuauaaaagcacuucauauacuaucucacuugauuucacaacaacagucugugguauggagagacuacauaaguugugaaaaauacaaaauuuuuacaaguaagacuaccaccugugauuaucagugguuaccaaucaaacuuccucauuucaguuaguucugaaagguccuuucucugaguugaugucaucuucucuuaauguacugagaguguggugagauauauacuaagagauuaauaauuguuuugguuguuggucugucuuaccagcuaguuaaauaucaagcauuuguuuccugcauuggcugcauuccagugaaacuaagcuuguguuguaaguuagagaugcuagauaauaacaugaucaaacugaucacgucugcaggguuguaacauccauguuaguaguauuucuuaagaugcucaauuucugcucugagagaugcucugugcagccuguauugaguguguaagcaguuaccuaauauuuuauuccuuuugaguacagaguaguugcuggagagcccuuuuacuguugagaucaucaguaaaccucauugauaaaucccuauucaaauauuaguggcgguauggucaaacaaguccaggcaauaauugucuugccucugcaguuccugaaaagccguaaucaugguucuuguaguguuguuuuguugggguaguuaauguaaugagguuuguacugacauggccuaggugaugccaugaucacugugucugauaguuugacauaggagcauuucauugacaaaucauuaguauugugaugucuauuggcugcuacuuugcucuuuuaaagaaggauaguagcugauuuuuuguuuacuguuucagcauuguauuaugucauuacauguguuaucucuuucauuguacacaauaggucauuuuauaggugagaaaaagcagaagaggauaaaauucacacagcugggauuuaaaacuaguuuaaaauaaagugauuucagagcauucaugggucuuuaucacuguucuuaaaauaagaagcuuagaguuucuugauauucuccacuuuuuauugucuuaauccauguuuuaaggguucuugguguagggguuuaugacaugauugauuguuaaguguuaagugugguuuugcguauuguucuuuuuuguuagauggaaaggaaaaaagguguuuccagacaaauuuaaaagaagugucucaaguggcugacauugcuuguaaaccagugcuugacuucuauuuuguuuuccagaagccucauagauaagcuuacugaauuuuuuuuuuuuuuuuuuuuuuacuuuucauaaguuuuuuuauuuuauaaacuuacgauucagggugggauaaacaguguacguguguguguuucucccagagauuugagagcacacacuauugguggggcaguuaggaauuccacuuaauguuucauuacaagaaagaguacaaggucuauuuauuuuauugcuggggaugauaggacuccccaagucaugguucucaguuuguagaucuugaaauggacuguuauuacuaauucagaugacuggguugcgauauugaccccacacuaaccagaacaacaagaggcuaauguaugaaaaccaaaaugcagucugcugauuuuuuuuuuuuaaggaaaaaaaacaacucuuagauggacaaggaugguuguguuuggugauuggcaugguuggcuauaggaggaagccaguucuuuaagaagguggcuugguaagcagaguuggagccagggagauuacuuggguguuuuuaguguccaguguaauuaagcuacuaucuaaccagaugcauuaauugcuuugauaagaauaggcuucuuugugcaucauaugcccugcccuuaaaugugucaccuggauaauacuggcuacaucugauuccuugggucucuuuugcuuuuguuggaccaauuccuaauuccuguuaucuucuuuuggaauugucacaucauuuaauccucuuacugcuaaguuauucuuuaaaacaaacucuacaucucucuugugaucuguuacuuuucgccuugucaaaaaaacuagucuuuauuuccagauucuugaugggguggauaggaacuaucuuuucauagguuggaugcauuuacauuuuugguuauuguguguuaagugaagauuuggcaacugcugguauuuaugccaguggguuggcaaacuaggauauuuuacccaacgcuguggaugauguuaccuccagagagcuuacuguugaauuugaaauuguacuuggauaacacauuaucauuugguuuuauaauucaguaguuucuaacuccuuuuaauaugaucagauuugaacaguuagguaucuuuuagcugacuguugaauauaagugauugcuacuaauucucaguaagcucaacaugucuaaauugauuugauuuugccgaguuaaaaaagccagucuuuuacuuuuuuucaauugaaaaggauuuuaguuucaucacuuacauuuaaauauuagaaauggaacaagaaguguuucuugaaaacagacuccuaaagaaguguuucaaauauacaaaaauacuuccacauauucacaacaguguuauugcugcuuaacaaaucacccuaaaauuuaguggcuuaaaacagcacaguguguguguguguguguguguguguguguguguguguguauuuuaagagauagggucucacucuguugcccaggcaggagugcaguaguguaaucguagcucacugcagcuucaaaccucugggcucaaggagucuucccaccucagccuccugaguagcugggacugcaggggugugccaccacuccggacugauuuuuaaaaagucuuuuguaaagcuagagucucgcuauguugguugcuaagucugaucuuagacuccuggccucacccuuagaaagcacugggauuacagguguaagccaccacgcccugccuaaaacaagacaguuguuuaagccucauaguugcuauagguuaggaaccuaggcaugacuuuccugagucaucugcuucaggguccuucacaagcugcagucaugauuucaacuuuggcugcauucaucucaaagcuugcuuggagaaaggucugucucaaacuugcuuggagaaaggucuguuuccaaacucacucaugugguaucaaccaucagaauccauucuuugcugguuguuggacggaggaucucaguucuuaauuguguguaaaugacccagggcagaggcagaguucagugggaagcugcggagcaacagcuuuguauauguagcuguuguccagagaugucucucucuuggcuucauguggcgucuguauagggcagcucacaacauagcagcagucaucaucagaguaagcaaucaggacaauagauagaagaggacaagcaagauggaaaucacagcuuuuguaacaucuugaaaggaacaucccaugacuugucuuauguuauuucuuagaggcaugucauaggucuagcccacagucaggggaaggggauuacucaggguaugaguacuuguaagugaagaucauuaagagucauuucagaugcugcuaaccacagcaguugaguauagacgcauauguuuuggaggaaagggagaaagacugaguaagauucagagacuuuuaagagcuuugcuaauuuugcuucugucuuugcccaagcaccuugguucagucuuuugcuuucuuuuuuuuuugccauaguggcaaaaaccacacuuuugcaccaaccuaauagcacuuugcuucauguuugcuguauuguuguuuccuuuugagagaauuuacccugaaaauagccucgcuuauguguucaccugcuucuccuggcuuugcacauuaugacagccugguauacuaucaugaaaggugacaggaucccagaacugauuuuugaagccuugagcugaaaggcugcugcuuucuguaagcaauuuuacaaauuauggauaagacuauauuuacauauggaggcugguacuuuuggaaacuguuccuugagguguuuuuuuuuguuucuguuuuuguuuuuuuuuuuuuuuuuuuugagacagagucuugcucucuugcccaggcuggaguacaguggcgugaucuuggcucauugcaaccucugcgucccugguucaagcaauucuugugccucagccucccgaguagcugggacuauagauguacaccaccauacgcagcuaauuuuugaguuuuuuaguagagacggggaucuugccauguuggccauucuagucucgaacuccugaccucaggugauucaccugccucagccucccaaggugcugggauuacaggcgugagccaccaugcugggcccuguuccuugaguuuuaaauaaacauuuacaaguuucugugaggaaugaacucuuaaaacauuuaaaggacaagaaugguuuugaucaccuuagcguucuuugcacuguuauguggagcauaaaacaagugagacccuccuuaggcugacauucuuucuucuggaauacaaaagaguaguugcuuuugcuuugcacaaaauacgggagaaaaaaaaucagaauuuuaauuggagaaaggguauaaccaaugaggaaagaaauuuuauuuguaaucuucggacaggauuuuuuuuuuuuuugaagauggagucucgcucuguugcccaggcuggaguucaguggcaugaucuuagcucaccgcacccucccacuccuggguucaagcuagucuccugccgcagccuccugaggagcugggacuacaggcacacaccaccacgcccggccaauuuuuuuuuuuuuuuuguauuuuuaguaaagacaggguuucgcuguguuagccaggauggucuugaucuccugaccuugugaugcuccugccuuggccucccaaagugcuaggauuauaggugugagccaccgcgcccggccuugcaggggacaggacauuuuugagacuaaaaggagaaaaauaaguuuaaaaauaauuauugaauuguccuuugcauaguuuacauuaauuuucaguauccccucugugaccugguuugaccgcuguuuugccuaggugugauguuuuugaauacauuauugagaaccuguugugcuaggcacucaucaacaauauuucuaaucaucacagcaacuugaacgauauuuucuucaucaauaaaaagagaaugagguucagggcaguuuaguaagauuuccuagggcacuucaaaguuguccaguuuagugcuucccgacccuaaugcuacccucgaucggggcucuuucccauuuuacccugauccucacccucccccaaaugcccuuaggguaauaagugguacaccaggaagacugcuacuuauaacuguucauuuucaaggaaacuuagguaucugugcaauuaaauaccagacaaauguuuuuuuuuuuucucaaucuuguuuaauuaguaaacaacaaauuagguccuuaagagcaaaauguauggcaaacugcuuugguccaggcaguaacccaaguccaugagauagauuauagagccacuuaaagguagaugaaaauuaugccgagaaacccagaaauuagauuugggaagcagagauuuauuuuagugagagcagaguuuaauuauuuuuccauuaucauuggguuauggguuaaaugggaaaguuaaaccuuuaucgucaaggagaggaaauguuuugugcuuucugguuuuuuauuguguucuucugagaaauucaacucuccagguauuuuugugcucaaaaauggugguuaaauacuaucucaaacaucuuaguuuccuguguaauagcaguugaaaacauaauuagaggaaauaagagggggcauuuuagucaguaaagcugaugaccagaaccaagaaugauagaguucuguggaauuuuacuuuguaagccuggucacuggugcuuugaucuuaugcaaaacuguacugugucuugcuugaaggguacuuugcauuuuuuuguugaagcuaguauaaacuucucauguuggcuuauggccagcgaucccuguuucucugaagcauggagugauuugugaagucacuuuaauggcauuaccaaguauuguuaaaaaauuaauggagguuagaagauuuuauuucccuuccaguaaugaaggaauagcuuuucuguccuuccaaaaucuuggaauagguuaguguugugguugggaaguauuuugguuaauggagucucuguguauaaaggaagugaauuuugccucuggcauuccauagcugagguucauagcugguucaugcuccagcuugaguaacuuugucugguaguuaguacacguauagagagaaguguuuuaauaguuguaaauacuuucuuuuucaguaagaguccacuuaguaguuagcuaauagggucacuguuaguucccuuccccacuccuuaaaaaucuuggcauggguuaagcgaguaauucuagauauuuaaguucagccucuauuggaugguuugaucaguguccccaccccugccccccaccuugccuuaggccucucugugacuuuuaccaaauauauagcaguguucugaccacaguuguguaguuggaacacuuuaauuaaagaccuucagggcacgugagcaucuucaguacccuugucuaaaagaaaguguugacugcuguacuuucauccuuuaugaauucuuuaaaagcaucuauuauuuuuaauuugcagcagcucuugccagguaaaaaguuuugggaaacagaugaauccagcaaagauggaccaaaaggaauauuccugggugaucaauggcgagacagugccuggggaacaucagguaaucuagaucuagcaucuguacugugauuuaugccugucuuagagcuccuuuccucagcaauuggcaagucaugaauuuuacaucagugacauaagcaugucaagcaguguccucuccuguaguauaauugccauuaaggagcuuauaugauguaauuuauuaaaacauaauuaacacaaaaucauaucuucaauauuuuuugaagugcuagccacaggggaauggucuuauuugaaacgaccauaauuucagcuguaacguuuuguucuguacugcugucagcauacuuggaauuagaaaauccacaccugccauuugaaguucauguuucuuuuucuccccuugcccuuguguaccguguauggaaugaucuaucuuuaaacgugauugggaccaaaucaagucacugggcauggacauucuucuggcauacuaccccugaagagggauggggagaacuuauagaggcagacacacugacagcagaaaaagugacagaugauagggaggaaggagacagaaaacccaaaagccaaugucguguauuacaguacaacguaagcauggaaccucaugaugacagugaauuaucagaaaagaacaaauuauauuguuuuuaaaaagggcaguaaaaucauauuuuguuuuaguaauacuaauaaaauauauuaaaaagaaauccuuuuacuuauaaagggguaaaaauuuuauccacucagcuaguuaaaccagauaagcuagauaaacuguuguauuccucugcuauccuggauaaaugaggaguguguuccauuuccuuagcuuauguugaauaucauacagugagggacaugauaggagguuuuggcucaacugaccauggcaaguuuccugauuccauugguuauccaugagacaucacucauaauuuguuugagccucuggcugcacuguaucaugcuuguguaucuuuuuuguagaucauucaguuucccagccaaucauggugcagagaagaccuggucagaguuuccaugugaacagugaggucaauucuguacuguccccacgaucggagagugggggacuaggcguuagcaugguggaguauguguugagcucauccccgggcgauuccugucuaagaaaaggaggauuuguaaguuggcuugaggaacuuguuccuaucucucucucucucucucucucucucucucucuuuuuuuccccuaaagcaaaacaugccuguuuaguuuccuuagauguucacagcauuaauuacaggguauuuucaaacaacguuuguuguaaauagaacucagcaaacauaguaggagauguaaacucaacuuuuaaaaacuaaaguaauaauguuuugguggggggacacauugauaguauugugagauaagaacugaaaucuggaucaaaguucauuggucuaucagaaaacaccauuuuuacuuuaaaauaaaagcaaaagggggguggugaaggaauuaaaaaaauaaagcugaugcugggauguuaacagggaauuccagauuugagagcagugauuugccaauacccgagaaaccuuaauauagaucagauuauagggcuauucuuguuuuguuagcuacgauuuaauuauagaauccucuuuggcccuccuugaacggcuuuguuucucacaccuggccugucaagaaauuagggauucuguuaauucuuucuuacaaauuuuuuugauucauuaucacugaccucucugaugcuaaacugaagucaaauaagucucugugucuauagccuuuuucuuuuuaagucuuaagcauuuuucuaugagcaucugugauagccuuucucaaaacaauuucuuucuuuaucauuaacuuucuagaucgagaaguguuaagauguauuuccauuugagucuuccucauuuugaauucugcgacuguugucauauuccaggucacagacaggaaggccaugagaggcacaugaaucuucuucccucccuuucuccugucuaaacuuguuuuguacuuuuucaaagacauuucucccugcagucauuuugggcugauaucaccugaaaacagucauuuaaaagauuuuaauguaauuugugggaaagaacagcagaagcaccuucuuucccacaaauugagaauuaauauuauaacugucuuucuuuaauagcauuuguugcucaguauuucuuaguguuauacaucuuuugcuggguaucagaggcuugguccuauuuucccuauuccacauuaaauuuuguuagaguaacaguaguucauuuuuggugcagcuuucucaagugucaaguacaguucuuaaguacuagcuauucuaaagcugaccugauugcuuuucaguguuuugacccugcagagaccuaggucagguuuaguagcuugugaaucagauaggagauggcuccuguuauuugaaccuucccaaggggcugcuugggaagaacaagaucuacccuuuggaugugaguuacuucucuuucuucacccuauccccagcucaccucuuuuucuguccucacucuuuccucaucuuaugagcacagauuccucagcagaaauuaguguugugcaucaguagguugcuaguguggugaacuggaaccugugacucuagcugugaauucucugucaugugugugaucaguuucuaauucuugggcacuaaccaggaggcaugugccugcauuacugugaagcuuguaggaggcagaaaaauaguuggaauuaggaggaagauacauggugggauugaaucauuuugccacuuauuuuucucucuuuaaacagucaucucacuagacgguuauuuugaugacaaaagcuguaucauuugucuugggagacuggugauuuaccucuuuuacaaaagaaucgugacagaggagguuaagacuucaggcuagauagauggggccagaagauuggacuuuaaccaucaagauaauuuacugagcugcugagguaugcauaaagauaaaugaaaauucugaaguaugcaugaagauaaaugaaaauucuccaaaucuguguuccagcuucuuuuagaaggaagauuguggguaauggaauauuaucccauaguuugacuuagauugcaucuauagagugauacaagaggacugaucuagugacaucaagccacuuguuggcauauacagucuucugguggauggagaccuguggcucagugaacugauuauuauuguuauuauuauugagguggaguuucacucuugucgcccagacuggagugcaauggcaugaucuuggcucaucgcaaccuccacuuccaggguucaaacgauucuccugccuuagccuccugaguagcugagauuacagaugccugccaccaugcccggguaauuuuuguauuuuuaguagagauccgguuuccccauguuggccaggcuggucucaaacuccugaccucaggugaucuucccaccucagccucccaaagugcugggauuacaagcgugagccaccgcgcccggccagugaacugauuaucagcuuugugguuguauccucuugauuuuauaccuaaccugacuuugcucugccuguuggucaggaugacaccugaccaaagcucuuuuuguggaagccugaaucacuuuauuuuugucauaguaugcauacaucuucuugaggaaagugagccuuuucuuuuaaagucuagucugucauuuaaaguguugaauucagagaaccaggaagauaggauuucugcuucuuguagauaauuguucuaaaggaggagugguacuugguaguguauggggucagggcauccacguauuuuuacuuuugggguagcuguaucaacauuaauuccaguaagccucacuuuaauccugagagcugaaagcaucaucucugaugguauagugauuguagaccucaaagcaaguaacuaagaaguuauucuuaacacacugacaacagauaauugagacuuuaacuuuucagguaaagguguuuagaacuaaaauaaaucucuauguaguguuuuaccauuuucagugaacuuugcugguuauggcuagauugaagcuguuuagcucuuugucuagcuugaauucauuuugauuguacaaauggucucaguuuagugguuuuggcuucugugauaagaauacauucuggcuaacaagaagaaucuggcaaccauauuuuguucugagcauucacuguaaauuuuugguaguauuccacauaggaaucucaaacuuuaggagagcagcuuucagaauaauagagcucaaaaauaucaaucaagucuuuuauuuuucuuuucuuuuguauccuuuauuuauucuuggaguagaacaggugcucaccccacagccccccaugguucagggugguuacaaaaucagauguaauuauuuuauuuuugaggcccaugggugagauugccaucuaaggacccugcucucuggaauaccagcugaucuuuuucaaauagguggaagccuagccagccaaaaaauggaucaugauuucuaccuugcugguuuauggugcccagggaaaugagaagaucacucuaaacuuugauuaggguaaugaccaccuuaaccucacagaagaaagauuuuuagaaaaaauauauugggaaggucuuucuguuuguucuguagagaguaucugcuuuuugaucuggaggauguauacacauucguaguauacaucuauuugggccgugaaacuuguuugucuagguuucacugcauuuacuuuagguaaccagugcuacuuaacuuucauagguuuuguuugaaaacuucuguacaauguaaugcagauagaaaucagggguuugaguuucaaauggaccuuaauucaucugcaaaaugagaauaaucaaaacucaacaaagucuaauucauacggcuguguagcauaugugaaaaugcuuuguaaacauuagaagucuuacuaccaaagucagugggccgacagcauuagcaucaccugggagcuuaucagaaacgcagaaucucagaucauaccugagagcgaaugaaucaaaaucugcauuuugacaagacuacccagaugauuuguaugcacauuaaaguuugauaagcacugcuaucauacgcguuaucucagaaaacucagcuggacaaagagucuaaugauuagagccuuaaaaguuuccuaggggaaaaaacauaguaugucuagcaauuuuuaagccuugguggggagggcuggugagggcauugugaaaaaggcaauggggaaaaaaugugaaaauuggauaaaguauuuuuuuaaaaagacaacuguacuuucaugaauuucuuuguuuaguccuuggaacaacacuuugagguagauacuguugucucuauuaauuuauagaugagaaaacugagucuuagaggggaaauggggggcugaauucaaacuuuguuuguucuaauuucaauuuuuagcuguauugcuuucaacugugccauacuggcauuguuugugaguaggaauccucacaaaaggaucagauuuaauauguuaaauuaaggaguauuucacauggccagcaguuucaaacuuauaauuuuuaauauuugaauuuuuuuuuuuugagacaaucucuuucugucucuuucugucaccuggaaugcaguggugugaucucagcucacugcaacuucugcuuccuggguucaagugauucuugugccccugccuccccaguagcugggacuacaggagugcaugugccaccacacccagcuaauuuauuuauuuauuuuauuuuuauuuuuuuuugagacggagucuugcucugucgcccaggcuagagcgcaguggcgcaaucucggcucacugcaagcuccgccucccggguucaugccauucugccucaaccugcagaguagcugggacuacaggcgcccaccaccaugcccagcuaauuuuucuguauuuuuaguagagaugggguuucacuguguuagccaggauggucucgcucuccugaccucgugauccgcccgccucagccucccaaagugcugggauuacaggcgugagccacugugcccggcccacacccagcuaauuuauauuugaaauuuuaaauuaccaguagagcucgacauuguuguacuucaaaggaaucagacauuucaguuuuauggcauuuugugaaaauggguaagugugugcaggagaaaccaguguuuuaguuaacauuguuauaguuuuuggacucagugugucaagcagguauaaaauacuuuguagaaagaagggaggaaaaugacuaaucccauuaaauaugacuucugcugugugaagcuuucuuuuaagaucacggcaguaagaguaguaaauagauuugaaaucuucugacuucauucagaauuaauagguauauuaggaaguauuccccccuuuaugugagucuuuugaggaaguugagccauaagugcauggauucugaccucaacaauauauaguucuaccuacgucugcuuuucucccaguucuuugauauuuagcaauuucucugccucucuguaggucugggaucucucagcacccaucuugguuccacucuugagauuuugauugggcuuggccacuugcaauuugagcauuuuacugaaguuuguauuugagcacuauagcuuuggguuaacauucagcuaaagaaagcccauaauuaaaagaugcuguuaagccuuuuucauuuauucauuuagcuaauagacuuuuccaguacuguauguacuugauaauauauaacaaaaaagcaaaucacaaaccaugccuuucugaugcuuauguugcauuuaauuaccuugguucucaauuguggauacuuacccgagcuauuugaggagaagcuuuucacaacauuugcaggaaccucuacagaccaaucagaucaaucucuggugcagagggugggcccagccaccugugaauuuaaaaagauugcgaugccuaacccuaaucauagaaccacugcuuugugcaaaugacaaugccccugggagggccauauuggccguauacuuguauuugagauuuaaaccacuuaauugggacauuuaagauuuuuauucuugaugucauguauaguguuacaaagaaacaccaucccagugcgucucuuuauuacuauuauauuacauuuguguaaaauggcuuaucuuuauaaaacuuuuaggcaugcauuauuucauuguuauucaugaguaaacaaagucucagagauuaaaugaccuguccaaaguccugugaccaguaaguguuagcaguugagauagaauguagguucugugcacccugguucagcaccuuuuuuuuuuuuuuuuuuuuuuuuuuuuuuuuuuuuugagacagagucuugcucugucacccaggcuggagugcagcagugugaucuuggcucacugcaaccucugccuccaggguucaagcgauucuccugccucagccucccgaguagcugggauuacaggugugcaccaccacgucuggcuaauuuuuguaguuuuaguagagaugggguuucaccuuguuggccaggcuggucuugaacuccugaccucaggugauccgccugccucggccucucaaagugcugggauuacaggugugagccaccgcaccuggcggguucaguauuuuuuuaaaagacugggcuagguguuauggcucacacuuguaaucacagagcuuugggagaccaaggcaggaggaucacuugaagccagguguuugaaucuagccugugaaacauagcaagaccccaucucuacaaaaaauauaaaaaucagccaggcauggugugugcaucuguagucauagcuccuugggaggcuaagguggaaggaucacaugagcccuagaggucaaggcugcagugagucaucauugcaguacugcauucuagucagggugaaagagcgagacccugucucaaaaacaaaaacaaaaacaaaaacaaaaacaccacacagcuaugaauaguuuaucuuaaauauuuuucagaaguguaaaauuuucauaaaacuuagcccauuuauaccuuucuucuauugucuuuagggucuucauguuuuuaagagaccauuuuaaggaucuugaaccugauacugcugucuauuaaugaaauaaacucagggucucacuuuguccccagacuggagugcauugccagugcauauuuuguucugagcauucacuguaaauuuuugguaguauuccccauaggaaucucaaacuucaggagagcagcuuucagaauaacaggagagcucaaaauaucagucaagucuuuuauuuuucuuuucuuuucguauccuuuauuuuaucuauucuuggaguagaucaagugcccaccccacagcucacugcagcuuugaaccccugagcucaaguggucuucuugccucagccuccugaguagcaaggacuacaggcgcaugccaccuugcccagcuaauuuuuuuaaaaacuuuuuuuuuagagauggcgucuccucuguguugcccaggcuugucuugaacucuaggccucaaccuagauccuuccgcuucugccucaaagugcuaggauuacaggcaugagccacugcgugcagcugauacuaucucuuaauaacagacuuuugacagaaugguuuccuauuugugcuuuuguuuuuacucagaagucagacuucugcuggccauuuuuauggagggccauuguugauuucuugaguuucuuuuuucuuuuaaguaaacuuuauauugaaauaugaccuauguucagagaaguguacgagccauaaauguucgucuugaauuucugcaaaaucaaaacacccauauaacaccuucccagaucaagaauuagaaacuucccuuggguuccccacucucuaaaagaaggagcccaccauuuugguuaggcaucaauagcuuauucagaguagaaaacccgguauuuuguaggaauggccuguacgauauugguaaaaugcaacacauugcagggaaauauuugaaaaucuggcccguggcaguauaacugagaauguaaauuaguggcugaaaguguaacuuagcagucaagauuucaggccaugccgggcgugguggugcaugccgguaaucuuugcuacuggggaggcugaggcaggagaaucacuugaaccugggagguggagguuucagugaccugagaucgcaccacugcacuccauccugggcaacagagcaagauuccgucuuaaaaaacaccaccaccaccacaaaagagauuucaggccagucagcauguagaagagcugagcagguucucaguaaagcccuugugaagagccccugaggaaagauaaugcagagcauugauaugacuagugcacauccccugcaaccagcugucuugcuuguuguugaaacuuccuacugcugcuuuauccuccuuucuuuccuuuaaaaaaaaaaaaaaaaaaaaagacgaguuucacucuuguugccuaggcuggagugcaauggugugaucuuggcucacugcaaccccugccuccuggguucaagcgauuguccugccucagccucccgaguagcugggauuucaggugcugccuaauuuuuguauuuuucuuagagacaggguuucaccauguuagccaggcuggucuugaacuccugagcucaagugauccugccuugcccuuccaaagugcugggauuauaggugugagccacugcgccuggcccuuucuuuccauuuuugccuacagaccuuuugaacuccuuuugagaaauuggagcugaacuguuucuucugagccagugauuugauuuguagacugcggaagaugaugacuuaggcguggcagugggaugauucuuguaauauucuuuugcuguugacauuaaugguuucugauucaggcagaguugucaucuagaccauauuaccaccuccaggacucuuauuuaaugaugauaaggacaacaggaagaucauucuuauuuuaacaguucaguuuugcaugauuuuuuuguuccuuuuaauuuucuucaucauauuuauugagcuuuuaucaggcacugcagucagugcuagggauauaaaaaugaguacacagcuuuagucaguuuugccucugcaguauggaggaagcuauugccuuuggauauuuugaaagaucuuuuugccuuuagaacccuaucauauuccuaucucugcuuugaggaaucucaauguggugcauaauugguuaucauucaguccuuuuaaaucaauaacagccacauacuuuaaagauucuauucugaagggcacaucucaauggccgucaaagcugugguuuacuguuuugaugccacaugaagcuaaguuguauauccuuucucaguuccuugucauauuuguucuuuuuuuauauuaucuuuuucuguaucacauuugaacagagaauaacuuuagaaguaaaaugggcucuaaaguaguaguugaaagguuuaagaaugucagccuuucugggccagugaucucuuaagagcaucuguugguuuuggaucuacaggccuguccacagucagucuauuuauaaccgagugucugcugcuguguccuccauuguugauuucuccccauugacauuugguuuuggugacugggaaugcuuugcagccacucucaucuucuauugaguggaucuugccuuguaccaggaacuugaacuugguccaugugcauuucucuuccuuaaaccaggagucagucguggggaaaagcaaggcugcuucccucuaguuuuacaagaacaaaggguuaaacccuuaacccuuugguguaagguucugcaaaucucucuguacuaugucaagucacuauaccaaaucuuuuccuuuggaaaucaagguacauguacuuuauauguccagggcuuaacuugggaugucgguaagaggagauagacacuucagagagaaauucuuuuguaucaaaugcuucaauuuaacauacucccacuuagagaucucaugaauaaucuuuguuaccaguagaugguagaagauaguuauuagaauacuuuuggugaaagaaucucagaguuaacuuguuuugaggcauuaaaaaauuuaagggucaucagugaauugaugcauaccugugaggcuuauaggguagagcugggaggugaugcaaauugacagggcauauaucccaagaucagguacagaauaauugaguugauaugauguuagaccacacuuggcucaauauuuagaaguaagggaggaauuuacauagugcaguggagaaguaugaaauucuuuuuacaggcuuaauaauuuuuuuuuucuaugcuauuagcugucauaccuggggcuuauuaagagucaugcuauuauacagaguuagguuugggaguagagaacuugaccaagagcugcaaaguuauggcugggcuuuggguaggaagaaaaaaaaggaaggaagaaaaaaaaggaaggaagaaaauggguuggugggacauuggauauaguaagacuguucugaacucuguaacauaaauguaugucugucucccucauuuggcaagaccuucugcaguguuccugccucuguguuguuuguuaauuagauuguaaugugugaaagggcacaacacuauccucuucugaguagcaucuaguguagucuggugcccacaacgguugcccguuauuauuaguugaugacgauuagugaagcugaagcuauuuuuuaaacagggcccaagggaugcagacagugaugaaaacgacaaaggugaaaagaagaacaaggguacguuugauggagauaagcuaggagauuugaaggaggagggugaugugauggacaagaccaaugguuuaccagugcagaaugggauugaugcagacgucaaagauuuuagguuuguauguuuuacacuucugauuuuugaauaugggcuaugggauuuuguuuguuuugauuuaguuuuacuuugauuuucguuuucuuccccucuucauguuuucuuuuuaagaauccaaucuaguguaggcuaugcuacaaagauuguaaauuaacuggugagguggaauuuucuaaaaggugucaaugccugaagcguugccaaaaugauagauuuugcauuugcauagaacuuuaaaaucugaagaaagauuccagagaagacuauuucagugauucucagauauuaaaaucaccuaggauagaugccuuggaaccuuucuuaaguuucucccaaauuaccguauuagagagcuaugguuacuaauggaauaugucauaucccucuggugguuuagagggaaaaacaguugagaacuugugcauuaucucauuugagucucaugagcucuuuuugagguagguggaccagguaucauuuuccuuauuuugaagagccagagaugcagcuuaaaugauuuguucuuaaucauaucucuucugcagaugccucucauuccaucucuggucaugauuaauguacagguuuuacccuauuauuuaaguuacacaguauuaaaauaauguauauuuaucuuccacaauuggcacauauucuugaaaaaucuauaaaaauccuuguccaguuauauauacagguagaggauuuuuuuuuaaucuccagugugauaguacagguagagaauuuaauuuugaguaauuuuaauaucaguguaaagcuaaugugugugcaugcacacacucacaccccucugcuuauucuaaugucugccaaagucaaaaugaaaauguauuuuggaccaucguuguaggacaagugucaguuguuuuguaucccuaaucuaauuauuguuaaucuugcauguguaaauaauuacagucuuaaacuuuuuaaaaauuauuuuuauuuauuuauuuuuuggagacagggucucacucuguuacucaggcuggacugcaguggcaugaaguuagcucacugcagccaccaccuccugaguucaagcagucuucccacuucagccucccgaguagcugggacuacagccgcgcaccaccaugccuggcuaauuuuuauaucuuuuguagagaugggguuuugccauguugcuagguuggucuugaacuccugagcucaaguggucugccugccuuagccucccaaagugcugagauuacaggcaugagccaccaugcccggccugaauuacaaucuuuggaagaaauuuaaggcacaggguaauaaauacuuaccuaaggucuuucagaugaguucagguguccucuccaccuugaauauccagcagccuguagcaguauuuuguuguauuuaaaugggggcuggugguggugguggugagugugugagugagagaaagaaagagaaggaaccagaauaauaccuuuaauauguaccagcuacuggacuacaggauuuuuugggguaggggguuggagguggagaagaagggcauugaauguugccacagguuacacucuucuguuuauauaauauuauauauuagucugauuuuggaucauauaauccugaaguccuuuuauauaaggugaugguagacccuggguuacccagaaccuuguguccuacaauaauuaucaauagugcccuguuuuuuuuuuuuuuuuuuaaaucuuaggcauguccugguuuggaugauaaauuacaucuucccauuacuuuuaauucuuagaauugucuccuuaacaggggcauauccuagauaaugaguucaucuuguacuacuuuggaauagucugcuuauuucgguuucuuagaaaggggaguuaguuuuaacauuggucaguaauaccaacgacauguaaaaacuuuuuucauucuguuucuuuccucacaaauaugccaggaagauaaaaacuuuuuagaaucacugaguuguggaauuucccccagaaaccaacuuuuuccauugucucuguauuuaaagaguagauagaguagauguugcauuuugaugcauuuugggaucugcuuucauggaugcuauagacagugauuuuuccacuuuauuucaguuuuccucaaacccggcccccuuggugaagggauguaaauuaauagcaauuaaugugaauuuaaggggugaguuauauggaauugccggcaauagaagcaucaauuuagaagauguaacccuguaagcccuguaaaguaucucugguuauuuuauagaaauaguuuuaaauacuguugauaaugagcuauguugaggacauuguccuuaaacuuggguugcuguagucccuccccacugaaaauaagguuuaaugcccuuuacuuucucuguuuagccguaccccugguaauugccagaacucugcuaaugaaguggaucuucuggguccaaaccagaaugguucugagggcuuagcccagcugaccagcaccaauggugccaagccuguggaggauuucuccaacauggagucccagaguguccccuuggaccccauggaacaugugggcauggagccucuucaguuugauuauucaggcacgcagguaccuguggacucagcagcagcaacugugggacuuuuugacuacaauucucaacaacagguacugugugugucucugucacccucucuacucucccuccagccagcacguuguucaaguaauuaagaauggggggaugggggaggugguggcauuguuucaggcuauccauagcuagcccuugugaaccuguuagugauguagguuuacagaguccccucaugaagcuggucccuaugcugaggucacuggcaagaggccaccguccucuguauguacuuccuuugguucuucucucuccucagcagcuggggaguggaugagguaguauugccucuuguaacacaacccucucgggugcuaaauuaaucucugaagauuuaugugguugugaugcuguugguuuguuuuguuuuuaaaauaguaaacucuacuauccaccgcugucaggaguguagugccaggucaucuuaccaguugugucuuacaguuaaacaaguuacuccagauagcauagacaaggaucuggcaucuuucaaaaguauuagaaugcgaucagaggaaaccacacacacaaaucauucaacuuaaaaucuaccaugaaauugcuuggcucuuuuucuuuuuuuaaauucauaagucccugaagauguuguaugucuaccuucuguuuuugaagacauguaggacuaccucuaggauuaacugaucucuguguuuauuuauuuauuuuuuaaagaaaggucagcugucugaacuacaaaagaggggcuguuaguuucccaaucuuguuaaguucucccuuguggcggaagcaguuugauugaccaugaauuucuguuacucuuuaguaguuuuguaauagaucguuaaugcagacuucuagguuugaaagguuagcaucucauuuugaaguuuagaaauucuauguagggaaauuagcuuauggucuuuggagauuauuaugccguguuguaccuuuaguuauugucauaaauagcugauacuaaaugaauuuugauugauagaguaaaaaguuaaacauaugaaguuucccuuuaagucuccugugucguuuaugaacaauaaauaccuuuaagggauugugugaaugugcauauucauauaagguuaaauuaacaaaauaucuuucagagagaguaaacugaaaguguacacucuucuccgugcaguucuuaguagguaugccugccuccccauaugaauugacucucugugcuuuuuuucucuuuauggccauuuuugguucuuagcuuccauucccaguguaaugcaaucuaacacuuucuguguuuuuuaagaaggguuugucucagauuucuuaugaacaaaaauauaugguucucucuuuuuuuuuuaaacuguucuuuacuucauaaucagaguugauauucuuuuuugauuuauugaucuuugguuucaaaauaauuuuaccaguuuuuggagacuggacaauuauuagaacuugaacagaaauguacuucuauguacccacaaguaguuagcaugauuacaucauagcuaccacuuauucaaaaauauaaaaccaagggugcccucaccauauaucucagcaguuauugaaaguaaacauuauuuugaaaguuaaucucuuguuggauucagguuuccugugcaugucuugguugcugcaacauagaggcauuuuuacacagacauaccacugucaugaugugaguguuguuuuaucucaugggccauaauucuuuucugaguaguuuguuuuauacauucuuguaccgggggcccuaauagcauaccugggaaccacuggcguaagccuccuauaucuuuaagacccucaaucucucgguguuccuguauaagagcuaguaguugucaagaaggaacgauuccuuuucuauuggaaauugguguuuguuucuuacauuuuaucccuuauccuuuuaguuuucauuacauuuuauuccacuuuucauuucuaauuuacguccaccucauuugucaagguucaguacugucaccuuccuuucuuagucuccaaaccaaaaagcugucaugucugccucccuagaacuccauagcauuuuguguuuccuuuaagagaagguguuaccauguuuugucuuguguugugauuacucgucuaauaguccuugccagauuguaagcuccuugagggcaaagacugaaccuuaccccauuuccucugcauugcuuuagcagaacaagguuucaggggacuuucccccaucccuauuauaauaucucagugcauccucuguacguaauaugcuucccaaaauuaaaauuugaaacuagccuuucaggaggucuggaggcuacucuuugagaacuaccguguuuucuaauauguguguccuuuggauccagcuuaccacuuauauacaaauaacuaugcuguauaauauccaggaaaguuacuucuuggaucagaacuuaauauuuuaaggcucacucuguugucaucugaucagaagccauggucucucucaugagaaaaauguacauaauucucugacacucaguuuuguagauaacuucagggagaccacagauuuguguucuacagauacagccuucuguucauaucuuuuguucuuuguagccaaccauaucuuucaugaauagaguaagauucccuuucuucuucuugauuugcucucagguuagucauuguaacucacuuuaucauuuaaauugugcauggaaguacucgaugacaagugaugagaccauuuaugcccauauucuuggaacccugcaacuauggagaguguacucuggucucuugggaagggaaggacuuuguggaagaagugguucuuuuuuuuuuuuuuuuuuuuuuuuuuuugagacggagucucacucuuuugcccaggcuggaguucagugguacgaucuuggcucacugcaacuuccgccuccuggguucaagcgauucuccugccucagccucccgaguagcugggacuacagacacccaccacugugccuggcuaauuuuuguaguuuugguagagaugggguuucgccuuacuggccaggcugguuucgaacuccugaccucaggugaucugcccgccuuggccucccaaagugcugagauuacaggcaugagccacugcgcccagccagaagagguaguucuuuagcugugccuugaaagacuuuuuuauauacgaagaaaaugagaauucuaguggaggaaauaguaaaacagauauguguucaguagauaauguagaaguagucagucugguuggugguuagguugaagaaaaauaacuagagagguugaagagaugguguugugagucuuaugcuguguugccuauaggaaaugagaagacacuuuaaagcaggaauuacuuaauuauuauaguuuguuuuuuuugugguuagugugaguuuagcagcaguuugaggcauucucuuacucuuauuauucaguuaacuguugacuguuguguccuucuaggaaccuuggguucugaaugaaacaguaguggaauauuuggggaacuaagugcuaaauuaauggguucugaaucuuaucagacaaggggagggcucaaugaggacaaagguugcaugcaacugacuugaaggacagguggaauacauuuuguugcaggucagagcagagguauggagcugggaaugacugugguguaguccuaggcugaagagaguagaagacgaguguacaagaggacaaggagguacagaugccuuugaaaauugagucccggaggccuugagaaccagcuggaagucucagacaguacugaugauugugaggguuggaccagaggucuagugcagcacauacuuuucugcacauucugcucuuuuuaucuuggcuuucugaaauaagcaacaaaggugaucauuuuucuugguuuagaguuugcugcaaaugguagguuugcuuuauuugugauuuuuuagaauaggaaucugguuuggagguugacaaaauaaguaauucucucuuuuguuauauuuucuuucaaucuuggcuuugauuugguguaauaagcugguuucaucaaacuuauuaucagccuauaaugagauacaugacauggagcagccugcaaauagggaaaagguaauuuucauuuaauucauugcaaacuuaguucuuguuagcugugacaugggauuuugaugagucaguugguugucuggucacuguuaaucacucugaauuuaacccuuguaagguuuauuuauaagagcaggaguuucuaauucuuuuuuguuuguuuuugugugugccgugaacuucuuaauaagugaaccauguggacuacuucucagaauaauguuuaaaauguauaaaguaggauuacaaaggaaaccagugguauaaaaauagcugucauauuuaaaaacaaaguuaauuauauauuuacuuauuuaugauaugaugcaugaaauagaaguagauguacuagcugucauaaugagcacaaguaagauguugagauacuuguaacaacuguaaaguaacaugaaaguauaugugauuucuguuugugauaaugucacagguauauugcuaaaguuaauguaguuuguugucuacaaucauaauugaagaacaugcuaaauuucagguaaaugugcaugagauaaagaugcaguauuacccacccaaguacaaauaucuuggguucagaaccucugacuuggaguauuuugucagcuugaaaugcucguuguuauuucuaaaauguucuuccuuugucucaaauucacuucauugucuucuuaauccuggaaaacagcugugagcaguucaugcauaauguguucauaccauuuuguacugugauguuggagcaguauuuauuuuuuacaaaaugcuauacaguugccuguuuccuuaaaugcaguuuagaaaauuauuacuagguuuuggcuaggcgcgguggcucacgccuguaaucucagcacuuugggaggccgaggcgggcagaucaugaggucaggaguucgagagcagccuggccaauauggugaaauccccuuucuacuaaaaauacaaaaauuagccgggcgugguagcacacgccuguagucccagcuacucgggaggcugaggcaggagaaucaccugaacccaggaggcggagguugcagugagcugagaucacgccacugcacuccagccugggcgacagagugagacgccgucuuaaaaaaaaaaaaaaaaaaauuuguuacuagguuguauuauguuacaaacauggcacaaaccaaagccaggauuauaucaguguagaauuaauuguauuguugaucuuuauuuagaauucaguuaaucuaaaaauagccuaauguaguauguuucacaaaauuggacacuguuguacuaaaacucaucuguuaagcaugaauuuuaacaaagauucaauauucugaaaaugaaaguugaaguaugguauucauuccugcacgaccacagucagaggggaguggaaaucggcauguguuaaaaguguggcagugugauuaaaugucauucucgugaggccaaguguguauauacuuuuaauguagguauuuaauaugcucaacuuucucuuuaacuuacaaaugauuauucuaucaagugucauguguauaguaacugacaaagagugacuaguaauugaucaguugaagcuuaacuucuauuguuauuugacuucguucaaauuuuacuuauggugaaguuuuucucaaaaaguauuaauaauacuuagugaagggauguguuuuguucuucccuaggaccuuagaaaucauuuguuuuggaaucagauucuucaucugccaaagaaaugcacagaugaugaugaugaugauuuuuuuuuuuuaguuuagcagcaugguuuaauuuguaugcgccuacgaaaaaucauuguaaucauuaguugaucauugcaguaguucaaauaaccugguauaaacugggcuuuuaucuagaagcuucaagcaguaacaagauuucacaaauuucauaugcugaggaaugacuccaaaauaaaccuuuuucuuaaaauuuuagaaucccaucauugauauagugcuuuuacuguuucgaagggauuuucucugugaacccugaaaacaaccccacgagguagggcagcuauuuuauuuuuacacauaagaggccaagcaugguggcucaugccuguaaucccagcgcuuugggaggcugaggcuggcaggacacccaaggucaggaguuugagaucagccuggccaacauggugaaaccccgucucuaguaaaaauacaaaaauuagccaggugugguggcgcaagccuguaaucccagcuacuccagaggcugagacaggagaaucgcuugaacccaggaggcggagguugcagugagccaagaucgcaccacugcacuccagccccggggacagagucucacucugucuccaaaaaaaaaaaucagugaaguuuagggacuuguuugaaggucaucuaguacaagcuaugcagauagcuauuauuuugguuucuagcuucaggcugucucuuuugaacuuuguauuagaaacgcagggccuuuuaauagguggaguugucucaccuucaaauucaacuacauagcuuuuucuuaaaguaguauaaugcagaaaguacucauccguaaaaacaaaaaugguuuucuuucuucccuguuaucuuugugacccacugauagcagcuggugguccuggugcggugagauuuugacucuuuuuuuuuuuuuuuuuuugagauggaguuucacucuuguugcuuaggcuggagugcaauggccaucucggcucaccucaacuuccgccuccuggguucaagcaauucuucugccucagccucccgaguaacugggauuacaggccugcaccaccacucccggcuaauuuuguauuuuuauuagagaugggguuucuccauauuggucaggcuggucucgaacuccugaccucaggugauccgccugccucggccucccagaaugcuagcauuaaaggcaugagccacuuugccuggcugauuuagacucuuaauacagacuaggaggaguccugcccucugcuuuuggucugcuugggcugccuggcucugggaaggaacuguaaagggugacucucagaagggcugagucuguugggggugcucuccccauucaucagaaagaacaucacacauaaaggacucuuauaaaucuuuacauguguuaauuuuaauccccacagcaaccugccauguuacauauuaucuuuauugucauauuaaagaggagaagagaaugaggcacagagagauuaagcgauuugccagaggugacauagcaagucacuggugagcugagauagaaaccaaggcugucuggcuccagagucagugcucuuaaccccugucugcuauguauauagucucaaacugguaaaaaagucagggcuggcaguacauuuuauuguggccgguggccaggggggagugggggcgguagucuuuugcauuuacuaacuccuuauuuagacauuacuccuccagguuuagaaaaaaaaagccauaauuuuuuaugucagcaacugcuauugauaacaacaacaguaauaauaguaguagcuaucuuuuauaagaugccaacuacaugucagucacuauauuggguguuuuuggcugcccggauuccuuucuggaauaagagcucuguagacuguuuuuaauauaguaagugacagagaaaggaggcaaaccagcuugucuacuucuuaaacuaugccuucaguauuuauuaggaaccucgauaugcuugaaguagaugauacauuuuccccagcauucagacucuugaacaacuugugaaaucuacccaagugaauuauaauuaacugcgucacauuuaucauuauacugaccuuugagcauuucccccaacucacaguauuuuguuucucaguuaugggauauucgcuugcuuugugaaaaacaugaaaauguuagcagagcucagugcuuugcccagcagauggcauuugugugaguuuuucaggauccuuuggaaucugucacuugccaauuacccaauuuguuuugaauacucuguauuuccaguuaauauugcaccauuuacauaaagagaaugugccaaaauugcuguaaucuguucuguaaucaaaucugucugcuguagauguauaauuuacuuuuguuaaguuguuuacugcaaaauggucucaagaaaauccuuuucuauucaccauaauuacuaagauauuaaucagcucucaaacauaggcuauauggggucucuuguaaggcuuguuugcuuuuaguuaaaaguaauaguuccugcuuucagaauguuuuaaugugguggugaaaaccacaagcuaauguuauauggaaugauuacuuuugugguauucccacaugccauguauuuccguguauauuuacagauacaguacacauacauaaaaugacuuacauguaauauuaaaaaaauauauagcccaggugugguggcucacgccuguaauuccaguccuuugggaggccaaaguggaaggaucauuugagcccaggaguuccagaccagccugagcaacguagacuucaucucuacaaaaaaguucaaaaaaaaaaaaaaaaaaaugccaggcguggugacaugcgcagcuacuuggaggcugaggcaggaggauugcuugagcccaggaguuugaggcuguagugagccaugaucacgucacugcauuuaagccugggugacagacagaguaagacuccgacucuucaaacaaacaaaaauauaugaagugagguuaagucagauggaauggcaguggacuacuguuuuugguuaauaaaucgagauacccuuaagaguuguguucugaacauacugucuuuuuuuccccaguuccaugucacagcaccugccuaauaauaggugcucgaaaaacaucuguugaaugaaaugaauucuuuuguuugcaguagggcaaagaaggguagagagaagcagcuagcacaagcugauauguuaaauguugcaaaagguuuuaggccaagaaaauuccagaaacccauugaagaggcaauacauguuuaguggaacuaugagauguuuucacaaccuuggaaauaauuuaaaaguaacuuucuacuguuuuacuuauuucccacuccuggcugccccucuuggguggacugccuccuguuggagggaauacugugugagacacaucuuuaguaaaacagaaaugugaaaccaacuugcagaaaucacaagcacacuguuaccaaauagucuugacuggcucccuuccuggaggacaaauguuuugauaaugucugucaguagauucaguuccccuauuucuuuuuaagacuugauauuuaguaauacuguuucuuuuuugccagcaucgcagugaaguuuuucuuuaacuuuuggggaaaaacaaaacaaaacaaaacaaaaaaaacuaaaguauuuuugaaaucugugcaugguuacuuuugacauucauacuccaaaagcagagacuaagacuaaagaguuaacaggugaaauuggccaauaucuucaaaguauucacuuuuuguuuucuuuuaaucuaaaauuagccucauguuugagguguagaggguagccaaaucucaggauaaaaucucuccaccaccuaagauaagaguaaguccagucaugacaauaauuaagcugaguugcuagaaugacauuaucuccuaaugucugaaacaaucaggucucuuuaugaggacaucuguaauucaagauccauggugucuguuaaacaucauccagcaaugucagcugagcuguugaaaaauccuguaggaagagcagguagguugaagguccuauccagggaggucacuucaguaagugcuuucagucugauuuuagcaaacauugaagucuucaguaugacuccuuggaaggaggcccauuaaggugauccacaaauuagguuacuggcauccccuuucuuuauaccaauacuauucauacuaaaauguaaucuccaucagggcaggauuauguauuguuuuauugacugucauaucccuaguuccuugcacagugccuagcagguaucauuuguuucauaaauauuuguugaauuaaugagugaaugacugguuuuguauuaacguagaaucguaagacauucuuaguguuguuaaggccuuugaacuuucuuuucuuuagaacuaagaagugugcuaggugugagcucauaauccaaguuuuguuaguagcugcuguguuucugcuguuuuauuuuuaacauauaaagaauaguaucccagaagacucuggagcucccgaaaguugggcaggugucuuaauuuacucauuaggauaagcuacuaguugaggaaguuauucaauaccauuuucccaggaagaggcagcucagaggaugaagugaacacuuuucauauucuucuccaaaaugugaguaggugaggauuaauucaguuauuuguggggucuugaaagcacugaaaggagauucagcacuagggacaaugugacaaaucaguugguaguacauuugucuaauuuuuaacuuugccuuggaucaggcaggaccuguagaccugauaaucuuuagggcuuuugaaugcauauauaugagauauauagauagauauauagauauagauauagauaucucauaugugugugugugugugugagagaguguguauuugugguucaggggacauauaaucugugaagcggucagcucauggaaccaggacacaguaaauugaaguaaagaaagagagacagggagaacagaaguaugaaacauuuuaaucccaugggaaugaaguagagugugagaacauuuauuguuaaggugucacgccuaaacaagugcuuauuaaaauuuuuagucagagagguuuuuaaaugauuuuguaagacaguuucccuaaccacaccguguuuuuccucuugccucagcuguuccaaagaccuaaugcgcuugcuguccagcaguugacagcugcucagcagcagcaguaugcacuggcagcugcucaucagccgcacaucgguaaguccuuaagcccauagcucuuucaugauagguguggccgccauuuuaggauaacugguugcugugaaacccaguaauuuaaacugauuauaaaaguucagacaaaucccucagacagaguaaguggccucuuccuuuuguccaguugucuccagccacauuaguuuugacauagcuuguagacccgcaucauaacauuucuucaguguucagccauugcccuaccucagauguuucaggauuuaaaguauuuaucagaguaaugacuggugacuaccauuagcucuuucgguaagauuuggaugacauugauuacauaaguugugguucuauagacuaauauaucagcuucuuauuuugugaacaaacaguauaaauccauuuuccaguaaguaugcauugaaaaaauuuaaaaguauucucauauaauuaccgauuuuaaaguagcuuugcccuuuuccuuuagcaguuguuaaaguuuugagcgauguauucaucguacugccuagacguuucuucccccuggaccuucuuaaggucucuuagagugcauuaaguauaaacaaguagaaguagaauuuuuuuuuuuaaugugucaaaauggcaugauugaguagaaaggagauagcuaaucuuggaugugauaggcuauagaagaauauacuuacuuccaaccuaaauaaauaaaggccaggcauaaaguccuugggucugauaauguauaguuguagaugguaaucuuuauaaauacccauacauuuuauuucaugaaaacuguuuggaaaauuguuuuaaauagaaauaaauacuucaucccauuuuaauauuagucuuuaaaauuguucuauuguaggcuguuacaauuuuaauaaucuuuuagaaaugcugaauuuauaacuauauacaguuuuaaguuaaauauuucuuuagcaaagguaaaauuugacuauauaaacauuucauuauaaucuuuaguauagcaguuaucuuuuuaaaauuucucuuuacccucaaccugucccgucuucucuuuuuucauuuuuuccuuaucuacugucuggagugaauagcgaaacuguguagguauuugauagggcugcaguuuuagucaaguuuguuuuuacugacagguauguuuucagcagguuuagcucccgcugcguuuguccccaauccauacaucaucagcgcugcucccccagggacggaccccuacacagcuggauuggcugcagcagcgacacuaggugagacauucugcugcaugagggauuuucucaccugcugaaaagucauuugagaugggcgugcauucuuuauacucuuucccaaauccaugucuccaguggagauuauccagauuuucaaugccaucuaccugccagcuuaauaucucuccguagcuguaucauaggccccucagacuugaaaauguucaaaggcaaauuaaucacauacgccuugcauauguguuuuugauccauggagccaccagauacucauuuauauuuugggaauuuccccccuugcccagaucuccuaccaccucuagucuaucauauaguucagguacuuuuacuggucucuaauguauuuauaauuuccuugccucucucaccuccucuuccccucuaaauuguucaagaaaaugauuucaaacuuagaucuuaccucuucaucuuucugcuuaaaccuuuuauugauuucccuuuuuucuacccuaguaugucauacuacaguuauuaccaaacauggcugaucauuacaacuuacuuggagucgggguggggguggugguguuuuguuccuuggaaucaguauuuuuaaggagcuuccagauaauucuguggguuagcuaggguugggacccacaguauauagggcucuaucaccaugccucauacauacaggucucuacauauguaccacccaauucccuuccuaguugacugccauuggcuaacaccauacauuguagcaguacagaucugauuuuaguuugcugcagauacugcauugguuuaggccccugucuuuggucacuguggucuucuguaguaagcucuuuuucccauucuuugccugugaagugcccuaguuggcuaauuacugcacuguuuuuauuugcuugugggauguauacaugaguuuuuuccccucuuuuuuuuuuucucuuucuuucucucucucucuuuuuuuuuuuuggagacaggaucucacucuguugccgaggaugggaugcaguggcgugaauacaguucacuguaaccuugaauuccugggcccacuggauucuccugcgucagccuccugaguagcuagggcuacugugcaucaccacacuuagcuaauuguuaaauuuuuggagagaugggguggucucgccagcguugccuaggcugguguugugucaaauucucgggcucaagcaguccuccucccuuggccucccaaagugcuggcauuccaggcaugagccacugugcccagccuaugaguguuuuuuucuuucccuugagacuagauuuuuaaaagacaggcaucuuuguuauuugacuguguguugcacaguuaccgucaccgugaugggaccauaaauguaugauggguugaauucaacauuaggacaaacaaaaugucuuccaguuuagauauucacugggggaagaucccuccaagucaaguucaucaugacuaaauauuacuucgaaauuuuacuacuuauuauguaacauguaauuugcaauuaugaacuuaaauguagccuagcauuucuuagauuuuuuaaaaaauuguuuacauuuuggcaugguuaugaugggaagauaguuaacauagggucaucuggcuguccguggucaucccccuuuugggggaaaacagaaagcucuucguaggagaaugaucucugcuaaccaucauuaauauuuauugagcacuuaacuuuugucaggcauuguccugaaugcuuuucuuucauaugauuuuucagaugaugauuuuagagauuagaaauuuguggcucagacagcugccuuauuuguuguuuuuuguuuuuuugagacugagucuugcucucucgcccaggcuggaguucaguggugcgaucucggcucacugcagucucugccucuuggguucaagugauugauucuccuaccucaaccuccugaauaacugggacuacaggcacccaccaccacgccuggcuaauuuuuguauuuuuaguagagaugggguuuugccauguuugccaggcuggucucaaacuccugacuuaaagugauccacccuccuuggccucccagagugcugggauuacaguugugagccacugcgcccaaccuagagagaacugucucauuugaagucacacaauuuaaauguuguagaguugggguuugaaccagguuuaacuccaaagcucaugcguaugcuucacuauaguauauagaaugccugugcugucugucuugaauugucuuuucuguacuuucuuuagaagucuuuacuaauuuauguuacuugaaacaaagaacuggucuuaggguugacacugcugcugucacugagaugguaguucggugaucagaaucuuguuuuuuguauaugucaguugagccagggugaaaaugaguuaauacuuucacaaauaacaggaaauguuaacuguuaaaacuaugaaaauguguauucuuugagggugucagucacacaggaauugaagugggcauccugaugugccaagcucaguugauuugcccugggauguuuuccuaaauuuaaccuuaggccaugugaccagcguauaguaguagaaaugccaguugagaaaauuuagagaguaaugcagauguuaaugguaauagcaguccuugcccaguagaggcucgcuuuuguuggcuuuugggagagcguugggacuauuauugcagguugcaaccacucauucaagguagauacggcuguacucccaacauguauuacagguugagcaucccuaaucugaaaauucaaaaucuuuuugaguaguaacaugacaccauaaguggaaaauuccacacuugaccuugaucucaugugaugggucauagucaaaaccacaggcacauaacacacaguucaucuauucagcauccccaaaggaaaaguaaaauuacccccaggcuauguguauaaggcauauaugaaacguaaaugaacuuuguguuuagacuugggucacauccccaagauaacucuuggacacacacauagucuacaaucugaaaucgguaacacuucuggucucaagcacucugguuaaggaacacucuaccuguuuacccauuuuuacaggugaggaaacuaaggcacaguuagggucuuuuuuguguguuuuuucucuuauuuauuucuuuaacugcccaagaccacccugcuuuauaaacacuaaucaaaugaguaugaggcucuaucacucuuuuuuuuuuuuuuaaacuugaauacauggcuuuuaggccguucaguuucugacaaauuaaaaaauguuuuaaccccuuuucuucuuauaguaaaauaguucauaguguaacagcuuuucuuagcaacaccuuuauucuguacccagguauaguguuucagugugcacccuugcuuguaaacagcuucuuaaucuuuucuaagcccacagguauagaaaacaccaaauuagaaaugucaaaacauauuuauauugggcagugguacaauuugacuuauuuguguuuuggaagcuuaaaaugggggaaacaagaauaugugucuauuuauuuuggcuuaaugaauuauguguuucuccagaauuagcuguagcaucagaguagcuguaauauuugaaacagcucuucagaacuucagucaguguaaggaagguuugguuacuguuaaugaaucaaguuggaaauauuuaacucucugcuuuaaggaaguucaacuuggagauauguuucagcagauuugaagaauugacuuugagcccauuuccugguuagcaaaugugucuuugguguuucuugcuaccagcuucgucauagaauucuauaauuagauuucugccacacuuggguugauaucugcauaauuuuguuauaucucuguuguguacuuuauguggccgacugcagcuguacuuuguugccaaggaaaaugaacagauaauuuggauuaaagcagaaugcuuaauuuuuuuuuuuuuuuuuggagacacacucuuugcucuguugcccaggcuggagugcagugguacaaucuuggcucacuguaaccucugccuccuggguucaagcaguucuccugccucagccuuccgaguagcugggauuacaggcaucugccaccacguccggcuaauuuuuuauauauuuuuuuaguagagaugggguuucaccauguuggccaggcuggucucgaacuccugaccucaaagugauccacccaacuuggccucccguaaugcugggguuacagagaaugcuuaauuuuguuuaagguucucaacaggucuguaacaagucaagguguuguauuuuuuguuucuauuuguguucaacguugacuuaaauuuaaaauuucacauaucagugucugaauguaguuguguugaaugccuuugugacuuuaaaaauagaaauaggggccaggccugguggcucaagccuaaagucccagcaauaugggaggccaaggcagauggaucgcuugagcccaggaguuugacaccagccuggggcaacacagaccucuaccaaaaaaaaaaaaaaaaaaaaaaaaauuagucagguauaguggcaugcaucuguaaucccagguauuagggaggcugaggugggaggaucacuuaagccggggaggucaggguugcagugagcugagauugccucauugcauuccagccugggugacagagagacccugucucaaaaaacaaaaaaacaaaaaaaacaaacaguaacagcaacuuugaaguugcaguggagguucaguugagugucuagguuuuguugucagacugauagauguucuuuuucuggaguuaaugaaacaacagcacuccguuaaaucaccuuaggugccauucuuaucauugaacauaggauacauccuaaccuuuuguucuauuccaucacuuuaagcacgcaaacccuccauuuacucccuucuaccaacagauauugucucuaugcuacauccuccaucuguuauuaaauugaaccccuucuaucagugauucccccuuuuaguuuucuaauguuucauuccccacugcuucuuccucuaggccuggauuauauuagaagacugguguaaggaucucauauaauguuuacuauucuuuaaaaagaguuaaugauuagcuagcauaaauuaauauauacuuuuaaguuaauauuuuacaguaggaucuauugagucagauguaauuuuggaaaggcugagaugagccucaguaguucagacuuucuuuaccuuucuuuugcuauuuuuaggcccagcuguggucccucaccaguauuauggaguuacucccuggggagucuacccugccagucuuuuccagcagcaagcugccgcugccgcugcagcaacuaauucagcuaaucaacagaccaccccacaggcucagcaaggacagcagcagguaaauguagacaaaauuuaccucuucuaagugggaaucguaguauuguggauaauuaauagguaauauugcgccuaauagaaaaacacugugaaugcaugaauuuccucuuguguguauauaugugugucugaguucaggcucagauuuaacuacucuuacggaaugucuuuuauauauuagacacuauuguaccuaggugggguaacgauacuaaccaguucaccuauagggaaauugcuuagcugcaaguggcaaaguggaucuucaaaguuacaguaaaauuuuguucugccauacuguaguugcuugcuaagcaccacuuucagaucauuucaggguuuugcaaggggcuugacacuaaagcagggguacuagauuuuuagacugcuuauuuguaguaccuauuggauuggauuggauguaaaucuuaaacuaucauaucugcauuagcuuuuuauuugaguugagaaaggacgguaaacugcaaaacuacaucuuuuauuuuuuuaaacaggucauuuccuccuugauugcuagaauaacaccuuuuuuuuuuuuuugagauggagucuagcucugucgcccaggcuggaaugccguggugcaaucucagcucacugcaaucuccgcaucccggauucaagcaguucuccugccuuagccuccugaguagcugggauuacaggcacgcuacaccaugcccagcuaauuuuuguauuuuuaguagaaaugggguuucaccauguuggucaggcuugucucaaacuccugaccucgugauccacccgccucggccucccaaagugcugggauuacaggcgugaccaccgugccuggccaauaacaccucuuuauugauagaaacugugguaaacuagaaaacuugaaaaaaaaaauuacccuaaauccuuaugucagaaaaccaaugcuauuauguuugguaucuguuauuuuagccuuauuauuuaauauuuuacaaaauugucauuauuguguccacgugguuuuacauucugauuucauacuuuacuguguuauuuaguguucuuuuaaaugacauuuuuacuagguacauuuaaauccaccaaacgauacuuuauuuugacuagucuauuauauuugauauuucauuuguaucaguauuuugguguuuuaaaugagauugauuaacauccuuuacauaaguuuauccuuggaaaaaauuccuaguaauggaguuuuucuggagcaaauaaaaucagcacuuaggcuucgauacgcauugucagauaaaagcugucauuugagacaaaacacccugcucauauaugaauauauuaaaugauccaaacaagaauuuuuugcuugacaucagucuuacucagaggguguauguuuaauuuuuuuuuuuuuuuuagauuccacacaauuacagaaaaaaaaaacaggucuugaaauuccccccguuauuuggacacuauuaaaugauuuucuuggcaacagauacaguucuuguaccauauauauaaggaaauucaguaaauaauuuguugacagaaugagugaucuguuaaaauaaauuuguuuugagacggaauuuugcuuuuguugcccaggcuggagugcaauggugcaaucuuggcucacugcaaccucugccuccaggguucaagcgauucuccugccucagccucccaaguagcugggauuacaggcccccaccaccacgccuggcuaauuuuugucuuuuuaguagagacgggguuucaccacauuggccaggcuggucucgaacuccugaccucaggugauccacccgucucggccucccaaagugcugugauuguaggccugagccaccacgccuggccaaauuucuuuuuuuguuuguuuuuuuugagauggagucuaguucuauugcccaggcuggagugcagugagcucuuggcucgcugcaaccucugccuccuggguucaagugauucuucugccucagccuccugaguagcugggauuacaggugugugccgccacaccuggcuaauuuuuguauuuuuaguagagaugggauuucaccaugguggccagacugaucucgaacucuugaccuucagugauccaccccccucggccucccaaagugcugggauugcaggcaugagucacugugccuggccuauuaaauaaauuaauuucucuucucuucucuucucuucucuucccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuccccuucccuucccuucccuucuuuucuuuucuuucugacauaaucuugcucugucuuccagccuggagugcaguggcgccaaguuugcucacugcaaccuucgccucccagguucaagcaauucucgugccucagccucccuaguagcugggauuacaggcacgugccaccauaccuggcuaguuuuuguauuuuugguagugacaggguuuuaccauguuguccaggcugaucucgaacuccugaccuccaguguuccacccaccuuggccucccagagugcuggguuacaggugugaaccacugcaccuagcaaauaaauuucuuaauaacugcucuuuguggauaagucuguauuuauuugugugaucaucuuuuuguuuaaauggcugccaaauuauuaugcauuuggaagacuaaaguaauuaccauguuuuaaaauuaggucuaauacagugaacaagaauaauacuaauugcuguuuauugaaagcuuucugugcagaguuaagugcuguacauguaauuucuauuucucuuauuaugauaguuguacaacuucuuguuuuaugaaauagaauuucauaauugagaggaaaucgauugaggaaauacaauuugugugcccagggucacacaaauacaaaguuguuaagauuugaacauaagccucugucuugacaacuuuucuucugaccauauugugaugucuugacuuaaagaaaaucugagaucuuguguuucuucugccguuaacuagcuuacaacuagggcaaguuggauggcuucucuaaaugcauauauuuuuguuauaaaauggacauaauaaucauuaacuuuucaguuuucugucauucccuacagguucugucaaacccuacuaagaaguuuuuagcauuaguuuuuaauuagcagccauuguuuuaguuccuuuuuuuugggugccaguuucugauuuuaaguauuugaggaaaauaugauuuuuuugguaaacugccuugucauaguaauuaaaaugagagguucuuuuuaaacuuugcuguuggccuuuugggcccuuguauuuuaucagaaaguauauguugcguucuagucaagcugacuguucuaggauaguuuuuauaaauucagucauuuugugauuuauuagacuuuaaaauguuacuugugaaacuguauauuuuguuuccauaaaaucauggauuugacagcuauugaugaaaugaaaauauaugaauuuuggcagauaacugaaggacuuuuauuuguaguuagggguacuggacagauuucuagagaguggacaaaaagcuaacacuguuuuccuuccuuauuacaagacucaucaauagucuuagacuaccucuuuagguaccuuguccacucuaccacaccugcccuuucacagaacaccuaaucaaacauaaaccuacuucuuuauauucugugaaagcaaugcuuucauuguuuuuuaaaaucuucagcaauuuugaacuauuagcauuugccauauuucugugcuugcuauuuacuuauccuagagugagaucucuucugaguuauuggguauguaaauucuaaguauuuggcaaaaaugcuugcuauuuacuuauccuagagugagaucucuuuugaguuauuggguauguaaauucuaaguauuugguaaaacucaccuguacagccccccgacucuucuaucuacguaguuugaaacacacuuucucuuacaaaguugguuagguucuuuaggucagaaacaaauuauauaauaucuugauaauagugauuugcuauugguuauugaugaucuccuggguaucaggcaguguggcuuaaacacauuauuugagauauuuccagcaaaucugcaagaucauuuguuaauucuuacuuauuacugauauagaaguaaaagauugggcaaauuaaguguccacacaucccuucuugccaguguggacaguguuggucaccuuauacucacuuaacaaauauuuaauugguuauuaguguugcuucucuuuuuacauuuuuuuuuuaccacugguaccaagaauaauuuguacccauuuucuugaccauaugucuaacuuuuauaaauaacacagugaaauugaaagugaucugauaagaacuguacacuugacaauaugacaaaacacauuguuaggaacuguaguaauuuuagccuugguuuguggguuuugcauuuuugcuugcuggaguguguagaucuugugagauagauucuucacaucauucagaauaauaaugauugcuagcauuuugaugucuguguuucauuaauaaaaaguagauccuugacugggcucaguggcuucacacuuguaaucccaacacuuuggcaggccaaggcagguggauugcuugugcccaggaguuagagauuagccugaacaacauggugagacccugucucuacaaaaaauagaaaaauuagccaggugugguggugcauaccuguaguaccagcuacucaggagaggugggagcaucucuucagccugggaugcagggguuacagugagcugagacugugccacacuacacuccagccugagcagcagagcauggcccugucucuucccugcacuccgcgccacccgccgcccaccaaaaaaaaaaaaguagauccuuuaucagaguggcauaacugguauucugcacugaacuugacuaaugcguauguuuguggaauuucugagagggaaauagaaauagucaggugagagcccuaccaaaucgaaucuggugaacucauuuggggccauguggaccuugauaaauauauuaguguuaaagaggaaauauucucauuccaucuuuugugugcaugugagacucaguugacuuuaaauguguggguaaauuaccccuguucaucuugucuggaaccccucccaacccccauuaauacucuuuuuuuuucuuuuuuuuuuuuuuuuuuuuguguguguguuuugaaauggaguuuugcucuuuuucccaggcuggagcgaagugucucgaucucagcucacugcaaccuccgccucccagguucaagugauucuccugccucauccucucucguagcugggauuauaggcaccugcugccacgccuggcuaauuuuuguaguuuuaguagagacgggguuuugccauguuggccaggcuggucucgaacuccugaccucugauaauccaccugccucggccucccaaagugcuaggauuacaggcgugagccaccacgccuggccuguuacacucuuuuuuuuucuucacccacuuuuugucagagcacugacauuauauaguaugguuuauugucugucucauucguuaaaauaaaagcuccaugaggacaggggcuuugucggucuuguucauugcucugucucacuugcccauuugccacaugguaggcauuaaauauuugauaacacuaccacuugcugaugccagauauuccaaauucaucuuuuaacuuaauugucacaagaacuuuaugaggcagaugagauaaaauguuugaaugaaugaaucaucacuuuugugugcuuuuugcugcuuauagagauaauguguuuaaaguaagaaugguagaaugaaauuccacucuaugaaauguuauuaauugaauuuauacgcuaacagcugugacauauaaaaaccauuauagggaaacaauuuacaauuaaguuuuaaaaguugacccaaccugagcauaggguaggucuucuccaaugaaaagaaagugguugaguuauuucugucuuccuuucccagguucuccguggaggagccagccaacguccuuugaccccaaaccagaaccagcagggacagcaaacggauccccuuguggcagcugcagcagugaauucugcccuugcauuuggacaaggucuggcagcaggcaugccaggugcggcugcauuguuauuccuaauacuuuggcagggaaaaaggcugcacguuugaggugauuacagaggggaaugagcagugcuuucaccuugcuuaggcuugucaugauuuggggacuggcaaggaugauacacacuugcccucacuuagacuauaguucacugaugagagcauuguucugagccagucuuaagucauauuggagguaucuaaauguccaugcagcuuggaauaugugguuuuuccuugguggauuaucuguuuucuguuucagaaucagggauagauggaguggccaagcuaguuuacaaggcuuagucuuuauguugauguuuuugaacagcaugauuagugagaaauuucugguauaccuugauagggucaucccuuacguuuuuaagguuucucuuaaaccaauaguagggguccuuuuuagcugucuaccucugagauacauguuuauauagauacaucuugaauauauguuguuuuugguucacugucagcugguuuggugcuuugcaugggauuagauguacuuugauguucuacaugugaaacaagucuuugagagaugucagcguauuuuuauggaccuuuacugaucauagagcauagccaauuuaacugagccauuuaugaauucaauaaauaacuuuaaccuguuucauuuguuuuuuaguuacugagccuuuguguguucuuaggaagucaccugcaguuuuucauauggcuuaaacugggauuuggagauucuaucucacauaauauugaaagaucauguuauuuaaagccuaucuagguuuuuccugcuauuuugcaggauauuuguucuuaaauuauuauguaguaugaaaguacuaugauuuuuauaaucauuuguagccucuguuuauucaacuauuuaagugauggagccaguauauaaaucuggccaauucaaccucaaagcugaguuugugauuauugacaauauguuggugcccaggagauacuuguuuguuuaacauauacauuucuuuguuggcuugauauuccuagguuauccgguguuggcuccugcugcuuacuaugaccaaacuggugcccuuguagugaaugcaggcgcgagaaauggucuuggagcuccuguucgacuuguagcuccugccccagucaucauuaguuccucagcugcacaagcaggugagcgcacaucugaguggacuccugccagagaucuaaaaguggcgacugauagugagauucuuaaaguauguugaaauaaacuuuuggcaauucucaguauaucgguucuacccuguaauguuucaaaaagagaucagaagcaauaagugaccuuaguggauucuccuuuuuguugggggguugguggguugggggagggguggcaugugccagcugguuagaagcaaggucugaaggucuggcuccacugagaacauagaaguugcauuacucacacaaaauggcuuuguuggcagaaauccaagucauuauuuuaagauaauuuuagaggagggguuguuuuuugccacaggggcaggaguggaggacgugggaaagaguagugagaagugacaaaauaauacauuugguugggaggaguaauaguuuuuuacuuuaaguguuuauauuuauuuauuuuuuaauuaagaacaauaacaggaacaucuagaagacagcagugugcuaaaauaggaauuugaaggauguguaugugcauuacaugguucuagaagaaacccucaacauagauauuuauggaauuuaagauuuuaggaaguaguuguauuuaauggauacauuugauguuuauaccccuuuuaaucuguauacucuuaaaagcaaccagcauagugaacuuguucuagugguauuuugaguucaaauugaaaguagaaacagaaaauagaagcuucauaugaagggaucaaagacagauuuguaugguuugugucuguuuugaaaagauaggcagcauuaaaagauuuuuugaaaaaagauaaaaauguaguuuggaaauguggccagucccuuucauagccaaacgguuugcuuucuucuucauagcuguugcagcagccgcagcuucagcaaauggagcagcugguggucuugcuggaacaacaaauggaccauuucgcccuuuaggaacacagcagccucagccccagccccagcagcagcccaauaacaaccuggcauccaguucuuucuacggcaacaacucucugaacagcaauucacagagcagcucccucuucucccagggcucugcccagccugccaacacauccuugggauucggaaguagcaguucucucggcgccacccugggauccgcccuuggaggguuuggaacagcagguagaaauuagacugauaugcucuuaagacugaauuuuaauuauuuuuacaauccuucuggaauacuggcaaugcauggaaccacaggcagaucuggaccaagccuugugggaauccagccaucccacauaaucugugagaugauagacuauugaaaucaaguuauacagaugggaccuauuucaauccaugcucauguggcuacuuacuuaaucaguuucuuucagggauuugaaaucuagggaagauuuuugcuguauuugggaaaaauauugagggaacuguagaaauugauaucaaaaacugagggaggaggacuuacuaaagauagcagagcugaaauacuccacaauugagacugagccgaguucuuggccugcaggccuuaaagaguuacaaguuuucuucagucuuuugaguagaauuuaagguagacauguggaaaauuaggaggaaggauauuagaccaagauauuuuuaauguuuugaugaaaaaagcaggaguguaguauggugaauaaugggauaauugcagagauuauaaaaaacaaacaaacaaaagugaucccuaaauagaagggcaugugugaaagaaaguaucuuaauuggaauugagggcagcauuaacucucgauugaacccacugagaaaacaggcuuucauauagaagucuuguguaguggggcaguaccccauuuacaaaucuuuuuucuguaucccauuuuucuacuugaaccuuuucaauugaugaaaggcauucuucuaguccauuuucuuccaccuuuuccauaguucauguggccgucagagcuuuuuaacccucccuuauccuauaauauacgacaccauaggaagguaaauuuggcauauguuugauggucauguuaaccugagccauguccucuuuauuacuuaucugccccuaguacugcuacauuaacaguuaggcugucucugcugacaaauuugcggugguaaggagucuggaucaaaguguuaggaacaggucacugggcuuguucuucgaagaacaggccuguucuuaucugcauuguuuuaauuccauuuuaguugcaaacuccaacacuggcaguggcucccgccgugacucccugacuggcagcagugaccuuuauaagaggacaucgagcagcuugacccccauuggacacaguuuuuauaacggccuuagcuuuuccuccucuccuggacccgugggcaugccucucccuagucagggaccaggacauucacagacaccaccuccuucccucucuucacauggauccucuucaagcuuaaaccuggguaagaaccauuacucuaacaccaccuugaacucuagaacucucuugccaccgaugacauuacaagaacuuugcauaagcaaaggacagucccuuuauacuagaaguguccuggguguucugugccuuccguaaauaccucauguuauucaggcuguaccuauagauaguauagcaguuuuggcuuuauuauaguuuggguacauucccuguauauucaguuagcuuuaguaugaacauuuuauucuuuggcuaccugugagaguauuucaauguaaacaauauaaacacagguucauuucagugaagcuaggaaacacagagacagaauuuaaucaccuaguaucaccaccugaaauaccaccacaauuaauauuuugccuuauuuccuuucaaaauuuccccucugcuauauguacauauaauaucuugcuuuuucacaaaaagcauuuuauuuuuaaaauuuugccauauuuuaaaauauuuguaaauauaaacucucaaaccauauaguauguuaaugaggagauguauauuucccuauuaaauauuuagauuguuuuaugcaugggauuuuaaaauauuaccaucuagauucuagaaaauagggagagaaaaagaggaucccaagcagcaggcuauaagaaugaaaagaaaauuauauuaccuuuuuuuugguggcaaaucucuaaaucuuucaggacaugggagauguuuucuuaucucaagcauggugcauacuccucucccgcaguuauguauuaaguuuaaaguacugauuuauuugcuagauggggaaaauugaaugcuagauguagagucaccauauaauguaucaugcaaaccagaacacuuuugugaguggaagggggugcuaugaauaauuacuuggugaugauaggccuaaaucaggacuguccugggcaaaucagcacauguggccacuuuaccaagaagauucuguucuuaaccagcaagauuaaaaguggcuucauggacucagaagugagaacuugacuaaaaacaaacaggaugccuucguuuggauaggcagacuagaaagugauuuauaagauucaagagaagucugaaguggguaggguaauagacuuauuauucuagaccuaggagugauagcuuugaguuugaaagaggcgaguuucaagucaaaacuauguuuauauauacacauuggcaugugugugcguauccugaaguuuuauacaguaagaacuuuaguuguagaacucauuuucucagguuauauaugaacaucacuuuauaaaaguuacugugacauuccugauuaguagguccauaauagguagacagggggaugggguacauugcacaacaguguuuccuagugacacaaugccuggcuuuaaacacuggggguuaaugcagaaucuggagagagcugucaaacucccaguuugauacguggcuagaaggaaggaaguaauguucacugaccuggcauuuaccugcugguguuaaugguuuuggguccuguacauacaacacuggaagguauagguauuauuucgugucucaggacuuaaauaucuugccuagccugugucaucucagauuugaacagauuuagaaucaagccuuuucgacuccaaagcaugcaguuucaguguauauccuguuacaugauguacucaggauaucuugaaccaguccauuaccaaauccagaaauauguaucuuuuaauuucuugguuuaaaaacaugugaacuaugucaucccauacuacauacuaaauaaacugaaccugcuaaguuuuuuuuucauaaagagccagauaguaaauguuuuagguuuuauaggccagauggugucuguagugaauauuuaacucugcuguugaagugugaaagcaaccacagacaaaauguaaaugagugaauacguagcuaucuucuaauaaaaccuuauuuauaaaaauagaugggccaggcaugauggcucacaucuguaaucccagcacuuugggaggccgaggugggcagaucacuugaggucaggaguucaagaccagucuggccaacauagugaagccccgccucuaccaaaaaauacaaaaauuagccaggcaugguggcgugugccuguagucccagcugcuugggaggcugaggugggagaauugcuugaaccugggagacaggcugcagugagcugagaucgugccacugcgcuccagccugagcaacagaguaagacccugucucaaaacaaaauaagauaaaauaaaauaaaaagcugugguuccuuggugcguggaaauggagccagaaauacuacuuucaugcaugauaccuuuccucuuucuaaagcaucagcaauuuaauguaauacuaccucuuaauuuuuguuuucccugugaagaaggaaauaacuauuagugugaguuauuucuugucaaaugacuuguugccugccuaguuuuauguuuaacauaacuucucuuuggaaacauucaccuuguucaagcaguuuuuuaguguacauuugcacuggacuucuguuguguguagugcauguuucguacaugccauuccugaggaacucuuugucucaguacagcuuugccucagcucagucuguuuccucgagaaaguagaggugugcuacuugguuucuaacaaucuccauacaaaggccuuaaagacauuuuaguauaagaaacauaacauuucuuucuggcccacaccuaauauagcuucuguuguuaauacuacuucacugcugccaccagccaucagcagugaugagcagccauacuaagcauuuuauauucauuguguugaauacucaaaagaacccuucaccccuuaaaauucagcguggcuuaauuaauauugcuaaugauaucgaccacaaaacuaguguuugaaugcgcacaucagccuauaucucguguggaucuuuuccccaucuugucuuuuuuacacuuugucccaggaggcagauauguguuaguaucuuuuaacaaaaucagugaccuguuuaguaauuuuuccuauuauuuuuuuaaaaaucacuuauugaguggcaugguuuuucauuacugauuguuuaaaguucagacuaaaaacaaaccuuuuugaguucuauucccccccguuuuuauuguuugggacagggucuugcucuguugcccagacuggaaugcaguggugcuaucauagcucacuguaaccucaaacuccugggcucaaaggaucuuuccaccccagcuucccaaguagcugguacuguaagcacacaccaccacacccagcuaauuaaaauaauuuuuuuuuuuuuuuuuuuguagaaacuaagucuugcuauguuggucaggguggucucgaacuccgggccuccagugauccucuugccuuggccucucaaagcacuaggauuacagaugugagcuacuauuccuggcuccuuuuuuucuuuauuuuauuuuauuuauuuuuuugagauagaguuucacucuguggcccugguuggaaugcaguggcgugaucucggcccacuccaacuucugccucccgguucaagugauucuccugccucagccucccaaguagcugggauuacaggcacgugccaccaugcccagcuaauuuuuuauuuuuaguagagaugguguuuuaccauguuggccaggcuggucccuuuuuuuuuucauuuuuaaaauguugucuuuuaaaaugcacuaguuuuuuauuuugaugagguccaguuuaucuugguuuuggaauaguaucgaagaaaucuuugccuaacucaaacucuugggggaauauuuucucauguuuugcucuaaaaaaauuuauuguuuuaucucuuaaauauaagucugugauccauuuugaguuaauuuugggugucaggucaggguucaucuuuuugcacaugcauuucuaguuguccuagcaccauuuuccuuuguaauuuuggugugcaggucuugcacugcuucuguuaaauuuauuccuaacuggauauauuuuugaugcuauuacaaauagaauuauguuccgguuuuaucuuuugauagacuauugcuugcuuauggaaauacaauugguuuuuguauauugaucuuauauacuguggccucgcuguaguuguuuauuaguaguucuaaugguuuuuggguggauucuguaggauuuucuacauauaagaucauaucaucuuaagaauaaaagccauuucccaaucuggaugacuuuucuuuuucuugucugauugcacuguguagaaccuccaggacagauugagaaucccaagucaaaaaucugaaaugcugcaaaacccaaaacauuuuugagcaucaacaaagucuuuguugaaaguuaacaaagcucaaaggaaaugcucauuggagcauuuagaauuuuugauuuucauauuaggaugcucagcugguagauauaauucacguauuccaaaaucugaaagacuuugaaaucugaaacacuucuggucccaaguacuuuggauaaaggguacucaaccuggacuguguuaaauggaagaaauaagagcacacaucuuucccuuguuccugaucuuggcaggggguggagguaaaguguuugucuuuuaccauuaagcauaaucacaguugguuuuuaguagaugcccuuuauuagguugagaaaguuuccuucuagccuaaguuuauugagaguuuuuguugcaaauggguuuuaguuuuugucaaguguuuuuuaugcccuuuuuuuuuuuuuugagcuggagucuuggucugucucccaggguggagugcaauggugcaaucucggcucacugcaaccucugcccccuggguucacaccauucuccugccucagcuucccaaguagcugggacuauaggcgcccaccaccacgcccggcuaauuuuuuguauuuuuuguagagaugggguuucacagugucagccaggauggucucgaucuccugaccucaugaucugccugccuuggccucccaaaguguugggauuacaggugugagccaucucgcccggccauuuuuucugcauuaauugacgaucauguggcuuuuauccuguauuccgugaaugugguauguuacauuaauugauuuucagauauuaauccaauccugcauuccagauauacaucuuaacugaccaucauguggcuuuuaucuuguauucugugaaugugguauguuacauuaauugauuuucagauauuaauccaacugcauuccagauauacaucuuacuuuggucauguucgauuugguguguuuguauuuuuguugaggauuuuugaaucuguauuaaugaaggauguguguuuuucuuucucgugagguguguguuguggcuuggugucagggugauacugaccucauagcaugaaauucgaaguguaccaucccucucuguuuucuggaagaguuuguggaguacuagcauuauuucuuuaaacauuugauaaacuugaccagguaagccagucuuagccugggcauuuauuuguaguaagauuuuuacuuaacccauuucuuuacaucuuauaggucuuauagguucagauuuuuauuucuucuugagucaguuuugauaauuugugaccuucuaggaauuuguccauuucaucuaaaaugccaaauuuguuagcauaaaauguacuauuuuaauaagugaaaucucucucucaaucuuccucucccaucuuccccauacaugcauauauacccaugaauguguacauauaaaauauguugugacccugaacaaggcagauguugcaaguauuuauuuuguuugacuuauguguuacaugucucaauuuaacaguauuauuaaucauaguuaauaaauaugaauuuucuuaacaacuagaucuguaacucucauuugugguuuauauguggguuacauagaaaaccuuaaacucucaccuauaacugaaacauccaugucuaguaaauucuacuucccaucucaaagagaaaaaaaguaagggauguggauaugaguguccccaaagacugacuguaaugguuucaugcccugccuacccauggaucucuuuauccuacucccccgcccuuucucaccccucauuucuuagaaugcuucuccaugcuuacaguuuuuugcacaauccccuggcuguaucauuuaaaaacucuuaaacaucaagagguagcagguacaguuuuuuguugacgacacccaggcuuuucauuugcccuggaagaaaaguguugugguuguucauuacuucagaaaugaaauauauaauaguaaaaaugagcucaaaaguucauaagcugucuagggcaaaaaaaugaaagcauuuauaacuaaauuucaauuuaguucuaaacuuaguucuaaacuaaaaagcauuuaguuuuauuauugugauagaaguauuaucuucucaaaauguauucuuucuguccuuuaucuucaggguuuuauacgccuuuuaguuuuuuaggaaaagcacagcucaaacagaaaauaccuuucucuguccuugcuugaacugaaggagaaguuucuaaguuacuggccaguaagcaguagucauguauguguuuagguauuuccccauucugaauugaaaugaauauuuugugauuucucacuugguucuuugaaggagacguaucagcuguaaaaccaaccaugugacaauuaacguauuuuggacucauuaaucaugcacuaagaugaucaguuuucaggguuauuuaauuuagagcuaccuugguguuguguuggagaaugaauuggagagaacuuauuuuuaaaacauuuugaugaacauuguugcuucugguuguauuaaacacagaacuagauacuggggaccaugggaauuuuucuuuaaaagugggaaggcagggcuuugcccauuaggcaucuauuagaucuaugaguacaaaaagcaaguaaaugauaacauuugacguagcaugggcaugacauacuacaugaccacuggcagaaaucccuuauauacaauuaugcaaaauagcugaagcacuuauuaauuuaaauaaaacauuuaagcccuuacucucuguggaaaguugucauaggacacacuccuaugaaauccaccacugucccuuugaagccuuaugagaaauguuucuuuuaaaacaguugcaaauuuaaacacuuccagaguguugcacccaaacccccagagcuauagugguuugggugcaaguacauguugguauucagacuauugugaaucggaaagcacauuugugcauucgccaucuaaaugagauucagucaacaaauacuuacugauggucagauauuuauuuacuauuugucacgcauuuuuuucaaaaacaagauauuacaauuuagagcaaaaauuuaagcuuuggcuuaauguugaaagaaguacugcuuggcucaaacaaaauaugucugugaacugucaguuugccauugccauuuauaauuuaguaccuaggaaaauuucacuucagagaugucuauauuucuuaguaauaaaagcuguguguguguguguguguguguguguguguguguguaugaauguccuuguaguauguacuugucugacaucuaaggagauaagaggcaaaaaucaaaacuucacgguaaauguauuaaccguuuuuguaggcguauuaacuguuguucaguccaguccuguguguggauuagucauuauguuuuugcccauaauaacagaacauccaacaaagaguggcuuaaacaauaagugcauuuauuggccuuuauaacuggaaguauagugguagggcaguguucaggguugguuugucuugucauuaaacauugucaccaaggaccuggcuccuuuauaauuuaccuuccauuuuggucagugaccaguuucuuaaaaucccuuuaaauuguuuucaaaacauuguguguucgccccauaccuucuucuuugguauguuuguugcuauugccacacuuuccccauaccugccaaccuacccuguuaccaccucuuuguccauuucuccccagccucagacagguaagacagaauuguuucugaaauggaauaaagaacagucuuggccgggcgccguggcucaugccuguaaucccagcacuuugggaggcugagaugggcggaucacaugaggucaggaguuugagaguagucuggccaacauggugaaaccccaucucuacuaaaaguacaaaaauuagccgggcgugguggugcacaccuguagucccagcuacuuggacggcugaggugggagaauugcuucaaccugggaggcggagauugcagugagcugagauugcaccauugcacuccagccuaggugacagagcaagacuccgucucaaaaaaaacaaaaaacaaaacaaaaaaaaacagucuuaugacugcuguuuucuuuucaguuaaucuccuuucuuccuuaaaaaaaucacuuuucauuugaauucagaaauacuguggaauuugacaagaauguucuguagaacaagaaaacuugaugaaacugagucagaaaaugaauuucagaccccgaaagggccuugacccuggagucaagagcccuguucugaauucuggccaugacaauuuuggguuuuguaucuuuggaugaacauuucaccucucugggcuuaauuuucuguuacauaaaugggaguugcaaacuccuuuuccaaaaugccagugagaauuccagagaaaguguauaugaaaaacuucuaacauagaauugggcuuaggacaaauacuaaguaaauauuuuacaaauuucugcauugagucauuuucuuuugguuucaucacuuugauugagacccagacuuuugaagcugggcccuggaauucugugaaguccagccuggguaucuuuuuguggcuaccauuaaaccccaaaccagacauuuauuaagacuugugaagaguugagaaguaguuaauauuggaugacuuuucucguggguuuuuaauuguuauucaucuaaacuuuuugugguuuauguaauauuucuuaccuccuuuggccuuuuguuuaaaaggaggugggggaaacaaccccagaaaggcuuggcaucuuuuuucuauugcaaucaaaauuuaaaaugaaauaaaauaagaacuguuuuuuguuuuguuuuguuuugguuugguuuuuuuuuuuuuucagauggagucuugcucugucgcccaggcuggagugcaguggcacaaucucggcucacugcaagcccugccuccgggguucgccauucuccugccucagccucccaaguagcugggauuacaggcaccugccaccacgcccagcuaauuuuuuuuuuuuuuuuuguauuuuuuaguagagucgggguuucaccguguuagccaggauggucuugaucucccgaccuugugaucggcccgucucagccucccaaagugucaggauuacaggcaugagccaccgucccuggccuguuauuuuguuauuuuaaaauacucauaauuuauuaugcugcuauacuguuuuuuucuguuuguuuguuuuuguuuuuuuuuguuuguuuguuuguuuuuuuuggagacaaggucuugcucuguugccuagacuggaguggaguggugcaaucauggcuuacugcagccucgaccuacugggcucaggugauccuccuaucucaacaucccaaguaguuaggacuacagguguguaucaccacacccagcuaauuuuuauuuuuuauuuuuuuuuagagauggggucucucucuguuguccaggcuggucucgaacucuuaggcucaagccauccuccugcuucgacuucccaaaguguuggguuuacagacaucagccaccacgccuggccugcuauauguuuugauacgccuuuuggucauauguuuguuuuaucugugauucacaauuauucccuugucacccaucaaaacagcauuaucaguggcaugaagguuguuggaacuacagucauuucaggcugugucacaauagaaauuguuaagagcuguccauuuguaaugaaaacucgaaaauuuuucauuuuuaaggcaucuccugucuuguacucauuaugucucauccauggccuggaaugucuuagcgauuuucacacuucuauuuaguggcaaaaucauuccuucaaagacagcuuuuucaugggauccccuguauaaaacagaccaaucuggaugccugauuuuuuagaguggguuucagauggaaauggggguuauucaagaaugaaaggaaucuccgcagaucucagaauggaaaaccacuccagucugaguuuguuuugcauuuucugaguuuuuauugcuggugcucaggugcuagguucaccuggucggcacauuucuuccucauuucauuuacuaggggccaugcuaacuguugcuccagccuuacuagcagucuaccaucaacgguaaaagcauucccuucucaaucuuugugcaaaaguuuccuuccagguuguugaguugacccacgaaagucaugacgcuaauagaauugucuugacacaaaaacaacagcauugaagaaaucagaaauggugcaggcuuucgggugugggaaugcuuuuuucucucuugaaugaaguugcugaagaguggucuuaaguuauccuguucuguaaccaacaggaggacucacgaauggcaguggaagauacaucucugcugcuccaggcgcugaagccaaguaccgcagugcaagcagcgccuccagccucuucagcccgagcagcacucuuuucucuuccucucguuugcgauauggaaugucugaugucaugccuucuggcaggagcaggcuuuuggaagauuuucgaaacaaccgguaccccaauuuacaacugcgggagauugcuggacauauaauggaauuuucccaagaccagcauggguccaggugaguacuuggcuuuggcacuuuaagguacccgaaauuguaaugccuuaacugucuuggcucagauggguaucuacuuaaauaaauugccauauaguaauuuuuuaaaagcgugccucuuaguuugcaucacauuauuucauagggauuuaagaaacaaacaugaacacaaagacauacauacacuucggcugcuuuaagcauuaugaagaaucuuuugcucucaaagaguugcuauucaaauacaaguuugaucuagggugcugaggaguaagacagcucuaccaccuuucuuuguuguuccacucuguagaagugacagucuauguagagacgagagaagaaacuauuauagaagacagaauuugguuugguuuaccccuuccuguugggcugcugcagugggcuucacagaaagcgaaucugguccuggggauagagcauaauuauggugacaacacccauccuucuuucccauuucuguuucuguuucuuucucugauacuguguccagugaaacaguuucuacagaagcuaccuccuccuuaaguucugccagcuugcuacugggccaaaauuucucauauuugaauucuauaggcuagauucagaggcaacaugauuuuccugauaguggucauuuggacuaaaaaaaggcagacuguuacuacuucagaagauaaugaauacuguuuuguuuuuguuuuuuuguuuuguuuuguuuuguuuuguuuuuuugagacagagucuugcucugucgcccaggcuggagugcaguggcgcaaucuuggcucauugcaagcucugccucccggguucacgccauucuccugcuucagccucccgaguagcugaugaguacuguuuuauaugaaaauaaguuaaagaauauaguaaggacuguaagcuuugaguucauugaugugaggcugguuucuaaaggaaaaaagucaaguaggguacauguuguguuaugucucccuccaccccuccucucuuccugcaccccugccccucccgccccccccccgccccccccgcuuucaucuucccucccaccuugcacauaaauaagauucaguaugcaugcccuacuggaaugaaaugugccaacauuuauauguaauuuucaaagcucaauuaaguuaggaccuucuuccucuauuuaaaaacucuucaagggaguucaagugauucauucaaauaaaguuugguuuauugugugcaugugugugcacacaugcucacucacauguuucagaacggaugcagucuauaaaccgagguacacugauguaucuccaggucuuccuucagugcugugauugcccuuuuuacuuuguacuucagauucauucagcugaaacuggagcgugccacaccagcugagcgccagcuugucuucaaugaaauccuccaggcugccuaccaacucaugguggauguguuugguaauuacgucauucagaaguucuuugaaguaagccuuuguucuuucuauccuuugacuuaagagaaucugcagagcauuuugauuuucauuagccuuuuuaagcauagcagucccauuccaguccucagaaugaaggguguguggucuuuuugaagagguuuuuaguguuuuuccaauucauuagcagcagucuaucuauucuguaugguuuaaauauccgagcagauaaugccaaucuauuuuggaaauguguuucgaaaacugguguccccauuuaggacccagcacauuauuucagauuguuauaauaguuucacaaaacgugucacuuaaggaggaaauaauccuuguaaaguaguuuuagcaggaucacaauaaaauauugccaaaaacaaauuuuucuaagguucuuagagaauugucuuuggacaccgacuccaguauguuucauuaucagcuagggucacaagaauuguuaaaugcugcuucuuggcugaucguuuggccuugauuucuuguuuuacuucuguuaauuugaauaauguucacuuguuguaucauugucuuuggaaagaaugagauuguuagguugaugucuuuucccucuagugagguaaaauuucagagaggcagggacuuuuuugcuuaccauuguagcccuuauuaucugguauuggcaacccuaagguguagaugcagaauggcacaaaacuucgagaugaggaggagucugguauggggaggaaaaugcuggaauucugcacauuaccuaccacaaaacaaauuuguaaaugucuuaacaucucauccuguuugauuuguaugaagaugaaaaacugacguacucaaguuuuaccuucccaaguuuuuucaugaagacuuauguuuuuucacccugaauucuucagcuuuggacuaagaaaccaaucuaaacaugacuuuuguauuuuugauuuuagaaugacuuugcacugccguuuugucacauauauaaaaauacugagcuuucuaguucuggaggcugaugcaccuuggggugacaaaauguacaauggauuauagccauaugauuuggaccaagcuugagaacuucucuggaucuuaguuucccuugggagaaugaggagguuggaugggcugagaauucauaaagucuccuccaaucucacgauuaugugauugaaaugaaaauaauaagccaaggauggaaaaucauucuaaguagaauuuuaacauuguguagccucacuucuugauucuacugauuuuuccccucccaacucuguuaccuuguguaaauaggagaaaaaaaaaucaauucucuuaaugauguagaauacuauuucaaaacaguguguccaugugugcuuuggcaguaagaguguaggauucuuuuuuuugacacacagucuugcuccauugggcaggcuggaguguaguggugcuaucucagcucacuguaaccucugccgccuggguucaagcgauucuccugccucagccuccggaguagcuggaguuaacaggagcgugccaccaugcccagccaauuuuuguguuuuuaguagaggcaggauuuugccauguuggcgaggcuggucucaaacuccugaccucaggugauccacccuccuuggccucccaaagugcuggguuuaccggugugagccacugcaccuggccagauucauuuaauaguaugaauuaaugacagcuuugaggaauuauguguuugcuuagcagauauuaauagugaaacuaccuauuguuggguauccgagaaacuucuuaacauuaaaaaggguuacucauaauuaagagaucgagaacuacuggcuugaagaagcaauggcucuuuaaauaaaagguuuaguuaaucauggguaucagggcuaaaagagguuaugccagugguugaugcagaauaaugaaugcuuugcuuucucugguuuauuuccuucuacuuaaguaaugguguuuacccacacauuaugucuaguuuggcagucuugaacagaagcuggcuuuggcagaacggauucgaggccacguccugucauuggcacuacagauguauggcugccguguuauccagaaagcucuugaguuuauuccuucagaccagcagguaauuguaaguuuccccuuuaacuuuucucuugguguuugauguuucuccaugguacauguagugaacccuguaauucugucaauuuucaguuuucuuuuaugguuuugcauuguugcuuauggcugccuuuuugugcauggcaagcaugaacugugcaaauaauuuaaacuuguugcagaucaaguaucuuguauuaaaaccugugguauccaauacucuuccauuggcuagaacuuagccuuuaauagguucaauuuuauaggugguuuuuuuuuccaugaauaaagcagguaaaauacuaauaagccaucauuuucuccaacaagucaaacuuucauccaacccaccuuccauauuuuuuuacuccuucucuccuguucuuucaucccaccaacaucuauugaacaaaggccugcccagcauggugcauagccugguacauugaccugaagcccacucugugccagacuucaucagcacagagaugacuaacaccugaucccugcccacagagugcauucugguggggaagagccaugguggugagcaguggugaggacaugagaaggaccccucacccuucccagagucccugagggccggcuuugcaggagaaggcaaggcuaaagaagaguuagacagggaagaaggaacagaaaugagaaugcuuaggugcugugaguggggaacugaaagagaagucaccugaacaggcccacagcuucuugacaagucacggcguggguccagugagcacugcagacaccacagggcccaggaggcaaaacagacccacaggcagggugugcuacaguuguguuugugcugggcagugccuccagccuccggugcuucucaucugagccugcagcuuuugggcucugaacucacugagcccuucucaauugagggguugguuggccauugucuggcaaugaugacccacuugcccucacugagaacaaaguucgguaaugagaaucuuuguuaauggacucaaguucugagccagacaagacacccaccaccccugagucaagcuaaaccaauccaaaccacugcacugguguuggcaguggcaguugaaggcugaagaaguccaaaguuuuuaaagugauaaguuucaaagguaugugccacgaugcuggugaagggagaaaggaauguuggagauagagcaggucuggaguucauuuauucagugcuuaguacuagagauguagcauuaauaagaaaguauaaguaauuagaagcaagugugaagcuauuuuaaauuuucuuuuaauguucagaucauugccaauuuuaauuuuucuuggauuuucauagauaguugaauuguucuucuuuaauuuucuuguuuuucuuucuuucuuuuuggagacaaggucucacucugucacccaggcuggagugcaguggcacaauuguccuuguugcagccucaaccuccugagcucaagugguccucccaucuuagccuccugaguagcuggaacuacaggcauacgccacuuccccugguuaauguguguauuuuugguagagaugggguuucaccacguugcccaggcuggucuugaaccccuggguucaauugauuuggccucccaaagugcugggauuacaggugugagauaccauacccagcugucguuguuuccuguguuauauuuuugcacauauuuuuucuggucauguuucucuguggugucuuguucugggccugacuuaugcuuccuacccuuuauuauuuuacucuucucuagaugcaaauuugccauuuuggguaaaauuaacucaucuuuguuggaauuuuuauuucuucuggaucacaaaaauauccagggaagccaucucuccuucauuuuguuuauaaguauucuuugacuuuauuuuuguauaagcuucauugucauaauuauucccacaauucccaucauuccuauaauuguauuuucagaguaaauuauucucuucugggcccagcacaguggcuuaugccuguaaucccagcacuuugggaggccaagguggguagauugcuagggcccaggaguuugagaccagccugggcagcauagugaaaccccaucucuauaaaaaguuggcugggcaugguggugcacuccuauagucucagcugcuuggggugcuaaggcaggaggaucgcuugagcccgggagguugaggcugcagugagcagccugggugacagauccuaagagacccuguuucaaaaaaaaaaaaaaaaaaaauuuauucccuucugacacuugguuaaucacugugucucuugccuuuugcuucuuuagccccugccaguguaaucuuuaauuuaauuagaugauaucuuaguugcuuugagguacucaacauuuugggcauuuaagacauuguauucauuaacaucacuauuuugaugugacuugcagucuucuaacauaaauccacuggcagcacaguuuagccaauguacagagauuggagacagcagggaaacugggcaggaggcaccagguauagccauggugcaggcauuuaauuucaagauaccuaagaccuggggcaaugaguuugggggaagggcuccagucaaaaucccagugucucucuuucuauauauccugucaccaucacccauuuccuacucacagacucaguuucuggccauuucauuuacuuccuuuguuugcacacuuuucauuaauugagaaccauuccugcugacucugcagucacugugaccuaguaguaagaucauagguguuggagucacagcuuaggcuagaauucuaauucugucacuuucuauccauaguuugaaauaugugacuuaagccccucugucucaguuucuuuuauauaccagcagaggugggguguucaggauaauguauuguugacaguuugguuuacugauauagugguuuaccauacaguucagccagauugcuuggguuugaauguugggaaucuaggucuauaguuuuguaagucuuuuaauuugccucuuccuuggugucuccaucuauggugguguccacuccguaagacuguuaggaaaauuuaauuaaaacauguuacacgguuagagguaugccuaaccagggguaaacucuagcuuaauuaguaucauuacuagucauacuuuacagaguuaucauaauaaaaacacgauuaauuguaugugaaauucuuuaguuugguuuaguuuuauuuuuagagacaggguguugcucugucacccaggcuucuggugguguuaccguagcucacugcagccucaaacuccugggcucaggugauccucccaccucagccuccagaguagcugggauuauggcugugugccauguagaaauucuuuaauacagugugcaaauagccccugacuuaugauuuuucaaaacuguacuuugaaucuuuuuuauuguuuuuauuauauauauguauauaaguauauauauaaaauaauuuuuuuuuuuuuuuugagacagagucucgcucugucgcucaggcuggagugcaguggcacaaucuugccucacugcaaccuccgccuccacgguucaagaaauucuccugccucagccucccgaguagcugagauuacaggcgcgcaccaccaugcccagcuaauuuuuguauuuuuaguagagaugggguuucaccaucuuggcuaggcuggucucgaacuccugaccuugugaucugcccaccuaggccucccaaauugcugggguuacaggcaugagccacugcaccuggccuaugauuuuuuuuuuuuuaauuauaggcucugugauaaauaauuuuguccaacucuaggguacuguaaaugcucugagcacuucugagggccuaggauuagcuaugauguucuguaaauuagggauauuuaaaugcauuuuuuaguuaaugauauuuucaacuuauaauuggaauguaauucuuuucuaaguuaaggaguaucuguuccugauguaggcuucuuuguauuugaagaugucuacccuuuauuuuuuuuuaagcucuaggaguuggccgggugugguggcucaugccuguaauuccagcacuuggggaggccaaagagggcagaucuccugaggucaggaguucgagacagccuggccaacauggcaagaccccgucucuaguaaaaauacaaaaauuagccagguguggugguacacaccuguaaucccagcuacucgggaggcugagacaggagaauugcuugaaccugggaggcggagguugcagugagcugagauuguaccacuguacucuagccuggguaacagagcaagacuccgucucaaaaaaaauaaaauaaaaacacaaaagcacucuuaagaggcuuuucuuuguuuuuuguuuuuacaggugugagaucuuuuugguuacugguuauuguuacaguaaauuuauuguuggaaauuuuacuguaaauuggcuaaugucugaaaagacucagguccucauuuguuucccuguugucauuguuccacagcugcuauuccacuuucaucaucacagauucucuguucaguagugcuuucauguuuggugaaaagaauauuauuuguccacauguuugcuugcugugauucugguggugcuuucuuugucuccauuagaaugagaugguucgggaacuagauggccaugucuugaagugugugaaagaucagaauggcaaucacgugguucagaaaugcauugaauguguacagccccagucuuugcaauuuaucaucgaugcguuuaagggacagguaagugacccaggagagaaauaauggaaacaaauuuauuuccuuugugagcagaaaacagaguaggauuuguggcauguucucaauaugcuuaauguacuuuauuuuuuuugagacuggaucccacucuguugcccaggcuggagugcaguggcaccaucacggcucacuacagccuugaacugccagguucaagcaauccuccccccucagccucccaaguagcuggaauuacaggcacauaccaccacaccuggcucauuuuuaaauuuuuuguagagacaguggccucaccauguugcccaggcuggucuugaauuccugcacucaagcaauccaccugccucagccucccgaaguugcugggauuacaggcaugagccacugugccugaucuuaauguacuuuagacugcaguaaaaagcaguccuguauaguacugucagguaccugucuguguguugccaagugucugggucucggucuucuuuccgucauuaaugcaguugucugcucacauugggaugaaacaccaucauaagaguuuuuaagaugaaaucucauauuugaagaauaaauuauuucccuugguuaaguacuauuuauucugauauuucagugcuuucguuuuaaauuugguuuaaaauucagguaauuuacgguacuaauguuguaggucaugugugaauauaucuuuaaaauaacaaggugcuuuuugcuuaaauuuuuuuggaagggaugcaguccagguugguuugaauuguauuaaauggccaaauaaccagagauaacuucuaguuucuccuguuuuccuguauaucaaaaaucucuucuuagcuucagcuuccaaguaagauuguuacuuuuauauguaaauaccuuuuuccagaauugcuucugaauuggcuauaguuuuguguuuuuuuguuuguuuguuuguuuuguuuuuuuccaaaacacaaaguccuuacagucuccuaaggugggugggacaggacaguaaaacucagcuccccuuugggugugugaaauuggucuuucuuuagggaagggggaaaaaugagaaaaagcacauagauuuucagguauaauuuauguacugcugaguauagagugauaugugauguguaguaaucuuuagguuuugcuguuugcucaaugaccacaaugguugaucacugacagcaacccacgugguuauugggaguuucugaguuaaagaaaaaaggguagaucuguuuaccuuaacauuaagauguuacauuuauggaauuauacaacaaaaaagauaaaacgauaaauccaccaggagagaauauuuucaagaugcgacggucaaaggauugauaacuagaauguauaaagaaccucucuaaugaaagaaaacaauacaacaugauguaaaagugagcccagaacacaaguugacauuucauagaagaaacacaaauugccaguagacaugaaaaaauacucaguuccauuaggaacaaggaaaaugcaaaauuaagccacaaauaauagacuauuauuuacccaucaguugcuaugugcugacaggaaugagguacacugcuggugggaauagacauuggcacaaccauuuuggaaaauaauuuaguauugucuuucaaauuucaaccuucauaauuucugugauccuguugaaauaucuguacauguauaccaugagaccuuuuagacauguuuaaacaccauuauucucuuaaaagacuuaaggaacccagaagaccaugagcaggggauugcauuuuuuaaaaaugucauauacauggccgggcacggugguucacaccuguaaucccagcacuuugggaggcugagacggguggaucaccugaggucaggaguucgagaccagccuggccaacacggugaaaccccgucucuacuagaaauacaaaaaauuagccgggugccuguaaucccagcuacuugggaggcugaagcaggagaauugcuugagcccgggaggcggagguugcagugagccgagauggugccauugcacuccagccuaggcaacaagagugaaacucugucuaauaaaaaaaaaaaaaauucuuuguauauaccaugcagaauaaacuacagaaacucacaguauuguaaaugaacaugggaaucauaauguugagugaaauaaaucaaguugcuccagacuacaaguguagcauuuuuauaaagcuaaauucaaggagaaccauacaguauacuauuuaucuuuacgauuguaaauauaaagcuacauguauaaagucacacauaaggcuaggugcaguggcucacaccuguaauccaggcacuuugggaggccaaggugggaggauugcuuaaggcuaggaguacaggaacagccugggcaacauagcgaaucuccgucucuacacacaauuuuuuuuuaaaguagccagaugugguggcaagugccuguagucccagcaacuugggaagcugaggcaggaggaugaccugagugcaagagcucaaggcugcagugagcugugaucaccauugcgcuccagccuugucuccaaaacaaaacaaaaucauacagaaagcacugggugugaugacuuacacuuggcaagcauccaguaaguguuagcugcuauuauugcucuuauuauuguucuugauuacaguugugagauguaugccacuaagcuaggaagggcagaaucucaaggguagugugcuuuucuauugcuccaaacccagcaaaagaaucuuuucuuauugcugaaaaacaucacaguuaaaucagaacauugcauucugguuguucuggcggugugaaagcauucaggauuuggucccaguccuucccuuuucuguuguuagcgcugucuuuuggagagguugucaguugacacacuugacucuuaacuaaguguguuuuucaugacuuugacuagcuaucuguuucuuggcggcuuggaaaaguccuuuucagcucugaauugugcacaucuaugaauuccuaaaauagauaagcgaugaguuuauugauacacacacaccuuauuauauguagagagaacuuaaaugccauuaaguucauuugugaagauuagugggauaauacauauauauauauauauauauauauauauauauauauauauauauaaacaauacugaagcauugaagguggugacugucauuuuugcuucucauuuguguuugucuacccuuagguauuugccuuauccacacauccuuauggcugccgagugauucagagaauccuggagcacugucucccugaccagacacucccuauuuuagaggagcuucaccagcacacagagcagcuuguacagguaguggaguugccaguagaggaacugcgaacaccugugggcuugugcagggccagaguuuguguguuuugucaguguagguuccagaagagguuaauguguuuuaaauacccuugaaucuugugguuguauuuguauucagagcagcuugguuuguguuuuaugaauauggguagugaauugagcccuagcccuggagucaggagaucugacuuccagaacucugucauguacuuguggugucaccuuagguagacauuuaaucccucugggucucuguuucauaaucguuaaaugaaauaaguugauuuguugauuucuuguuuuuagcuuugauacauucucugcuuauaccacugauuaaauaauuagguaugcccuuguuuuuuguuggacauaaauauuuccaguuuuucucuguuauagauaggugcagugaaccauuuguauauguguuugagaaaaaugaauauuuacugccauaacacucccuccccuuuuaaaaaugaauauguauauucuauugucuaguaauaauauguuccuguuuuguaauaauagagaagaacguuacuaccugucuuaaaaauuguguguucauuaguauucauauaaaccguuauggugguaaaagaaagacagguuuuaauuagauauaaggacuuaaguaaccugcagaacuggcuuucacauacauuuuauuucucuuacuguuucucaaacaggaucaauauggaaauuauguaauccaacauguacuggagcacggucguccugaggauaaaagcaaaauuguagcagaaauccgaggcaauguacuuguauugagucagcacaaauuugcaagguacgugcuuugaguuacaaggacuauuucccagaagagaggauuaguaguauugaacuauaauuaucuuauuuuuuaauguuguuguuguuguuguuguuuucaaaguauauauagcuuaaaagucaaauaguuuuauuacaaaguauaaacucugagaggucccuuagugggcuucuuacucugauagagucagccacuuugaaaucuggggaauauguuacuaaagaaugugaguguuacacuuugaugaacugaauauuuuauuaacuuguuuguuuggaauugugaaauguuguuuauucaguuucccuuuuuagcaccugaaagaaaggcaguuuaccauaugcauaucuauauauaggccuuaguauucuuaggaucucuuuuccagucuucauauugugcaagcucaagaaugaaaugcaguaguuauucccagguugugaaaggugucuuaggucacuuauaaguagcagagguuggagaaggaaucaauggcccuuccauguggauagugguauagucuucugagaagauacuguauauguccuacugcccacauaacauacuauuuuuuauuuuuggaauauauucuucccugguuuuuagaauaaauugcaaggcaggacaggacucauacaaccuugauguuuuuaauuuauguuauuuuuugagacagggucacgcucugucgcccaggcuugagugcaguggcacagugucggcucacugcaagcuccaccucucaggcucaagcgauccuccuaccucaggcuuucaaguagcugggacugcaggcgcacgccaccacgcccagcuacuuuuuuuuauuuuuguagagacaggguuucaccauauuggccaggggcuggucuugaacuccuggacuuaauccucccacuuaggccucccaaagugcugggauuaccagcacgagccaccaguaccuggccucauucauuuuaaauuugugaaauuuuauaacaugucacagcauggaaaaacagagaaaagaaaugaaaguaccuguagauccagugucuccauagccuagcccuaucaggguuaucucuuacgacuuuauauuguuuuguuuugggggguuccuuuugaccgguugccaggacugaggaauggggaucagaaucucuuggguucucuucuucgggucagucuccuguuuacauuuuuguucacaguauuuaauuucucacccuuggauauagccuaagcauuaauuaauauuacaacaaauucaaaaacaauuuaaaaaaaaagaaguuuuuauuuuuuuaagggacagagucuguugcccuggcuggagugcaguggugcacuccuagcucacugcagccuaggauuccugggcucaagcaguccucccaccucaaccuccuaaguagcugggacuguaggugcacaccaccauguccagcuacaacaauuaauaacugaguagcuacugugggcccaguccucccauugauaacauguguaaacuguggacaaaaauacaagaacuaccugaagacacuagagaguaaccaaagggcagguggagaccagagaggugggggcuggcauuuggaagaagagaauugcacuggggaaauuucuuauuucugauggcuguuagccuguggucacuucccagucuuuuccaugcugggcagcuaaagcuggaauaggcaauccucagggcagccacaacaaagagaaauccuagaaagggagagagccggaagggguucgggggggcccaguuuuaaccuucccccaaguccggcugaccccugaaccacauuuccagcuaaggcugaaagaauugaacugggauuucagcugcugcuuacuguaugggagaaguuuguaguuugacuauagccaaguuaacugcacuaaaacaggaguggagggcacuucucuuugguggaacauagcagaagucugaguuucuguagccuguuauucgcagugucuaucuggauaauaggaaaaugugaccuauacucaagaaaaaagaaauaaaaaucaguggguagucuaaaaugacccaguuauuggaauuaguaaagaaggauuauacagcagcuguuuaaauauacucagguuguaaaggaaaauaugcuguagugaaugaaaagauaggagauuuuaguagaaaauuauguauguauguauguaucugucuaucugucuaucugucugucugucugucugucugucugucugucugucugucuaucuaucuaucuaucuaucuaucuaucucuaucuaugaaugagauggagucucgcucugucgcccaggcuggaguacgguggcgcaaucuuggcuuacugcaagcucugccuccuggguucacaccauucuccugccucagccucccgaguagcugggacuacagguguccgccaccacucccggcuaauuuuuuuguauuuuuaguagagacaggguuucaccauguuagccaggauggucucgaucuccugaccucaugauccaucugccuuggccucccaaagugcugggauuacaggugucagccaccgugcccggcugagaaucuuauuuuaaaaagaaaaaauaggggcuggagacgguagcucauaccuguaaucccaacacuuugggaggccaaggcaggcaaaucacuugaggccaggaguuccagaccagcuuggucaacaugcggaaacccaucucuacugaaaauaacaaaaauuagcugggcgugguggcacacgccuauagucccagcuacuugggaggcugagucaggagaauggcuugaaccuaggagguggagguugcagugagucgagaucgugccacugcacgccagccuaggugacagagcgagacugucucaaacaaaaauuuuuucaaaugguggaaaaauuuacuuuguacucugggucaccaucaaaaaugucugaaagcaggaacaguggcucaugccuguaaccccagcauguuggaaggccgaggcagaaggauugcuugaggccaagaguucaagacuagccugggcaacacagcaagauccugccucuacaaaaauaaaaauagggccgggugcgguggcuuaugccuauaaucccagcacuuugggaggcugaggcgggcagauugcuugagguugggaguuugagcccagccugaccaacauggugaaaccccgucucuacuaaaaauacaaaaauuagcccggugucauggcggacaucuguaaucccaggugcucgggaggcugaggcaggagaagaauuauuugaauccgggaggcagaaguugcagugagccgagaucaugccauugcacuccagccugggugacagagugagacccugucucaaaaaugaaaauaaaauaaaaaauaaaugucugaaagccacugauguauuuuuuuguuuacuucuauugaucuauuuucaaguucauugacucuucugucaucucuaauccacuauuaaagccauacaguaaauuuuauuucugauguuauauuuuccuuuucuaaaauuucuauuuuuacuuaaaaaaaaauuacuuauuugaggccaggcaugguggcucaugccuguaaucucagcacuuugggaggcugaggugggcagauaacgaggucaggaguucgagauggagucuugcucugucgcucaggcuggagugcaguggcacaaucucggcucacugcaaccuccgccucccgauucaagcaauucuccugccucaaccucccaaguagcugggauuacaggcaugcaccaccaugcccugcuuggcagcagggagauaggcauaaguaagguuuguuccuggccuuggugaacugacaaaggcgaggaaagaauggacagauuuugguaaguguuaaaauaauaaccagcugguggugaaccaguguccugaaccuugugcuuaagucuccucaccuaccugggcuccuuacccuuacccguuagagggccgggucccauguccuugaagaccuggucucucuggguggucaguaugcaguaguauggcaguguauaauuugaucacccucuauaguccccguggauuggagaaaaaaucugauuuaaugccacguucccccuuuccuacgauuggaugccacagauggcacagguggagagucagagacugagagagucagacaguuggcgacucaucuuccucaaauguuaaauagcucucucucccugcugguccggaggucagggcagaagcuaggcaagcacagccucacuaacaggggccucucuuguaagaguugucccugguuuuaucucauuacagcaauguuguggagaaguguguuacucacgccucacguacggagcgcgcugugcucaucgaugaggugugcaccaugaacgacgguccccacagugccuuauacaccaugaugaaggaccaguaugccaacuacgugguccagaagaugauugacguggcggagccaggccagcggaagaucgucaugcauaagguaggccgggcugggcagggucucagagaaagugugcaaggccuuggcuuccuuucugaaacacaaaggagggugggugcccugcuguuuuugaagaguuugucacugaccucugucccaugcuguguucuguuuuucuuuuauguggagucaccauuguccuuacacauuugccaacccucccuuaucaauagccacacugguaugagaaucuuaagcuacauuuuuugaaauauuuccaucccugaucucuagagaaucagcuuaugaguccaacaaaucaacuugccucauuuccuuuucucacuccucccuucuguucuuucaucccaccaacaucuauugaacaaaggccugcccagcauggugcauagccugguacauugaccugaagcccacucugugccagacuucaucagcacagagaugacuaacaccugaucccugcccacagaguacauucugguggggaagagccaugguggugagcaguggugaggacaugagaaggaccccucacccuucccagagucccugagggccggcuuugcaggagaaggcaaggcuaaagaagaguuagacagggaagaaggaacagaaaugagaaugcuuaggugcugugaguggggaacugaaagagaagucaccugaacaggcccacagcuucuugacaagucacggcguggguccagugagcacugcagacaccacagggcccaggaggcaaaacagacccacaggcagggugugcuacaguuguguuugugcugggcagugccuccagccuccggugcuucucaucugagccugcagcuuuugggcucugaacucacugagcccuucucaauugagggguugguuggccauugucuggcaaugaugacccacuugcccucacugagaacaaaguucgguaaugagaaucuuuguuaauggacucaaguucugagccagacaagacacccaccaccccugagucaagcuaaaccaauccaaaccacugcacugguguuggcaguggcaguugaaggcugggggagucccagguucuuaaaguuguaaguuuucaggaugcuggugaaggcagagggaauguuggagguaaguaggagcuuaagacaugucuauucauucauucauucagugcuaaacaccuguuguacagcaggucguauucucagcaggguuguauugguaaacgugauagugcugugcacagauaguuacugggacacuggagaaauacaggggaaaggguuguccaggaaugggcagggugucuucuauaacguguggguacagaggaggcucucuaacggagugauacuuaauagagugaugacccuuuccagaagagggaacguggugugugaagacuuggacgccagagaccagaccguguuguaucugaagaaguaaaacaaguucaguggaggaggaguguggugacaaaaucacacguauauuucaaauaauuguccuggcugccauguggccuuuguaguuuagaggagggaggcagugaugagaccacaugggaggccgucaaggcaccagaugguggugguuugggauugaagagaaguggacagaauagggugcuagaauugguagggcuuagcaguugguuggcugagggaguugacggggagaguccugagaagcccucuuaguuuuucagcucuuccauuacuaagugguauccuuuucagcaaaagggacauaaggagagaagcagguaauuaacguuucacuucuuguuaaauccaauaaaaaauggaguucaacauguguguguguggcuuguuagggguuuuuuguuuuguuuuguucuggggaaguacaaaggugaagugccuggacuugucagcagccaguuccagggacagaggaauggauuggauuucaguuauuuucuaaaaggaaagcuaccaaaagcaaggggaucuugaaccucaaguucucaugacagaaacauuaguaacauaguauuacaacugaaaggaaaguauagcauuauugcauacgccguuuuacaggugaguuuaagggaggugaaacuggaaccaaggacuguuugccaccagccaguuuccccuguaggcuccaaagugggaaugugacacccgaugcagcucuguguccugggaagcaugcgcaggugauuucuagaccggaucaacccuuccuugcuuugaggacacagcuaaacagacaaaaauuggugcccucauggagcucucaaccuggagagccucugucuacugcgguacauuuauccagugcguuuauguaugcaggugcagguuuggauggggaaucugaugaauaaacugugguccuuuacuguuuauauggaaagauugauaauuaagcaaaagauagcagacacagcugagguauguagaaugcucccugagcucacagaaaagaaaaggggcuuccagagaagaagcaccucucaaguuuucuggaauguaggacuucuugaaaugaucagcccagggaaggaagaacagaaaggaaugcuuggagaagugacucagagcauaggucggagagccugagggaugaggcugguguggcgggcgugccuugagagcacaguggggagaaaccugauucguggaggagccacacaguuugggcucagcuaucugugcuguccuuuguuagccauucaaccuuggcugagugacuuaacuacucugugccuucauguuuucugucaguaagauggggauaaucacaccagcucaugauguucaucauuucucuucuugucauugauuagcuuucugugauccacugugaccuggagagacagggucaaguggugagcucaggauucuggugacccgaaauaacccccacugcucaggagagccuggaugccgugcauggggccagaggggccugugcucaugcuugcagggaagcacugugcagcuggcggguagugggcaguguauuuucccagcuaggaugcacuuucuccauguguuguccugggaguggcccauggccacccagccuccaggguccucaggcccuguggcaccacucaggguaggagcuccucuccucaucugauggguugccaaagugcuagaagucaggggacugggcugagccagugaaagguauugcuguagggguguguguguguguguguguguguguguguguguguguguguguguaugugugugugaugcaugacaugcaaaugcauguccgggaagccugcccccaagucucaucucaggccauguaacacagacugucuuuccuccccagauccggccccacaucgcaacucuucguaaguacaccuauggcaagcacauucuggccaagcuggagaaguacuacaugaagaacgguguugacuuagggcccaucuguggccccccuaaugguaucaucugaggcagugucacccgcuguucccucauucccgcugaccucacuggcccacuggcaaauccaaccagcaaccagaaauguucuaguguagagucugagacgggcaagugguugcuccaggauuacucccuccuccaaaaaaggaaucaaauccacgaguggaaaagccuuuguaaauuuaauuuuauuacacauaacauguacuauuuuuuuuaauugacuaauugcccugcuguuuuacugguguauaggauacuuguacauagguaaccaauguacaugggaggccacauauuuuguucacuguuguaucuauauuucacauguggaaacuuucagggugguugguuuaacaaaaaaaaaaagcuuuaaaaaaaaaagaaaaaaaggaaaagguuuuuagcucauuugccuggccggcaaguuuugcaaauagcucuuccccaccuccucauuuuaguaaaaaacaaacaaaaacaaaaaaaccugagaaguuugaauuguaguuaaaugaccccaaacuggcauuuaacacuguuuauaaaaaauauauauauauauauauauauauauaaugaaaaagguuucagaguugcuaaagcuucaguuugugacauuaaguuuaugaaauucuaaaaaaugccuuuuuuggagacuauauuaugcugaagaaggcuguucgugaggaggagaugcgagcacccagaacgucuuuugaggcugggcgggugugauuguuuacugccuacuggauuuuuuucuauuaacauugaaagguaaaaucugauuauuuagcaugagaaaaaaaaauccaacucugcuuuuggucuugcuucuauaaauauauaguguauacuugguguagacuuugcauauauacaaauuuguaguauuuucuuguuuugaugucuaaucuguaucuauaauguacccuaguagucgaacauacuuuugauuguacaauuguacauuuguauaccuguaauguaaauguggagaaguuugaaucaacauaaacacguuuuuugguaagaaaagagaauuagccagcccugugcauucaguguauauucucaccuuuuauggucguagcauauaguguuguauauuguaaauuguaauuucaaccagaaguaaauuuuuuucuuuugaaggaauaaauguucuuuauacagccuaguuaauguuuaaaaagaaaaaaauagcuugguuuuauuugucaucuagucucaaguauagcgagauucuuucuaaauguuauucaagauugaguucucacuaguguuuuuuuaauccuaaaaaaguaauguuuugauuuugugacagucaaaaggacgugcaaaagucuagccuugcccgagcuuuccuuacaaucagagccccucucaccuuguaaagugugaaucgcccuucccuuuuguacagaagaugaacuguauuuugcauuuugucuacuuguaagugaauguaacauacugucaauuuuccuuguuugaauauagaauuguaacacuacacgguguacauuuccagagccuuguguauauuuccaaugaacuuuuuugcaagcacacuuguaaccauauguguauaauuaacaaaccuguguaugcuuaugccugggcaacuauuuuuuguaacucuuguguagauugucucuaaacaaugugugaucuuuauuuugaaaaauacagaacuuuggaaucug

SEQ ID NO: 192932 - RNA, 44381 nt, Homo sapiens
uuaauguuuucuuuugcuaucgcaaacucgaaaccccuacgauuuuauuaaaagugcaagaaugaaaaacaggaaaucccuugccuugucugguucugagccagagaccagaggccugaggcgcagccaggcccacuucagaugguggaaacgaaaauuaaucagaagucguaugcacaaagcaaaggccuuguauuaaauucacagagugggugcugacgggugcugccggcaggacagccuucccagaggucuggcacuacaccccaccugaaggugcaagggcccucccaggccacgggaagcagggacucauggcaccuuggucugccccaaaggccaucacugccaccgguggaaaaccaggcggccacaagcuggcgguucacuggcacgugggugacaagguucaugggcacagaugcccaugcgcaagccccaagcaccgugacccgucgggagggggggacacacggggccagugggacucugaccaccaacgcccgggguuuccuagcaacuaaagcacacaaggcgcccugcacagcaggccuuucguggggaacacagacgcauguuaaucuguuugcagauucauguuuaauagaacgcccuucugaaaugcauccaaaauagagaagcuuucucccgaacugcaaaagccauaaaaaugcaaaaugcuucuuuaggaaaaacugaaucaaaauuacgccuuaauguuccaagcaacacgaaaccuacucugugccccagggcaggugccggcagcagccauggccccgaccagcucacaugaaaccuagucugugccccagggcagugcaggcggcagccguggccccgaccaacucacaggaaaccuacucugugccccagggcaggugccgguggcagccauggccccgaccagcucacaggaaaccuacucugugccccggggcaggugcaggcggcagccauggccccgaccagcucacaggaaaccuacucugugcccuggggcaggugcaggcagcagccauggccccgaccagcucacaggaaaccuagucugugccccagggcagugcaggcggcagccguggccccgaccagcucacaggaaaccuacucugugccccagggcaggugccgguggcagccguggccccgaccagcucacaggaaaccuacucugugccccagggcaggugccggcggcagccguggccccgaccagcucacaggaaaccuacucugugccccagggcaggugccggcggcagccguggccccgaccagcucacaggaaaccuacucugugccccagggcaggugccgggccguggccccgaccagcucacaggaaaccuacucugugccccagggcaggugcaggcggcagccauggccccgaccagcccccaccagccucaguuguucucgaucugcuccagguccagcucccagcgggcccgggggaagacgcccuccuccccgacacuguccccaucacggggguccccgcugcuccugcgggagccaucacuggucaccgacucccuagaggcccacagguugggguggacagggcugguccugaggccccucuggcugcagccaggcauggugaugccagggaggccccgggagucacauggggaggacagaaccgucuucacuggggugucauccucaucgucaucuucguaauugagggagcaaaggcuuuuugaauuuuuuaaagucugcaauagaaaagauacgggcuuaaagcauuucuagcagaucacacaggaggcagcaucccaccaacccaucgagggcucggugugcuggggcucuggccauccccaagaccacacaaagcaggggccuugguccccuguacaccagccacagcucucagagccccuuucucagacccugcccaugcccgccccagcccaaccagcuggccccucagcucuccucagcccccgcccagcuggugugggcagagacgcacagccuggcccugcccagacccaacggaccagguuggugggcaccugacaccuaagcaagccccaagaugcccagggcucacaggugacagccuuaucccagucuuguccuuggcagguggccuguccagagagggugccuugugccuccacuucugacaacagccccacccagggccgcucucagcaagcaccucacagccaccucugaggcccugugguggcucugucucuccuccaccugcccccauaaggccccuggaaccccaccucgucgguguccucaggggcccaccagacgcagcucccaccuucucuguccuugcaccuccuccccuaauaguuacucuaauagaaacacaugcaaauccuucucaucucaaaauacgugcgacaaacaggugcacacacaggggucuccccugggcaaggcccgcccucaucccaggcgaguagcuuccaguacccccaugccacgcccaggccuguccacagcaggucccugagugccaggcuccggcccucccucugcccuccggaggugccgccaccacccccuucucacucugccccccggcuauaucucacucaguagccucccuucccaaggccuguuaggaauaggggguccccccaggcugcaccccccaaccagagcacucugagcugcaaacagucuccauccacccaggcgugcucucuugggcgucuccagggcccugagacccagcagguguguccagcuggggcacgaguccauggccacgaccagggcaccagccccucagcacucccgggcccccaccccccgccaccucccaguccuugccucaagucccccgucuguggugcccagcgccguccaugccacucguccacugccacugggagcagccuuccuacccagccccaccugccgggucaccuccaggccuccucagggucaaggcuccccuccucgaccacaccacgcuggcuucagacgccucaccucguggcucaggcuugugagggcacgugggugccacuggccacgccugcagggcacaggggcgccaugaugccgaugacaaggccacacugacacagcacccucggccaccuaaaguuaugaccuagagcacaagcucaccaauuccacaggacccaagaaacuccccaaaucaccuucguccagagcaaggaaacaccccacagacgggaaccucaaacacuuccuggaaacacuuccagcgacugauuuuuauaaaagcacauggcccucggggacagagcuccuuuuuucuaaggauauuauugggcucuaaaagacaaauugacgccaggcaugguggcucacaccuguaaucccagcacuuugggaggccggggcgggcggaucacgaggucaggagaucaagaccauccuggcuaacacggugaagccccgucucuacuaaaaauacaaaaaauuaaccaggcgugguggcgggcgccuguagucccagcuacucgggaggcugaggcaggagaauggcgugaacccgggaggcggagcuugcagugagccgagauugggccacugcacuccagccugggagacagagugagacucugucucaaaaaaauaaauaaauagacaaaagacgaauugacauauuuucugucuuugugguucuacuauaaaaagugaaucacugagaaguaaaauucuaaagaauaauuuuuuuuuuuuuuuuugagacagggucuugcucuguuucccaggcuggagugcagaggugcaaucauagcucacugcagccucgaccucccgggcucaagcaauucucccaccucagccucucaaguggcugagacaacagguacauaccaucaugccggucuaauuuuuguauuuucuguagcgauggggucucgcuuuguugaccaggcuggucucaaacuccugggcucaaacaauccucccgccucagccucccaaagugcugggauuacaagcaugagccaccacgcccagccccacucaaaucuuuaaagauacaacuggccacauguuuuggucacaaaauagggaugcauaacuuauuuuucauucaaaucaaagugaauuugcccauggacaucacuuguccguacaagccccaggcccggcaugaggauguggcuggucugcugggccccugcuggauggcguggagguccgggucucaccagcucggucuggugucacccgugaccuugcagacucuggcugccgugcugcccacacaggauggccuccaauccacagcaccaccaggcugcacuacacacgcaccgggguggcggggacgcuacgcaccuucaggggccagguuuccuuccauuucaaaccacggcguuuuguuuucauucagagucgacccucuggacugacugcucggacccgacagaugcuguaagcucacgccgaggccucggacgcgggacucgcacucgcgggcacagcugugcggcuagagcgugaaaacagcaggcucugaacgccucuggacgacacagucggugcaggagaaaaaacuucugcccacagacacggcagcuguacagcucagcgcccaacagcgcuagcgaaggccacacggaacugaaggggccacccacgcuguagagacgguggaaaccgaggcccacggggccgaugcuggccuggacugcgccacccauccgccucgcgcccccugucccugggcgccagccccggggcuccgucccagcuccugcuaccaucacucugguuggauggucacuuccaucugagguuaaacacaaaacaguuguccaaaacacaaaggucaagccuucaaguuccaaauugggcuccaaagcgcagaggccuuucaaacugugugcgaagcccuccaggcagucuggggggugcacggaccccagcugacagcuggagggccuccagcaccugagguggguuaacucagcuaccggaagccggugagacccuggaaggucagggaagccuccuacgagcugaccugacgucacucagcaaacguccagggcccugucucagccacaucuguaccugccccuugccaaagccucuggcuuuugucaaacuaaaacacggguuuacucucuugagaaagcgcaagcuccauccaccaugugggaggggcucacaggguccccucacagccaaggcggcccuggccgugggccgcucugcagcagggccaggcagcagucaaggguggggggugcuccccaagggccuggcagugccuggagcgcagcacagugcauguugaaacaggcagccaagcagagccaagcaccucccuccugccacagggaggcacaggccggccaagccacagaggcccacagggcgcagggauguccauggcacaggcagggacagagauggccagagcaagcuccgugcgugugucaggcgaggaggccagugugagaagcaccgggacccuagaccccuuguugccucuggugagcgcccucccaacccugcagaagagaggguuauuaggaaaguacggacuggagcauucuagacaggggagcuggccgacggcacaugaaaaaacuggcugagugagcccugcucagacaaccugcucgggcugugaggggcacacagccuuacaaagccaggaagcuggagaacaaagauccucccugucuccccagcccuccacacagaggcagaaggaggggacucuccgcccugaccgugcagccacugauggcaccggcuccucaucccaagggggaugggacagccagugcccaucaggagguauggagugagugcccagcagugcgcccccugcccagcacucgcuucugccaccucacucaccaccucugaccacccugggcauggcuccuggagagaaggucugagaaaacaagcaagaaaaaucagcagcuacaaauuccagauuuucggucugcgccgucucaaacauuccauguucuugauggucccugcuacaguuugaacguauaccuccaaaucucuaccaugguguugggaguugaucagguccugcgggccugcacaagacacgagagccucauaaagggcuggagggaaccagccucaguccuccgcguccucuaucuccuccgccaggugaggacacagccacaagaggccaucuuggaagcagagggcaggcucucaccauacaccagacuugcuggggccugggucuugggcucccagccuccagaacucuuuuuuuuuuuuugagacggagucuugcucugucgcccagguuggagugcaguggcgcggucucggcucacugcaaccuccgccucccggguucaggccauucuccugccucagccucccaaguagcugggaauacaggcguccgccaccaugccggcuaauuuuuuguauuuuuaguagagacaggguuucacuguguuagccaggauggucucgaucuccugaccucaugaucugcccaccucggccucccaaagugcugggauuacaggcgugagccacugugcccagcccagaacucuugagaaauacauuucucuuauuuauaagugacgucgucggggguauuuuguuacagcagcaaaaacaaacuaagucaguccuuuucuugguaccaggagcugcucaaagcuuuugguuuuucaauuuucacccaggaggcacagagaaaacagcucagcaggugcagcagaggcccccccauggaggacaagccuugcgcucucgugacugaggccgcggaaggcaccaucugcucacuaaacccaagaccuccaaaaacgcagcgggccugaaggugugaacacggccacaugcaccucuagcuuguccuuagguucuagcccaugauguaacugcuggccccaaagcugccugccugucugaagaacuccucaggcucugggugacccagcugcagggccacauaggaagcuguuucuuucucugcagcagccucggucucuccagaggcagcugagcgccuucucuacguggcaaaagcuuuucaaagcccuaaaagcacacgcuuuuauagaaaccagcagcugcuuccacacucugcuggaaccauaacugaugugcauauuuucaauggucauauuuuaauuucaacuuugaaacauagcuuugccaauaaaaacagaaaaaguagcuucgccaguaaaagccgggcaugguggcuuaugccuguaaucccagcacuuugggaggcugagguggguggauuuccugaggucuagaguucgagaccagcauggccaacauagugaaacccccucucuacuaaaaauacaaaaaauuagccaggcaugguggcaggcaccuguaaucccagcuacucaggagacugaggcagagaaucgcuugaaccugggaggcagagguugcaguuagccgagauggcaccauugcacuccagcccgggugacagagcgagacuccaucucgggaaaaaaaaaaaaaaagcagaaaauccuaaauguuuuccuaggaaaacaugcacuguuuccaagggaaaggcagggaaggcagugccccugcacccugcucagagagcagcccucugacaccuggggaagcuggugugagccuagacucagagcagacagcaggggguggcgggggguugaggaugaucgccgaacggucccacugauaagccccgacauaggagcccugcagggugaacacaguugcgcacgcagacugcacaacacacgccagggacgccggacuagagcugggcugcgcauaccgaguccgccaggugcaagcacagcacagccggggugcggaugugagcgagcgugagcaugcagcggugcacaugagugggagugugcacaugagugggagugugcaccugagugugcacauaagcgugggggugagugugcaugguggguaugugugugugcccacccagagucaggacuaauuguccgguaacacacaauuauaaaaguuguagaggaaaaucagagcauuucuuuuuggcccugagguggagaggagcuugacacaaacaggaaguggcaaagccugggccugguggcgcacgccugcaaucccagcacuuugggaggugaggcaggaagauggcuugagcccaggaauuugagaccaacuuggacaacauaguaaggcucugucucuuaaaaaauugagaauauuagcugggcacaggagugugcaccuguggucccagcuacuuaggaggcugaggugggaggaucaccuggguccaggagauggagacugcagugagcugugauuauaccacuacacuccagccagggcaacagagagagagacccugucuccaaaaaacaaaacaaaaccaggaacugacagguaacccaggcugggggccaaguguucaccaaaggugccacauauucaggugaugcggugcaggcagggguaggugggugugggugaagacugguuggcugacagggagaggggcacacagacggcagaugagggacacagagaaaggugggagccaguuuuugggugggaugagcaaagagcuggaaagagggagagcaggcagcccuggccccucaggagucuuggcacuguccucugcagccgcggucaggagggcucuggguuugcagacguggccccugaagacacugccugucuccucaggggcuuuccugacauuugaugaggcccucuccccacaaaccuuuuuaccagaaagcgaugacuacggucacacugaagacacucgugagcaagcagaccaaagcggcugaauuuaaggcaaugcacacuucagggcgggcagguauuaccuggcccccacaugaagcaaauaaacgaaaagcuuuuauuucaggugagguugagucccaggagcagaauggggugugcagcacccacaucacuguucuggcucauuaacaaagucacugaagaaaacggggcaagccgggagugguggcucacgccuguaaucccagcacuuugugaggccaaggcaggcggauuaccugaggccaagaguucaagaccagccuggccaauauggugaaaccccaucucuacuaaaaauacaaaaauuagccaggugugguggugggcgccuacaaucccagacacuugggaagcugacgcaggagaaucucuggaaucugggaggcagagguugcacugagcugagaucaugccacugcaguccagcgugggcaacaagagcaaaacagaaagggaaagggaagaggaaggggaaggggaaggggaaagggaaggggaaagggaaggggaaagggaaagggaaggggaaggggaaggggaaagggaaagggaaggggaaggggaagaggaggggaggaaagaaaaggaaagagaaagaaagaaggaaacaagggaacaaagaaagcucugcaccugccuauccucucuguaagcccccuaccugucuguggccaaccaaaguccagcacaaggggugggaggcaccagagccagcaucaaugcuaacaccauuccacaagcaccguuucugaccgacacuccuuacggagaagagcgguuuugaaaucacucccuucaaaaaguggagcccgauccuccucccacugaguaagggcuagacagaguuaaggagcagacgaaaucucagcuggugaggaccaggucacacagggcucuguggggcccgcucaugcccacuggggucacucauuaugggaaaucaagcugccacaucgugaacacacucaggcugccccucagggaggcccauguggcaaagaaaugaggccuccugccaaaagccacaugggugaacuuagaagcagguccugcagccccagucaagccuccagguaaccacaaccuggcugacugagcuccaaggaggccugagcagagccuccccaucggccuccgggaccccugagguggcucaggcaugguguuugugagguggcucaggugugguguuugacagugagguggcacaggcgugguguuugugagguggcacaggcguggcguuugacugugagguggcacaggcguggcguuugacugugagguggcacaggcguggcguuugacugugagguggcacaggcguggcguuugacugugagguggcacaggcguggcguuugacugugagguggcacaggcguggcguuugacugugagguggcacaggcgugguguuugugagguggcacaggcguggcguuugacugugagguggcacagucaugguguuugacugugagguggcacaggcgugguguuugugagguggcacaggcguggcguuugacugugagguggcacaggcgugacauuugacugugagguggcacaggcguggcguuugacugugagguggcaaaggcguggcguuugacugugagguggcacaggcgugguguuugugagguggcacaggcauaguguuugacugugagguggcacaggcgugguguuugacugugagguggcacaggugugguguuugugagguggcauaggcgugguguuugacugugagguggcacaggugugguguuugacugugagguggcacaggcguggugguuuuugguuuugauuuugguuuuuucuguuguuuuuguuuuuguuuugagacagagucucacucugucgcccaggcuggagugcaguggcgugaucucaguucaccgcaaccuccgccuccagguucaagcgauucuccugacucagccucccaaguagcuaggacuacaggcgcccaccaucaugcccagcaaauuuuuguauuuuuaguagaggcgggguuucaccauguuggccaggcuggucucgaacuccugaccucaaaugauccacccgccucagccucccaaggugcugggauuacaggcgugagccaguacacccggcggguuuuguuuuuuuuuuaacacaggugugaaguuugaagcugcuggauucaggcuugcuugucccaagaagaggacuaggacagugcucacgcaucuucauugcagagaauucacucgggcauugauaucaagauugagcuggcuagaugcaguggcucacgccuguaaucccagcacuuugggaggccgaggcggguggaucacgaggugaggaguucgagaccagccuggccaacguggugaaaccccgucuguacuaaaaauacaaaaauuagcugggcgugauggugggcaccuauaaucccagcuacucgggaagcugaggcaggagaaucccuuggacccaggaggcagagguugcagugagccaagaucacaccauuguuccauugcucaccagccugggacagagcgagacuccaucucgaaaaaaaaaaaaaaaaauuaagagagggccgggcacgguggcucacaucuguaaucccagcaauuugggaggccgaggcaggcggaucaccugaggucagaaguucaagaccagccuggacaacaugguaaaauccuaucucuauuaaaaauacaaauauuagccaagcgugguggugcaugccugcaaccccagcuacucgggaggcugaggcaggagaauugcuugaguccgggaaguggagguugcagugaccggagaucgugccacugcauuccagccugggcaaaaagagcgaaauucugucuuaaaaaaaaaaaaaaagauggagauuagaggcaacaaagccaacuaggaugaugucucaguagccgaagaggguaucaaggccugaggcagaauaaccggggucaagaggaaggaggacugaaucacagaaacauccagaggacgggacaccagccugggugaccagcgcuugcauggacagggacacgcaggcucagcaagggacccaaagcuggggacagggacacacaggcucagcaagggacccaaagccggggacagggacacgcaggcucagcaagggacccaaagccggggcugcauggaucugagggauggaugccccgcgcagccccaguccuaggggucacggcuccaguucccacacagcggggguuucuccucccagagagaaaccaggcacccaccuaugcaucagacacacacacacaccaugcacgcacacaccacacgcacaccucacacacacaccacacacgucacacacacaccacacacgccacacacacaccacacacgccacacacacaccacauacaccagucacacacacaucacacauaccauacacaccagacacacacacgccacacacaccucauacaccacacacaccacacgucacacacacaccccacacgccacacacaccauacacgccacacacaccacacaugccacacacaccacacacacuagucgcacacacaccacacacaccacacgccagacaccgcauacaccagacacacacaugccacacacacacaaacaccacacacgucacacacaccauacacacacgcuauacacacaccacacgucacacgcacaacacacacaacacacaucacaugcacaccacacacaccagacacacacacgccacauacacaccacacaucacacacacaccacccaccccacacacacgacacacaucacacauaccacacacgucacaaacacaccacacauuccacacaccauauacucuaccauacacacaggccacaccacacauuaccacacacacaccacacacaggccacacaucacacacaccacacaucacucaccacacacacacacaccagacacacccaccagacauauccaauacaccacauauacaccacaccacacauaccacagaccacacaccacacacagaacacacaccacacacacuaccagagaccacacacugcacacacacaccacacacagacuacacaccacacagcacacaccaaacacaccacacacgucacacacacaccacauacuacccaccacacaccacacgcuacacaccacacagcacacacaccacacaccaaacaccacacauaccacagacaccacacacuacacaccagacagcacucaccacacacacccccaccacacacauaccacacagaccacgcauacacuacaccacauacacacaacacacaucccacacacacaucacacaccacacacacuacacacacacaacacauagaccacacaccacccauagacgucacauacacaucacacaccacauacaccacacagagcacacacuacacacaccacacagcacauagcacgugugccacacacacaccacacagcauuugacggcagcccugcccuucucccacccaucuccccaacacaccacacacccggguguccaugagcccugguccugggucuggcgaguccuugccucuacccacaccucacacucuaccggggguaccccauguccacacugagccccaugcagccucgaucaccaacucacccaaccaccuggucugucucccaaggcaucugagaaacccagggccgcucuacauuaggacuguugucuggucaucaauacgucgcuggcaccaucauuccccgccccacaacgugcugagccggcagcucccuccucugcucccaucccuccugguccccguggggccugacacccacgccaugcacaccccaagcccuggcaagcagggacagccugcuugugcuauguccaaagcuugccaccagcuuuccagcauuuacuggcuuccccaggucagcccaucucauagcaaaagaucagagccuucucuaaacccugcucucugcagaaaaguuucauagcagggaagucuggguuuucaacucaccucaagccccccggaagaaucaacuggagagcccacugaucagaagaggcaaagcucacggugcccucagcguggccuaggacuagcguccuggaggacccugggggaucccaccuggcacgccggccacacugcucuccagcucugggcuguggccaggucgaggaggaccugggccaucugugccccuucuccagucacuguccccacaggaugcccaggcccagcccacccgagcaagacagugcagccacacuauggacagcuccacccacaucuacagcccccagaggcagggcaugggcaagccuguggcccggaggauggggcuggggaugagaguucagggggcugccaaggccacaggucauugaggagacaggcugacacugaucccgccccacccuagccacagccccacucggcccuggcugguacucaguuggcaucgggaaguccuguuaauuucugccacugcccaaagcuuccccgacacagaugacccagugagugugcacacagcccacccuacucugucacggcucugccaucucccuccccgagcgcugccgggcccccagaggucucuggugaaugcacucccuuaguaacacagagcaagaccugggaaagccuccucaguccuguuuccuuccuuaacucugugccaaccacggccugugacggggguguggagagguggguggcacugagaaucuucaagugggugaaggcucucuccuacauccagacaguuucugcaggaggugccuguacagucccaaagcgcacaggcgcugcugggcucugagcugcaacaugcacacccaccagcucccacaagagaggaccccgggcucugccucgaauggggcucccaggacagcuuguuacuuccugagccaucaccagaaaaagucaggggacuccccagcagcugaggcggggggcggcucagccaggccagaaacccacagcuccguucugcugccucccccaggccucacugcaagccuggccggccacccugggccguguguggggcucugccucugcgggagcaggcggggugagcugggugcucugacaccaggacaggcccccgaucgcucccacgcacuccagauggcucuccucacuccuuuccucccagcccagagaagaccagccggaugcuaacagccacauccagagaaucagccagccucaccccagcaccgcccuguccagaucuacgccccucugagccccuggaaauaagaaagccucaccugggucauuuucaggaaguccaaggaugggcguguccaccuggcguccuccucacgccuccguuugcgccggcuccucuucccacugagcacgcaaggcugugagcggcaccggagcagcccacggcgcccgcccagcgcaggcguggacguggggcugcugcuggcccagggcaggggagugcccgcacccgcgagucgcuccugugagagggacgggcggcgccucguggagggcaagcaggacuccgcggaacaccagagcgggccugagcccgcacugcccucgcugcuguccacgaagccgccgcuggcggaggacggccggggcguggcgggcgaggugggaccggucgaccacacagcacuccucggcaggacggcgccggggcuucccugccgcguggcacucccgccgcugucgcaccgccucuuggagacuggaguccagaccuuggagcugccggggcgccagggggaccggcagcgcacaagcuccucggguucugacaaggaccggcaaugccgcuuggucgguggggccguggacgagccugugcuuucacugggguccacggugcuggcugcacccaggccugcgccugggcgcggggacuguggcugccacugaagacccauggugugagcggcagcagacaggcccggcaggaaggagaaaucagggcccguggcugccuggcuucugacgggcgguccuccacugaagaccuuccagggacucuggucuacaaaaaaagacacaaagaggcaggggaagagacaggugagccacagggcaggcgacauccaucccggcaaacagccuggcagagcugucaagggcacaaccccaucgccgccaccccugggcgugcuucuccaagauguccguggcgcacaguggacaccagccccgccugcccuugcuggguuagcugcggggcucggcucacuucuuaaaggggacaccgugucugaaggaggugucagccuccccaccggugccucccugagaacaaccgcacggcucugcucucccgacagcuuugcuaaaacauucuucccgcauccucaaaaugccccucucccucugugaccaggcaucucaaggaugugcggcuaccccggccaggacucuccagggccccuucuuaaagcagcucaggucccuuaguaacaugggcaacacagggucacaccugcugccacggucuucagggagagucugagccccagaaacuccucacaaaccucagagccaccagguccaggccuggagccccuucccaagucucacuuccugcacaacuguccugggguugccugucuaacgcgcuccccagcccacugccugcugguucggagaagccuggagagcaaggccaggugcaugggccuggcauggagucugcccaguggcuugugcagucacuguccagcugaggaacuuggaguggaggcugugagaccugccucuggggaaaggcccugggaugaccuuggggugacugggagagagaugggggcuguggggaggagacguggagguguaggcagggagagcggccggcugggugaggaguguaggaagcgcugcggggcucugagccaggauggagguggcuggucugaccccgugugcaggaugaaccccaggaggcugaggugaggacaucgcaccacaggcccggcaggggguggggcucuggccagcuggggccucacacaugcuacuuccaucuacucaugaaagaaucugguaaaacaccuucacuuuggucaucuggcgcucagcaaggugagccuccuaacgggcccacucugcgugacacagggcgcugggcgugucacagucagguaagcagggccaacagagggagaugccccugggaccuucgcugggggaggaccugggaccccaggguuaccuggcccgugaacaccagccagccuccauacucggggcaccugcucuccaucaaugaagggcccaccugcgggugaaccaggcacagccacacccuccacugcacggacagugggugggccgcccaguaugccauggcacgcuccagcugacgcuacaagcccugccagccacgccguccucuucuuuucguggccacagggugggccuugcaccuuccagaaagggcgcagcagaccccugggccccaccagcugaggagggagagaccuggcugggcccgcacccuacacgagccguccugcucacagaccacucuugaccacgggcccagccguuggaggacggcagcagggaccaccccacgccccagugcagggcacacgaacaccuuccugggcuucugcagauccggcucauguucugcguccaggacccucccagcccaggagcccagucccagcccugcucaggccuccggccacagcuccuaaagugcucaccguugagcuccaaagggaacagacgaccgcucuuguucaggguuuccgcagaauacugcaacugacaggaaagagaaguuucaauacugugacugacacgugagaauucggcaauaauaucccccauuuucaucacugcagcacguucuaccuuuccccaguguuuucuuucuagugauuaaaauaagcacaguuuuauuaaaaccuaacaaaauucaacugaguaaauggacaauuuuuuauuuuuuuagauggagucucgcacagucacccaggcuggagugcaguggcgcgaucucggcucacugcaagcuccgccucucggguucacgccauucuccugccucagccucccaaguagcugggacuacaggcgcccaccaccacgcccgguuaauuuuuuuuguauuuuuaguagagacaggguuucaccguguuagccaggacggucuccaucuccugaccucgugauccgcccgccucagccuccuaaagugcuggaauuacaggcaugagccaccacgcccggcuguaaacggacauuuuuaaauuuuuuaaaaaauuuuuucuguuuuuaaaagagcuguuaacacuaagcagacuuuuuuuuugucuguuuuugagacagagucucgcucuguugcucagacuggagugcaguggugcuaucucugcuuacuacaagcucugccucccggguucacgccauucuccugucucagccucccgaguagcugggacuacagaaagcugccaccacgcccagcuaauuuuguuuuuuuaaauauauuuuucguagagacaggguuucaccgugucagccaggauggucucgaucucuucaccucgugaucuucccgccucagccucacaaagugcuggaauuacaggugugagccaccacgcccggccucagacauuuuuauuccaagccacaggcaugcauccugucccugcuccugaagcucaggcccuccugccuuucggcagccucagcugcagccgucuuugcaaaccucaccacuuacuuacuuuucagcaagaacuucagccaagacccaaggggcccuuucccaccugcaacagcucagacacgggaccugagcgccuaagccaggcucuggaguguggugcugguccagggagacguccagagggcagggucucccucccuggaagcaggaaagccacagggcgugguggcagcuggagggucuauagggagggcacuaagggaaaugccacagggcucucuucccuaccccaugaagugucagggagcugcuuggcaggucacggcuuggaggccauuaaugugucugcuuccacgcacuggcccgugcaggcgggacacagggcccugcagaggauggggcacaggagggggguccugccgggugcccggcaagcucccuaaccucccagagcuuccucgucugugagaacacagaaggccacccugugacaaggacacggcugucccgcaggguccgggcacagcagccccucugcuuuuuugccuuagaguuguggggcuccucugccacaccucagaaccucucaguuaacgccuaagcccauggcaucacguccuaugauaacauuuccaaacacgauaaaauuaaaaggaaauccuucacugcuuccuguaaagggaauaaguuaaaaguuggguuugugaccccgaaaaaagacaggccgccuacacacggggucccaccucagccagcacggcgguguggagcugugagcacccggccacaccaugaggacagggccuggugcgggcccgggaaccacacgaccuccagguucucccaccccgggacccggguccgauggaagagaggagaggcagcucugcuaaaggacuugaaggcuuucacgccacagggacccuuguugcugucgauccucccagccccgggccuccccgcagcaagcaccaggaccucgcucuccuccuguuccgcacagcacccguuccccggggccacaugaacagcacccagcucgacgcugccacggaaaaacgucuagcaaggaaaggacuuucccagccggcacagauggcucucacgggcagcuugaaggagccacaggcccgcacggucccaaaugugaccaccucuaugcaaagacacgccgggggcagcagcuacucccaguggcacuggccgugugggaugugggugcagcagacaaacagagccaggguccccgggagacaggaaaggcugggcagccaggucccacaggcucaggcagggggcuugucaaaaacacuuauuccucacaguccuggaggcagaaguccaagaucaagggacaggcagauucagugucugguaaggccaccuccugguucacagacggcucuuccgguuguaucuaugcauggucgaaggggcuggcuuccucucugaugccucucacauaugcgcacuuaauuccauucaugagggcacugccgccaugaccuaagcaccucccagaggccccaccuccaaauauucaucccgucaccuugagggugaggacuucaacauauggguuucggggaaugugaacaugcaacccuuaagccuaaggaaaucuggacuucagggcugggcacgggggcacacaccugaaucccagcacggcgggaggaucgcuugagcucaggaguuugagaccagcguggccaacauggugaaacccugucuuuacuaaaaauacaaaaauuagcugggugugguggugggugccuguaaucccagcuacuugggaggcugaggcaggggaaucgcgugaacccgggaggcagaggcugcagugagccgagaucacaccacugcacuccagccugggcaacaagagcaagacuccgugcagaaaaagaagaaaaaaacgaaaucuguacuucagggccggacacagggaaauccgggaaaucccagcacugugggggcugaggugggaagaucacuugagcccaggaguuugagaacagccugggcaacacagggaaaccuggucucuacaaaaaaaaaagcagauaugauggcaugagccugucauuccagcuacucaagaggcugaggugggaggauugcuugggcuagggaggccaaggcugcagcgaacgacugagugcacugcgcuccagccugggcaacacagcaagacccugucuuuaaaaaccuaaaaguuuuuaggcugggcacgguggcucacgccuguaaucccagcucuuugggaggccgacacaggcaggugacaagaucaggagaucgagaccauccuggcuaacacggugaaaccccaucucuacuaaaaauacaaaaaaauuagccaggcgugguggcgagugccuguagucccagcuacucaggaggccgaggcaggagaauggcgugaggcagagcuugcagugagcggagaucacgccucugcacuccagccugggugacagagccagacuccaucucaaaaaaaaaaaaacuaaaaguuuuuuaaaaaccagcucucuaccaaucaaucccagccuguaucugcacagcugcacagggcuggaggacaccacagcccgccacccacccauaccgugcccgccaggccagcggcacagugagcuucccugcgccuacagcccccagcacagccccaucacaccgccuccucucuccccuacccugacauucucagcucucccugcucuccgccccucagcccgggaacugcugcucugguccuggcugccgcggcccucuacucugcccucuggacuccugagagucagaucccagaugccugugcccccaggcucccacccucacaggcucccacggccaugggaaccuccaccuggcugacuccccagauguccauauggcucaucacccaccuuccagcuccacccggaggucacagcccggcgcccuauguaaacucccagcaccccuugggcucuacuuuuuuccugaugcacuaucgcgacuccucagucaccugcuucccacccgccucccugcaggaagugagcaccauauugcuaacccagcacagccagugcagcacagacgccccaacgcgcugaaugaccuucacacgugaccuucaggcccuaccgccuccuggcugcugucccgggcucucuggggaagccccagccagagcacagugagaugcuggccccacccacccauccacgucccccucccuguggccccaauggccuuugcccaccccaacauuaagaccccgcccaucuuccagcacucagccaccauuacaccuccaacccucuuugcugcuccggcagcucagcgaggcacccgugcccacuccccucccaccgccucaugccugugguuacuggucgucuguguaggucccccaugaggacacaacccuaaaaaucacgucaugauuugcauuaggacgcagcauuccuccacaugguuacacagagugcaccuccaugccacggagcaccucuugguggcgcagaggaaccgccggacggaucuccagggaagcaugcugauggaaaggcagaacccaaaugcuugugcacugugucacuccauuuacacaccacucucgagaugacagaaugacagaacgggggaagaaaccauaaagaacucuuacuggccaggugucauggcucacaccuguaaucccugcauuuugggaggcugaggcgggaggacccauugagcacaagagguggaaaccagccugggaaacacagugagacccccuuucuaaaagauauaaauuuuuaaaaaauagcuggguguggggugggcgugguggcuguaaccuguaaucccagcauuuugggaggccaaggcaggcggaucacaaagucaggaguucaagaccagccuggccaacauggugaaauuccaucucuacuaaaaauauaaaaauuagccgggcgugaugguggaugccuguaaucccagcuacucaggaggcugaggcagaagacucucucgaacccaggagguggagguugcagugagccaagaucgcaccacugcacuccagccuuagcaacaagggcaagauuccaucacaaaaaaaaaaaaaaaaaaaaaaaagcuggguguggucacacaugucuguaguccuagcuacucagaaggcugagggaggaggaucacuugagcccaggaggucgaggcugcagugagcagugauugagacccugcacuccagccugggcaacaaagcaaggcccugucucaaaaaaaaaaaaaaaaaggguucuuacaacucaaaaauaaaaagagaaauaacccaauuuuaaaguaaaaaugggauuucauuagauauuucucaaaagaagagauacaaauggccaaugagcacaugaaaauaugcucaacauagcuaaccauagggaaaugaaaaucagaaccacaaugagauaccacuccacacccaugcagguggcuuuuaucaaaaaaauggacaauaacacgcguugaugagaguuggagaaauuagggccaggcacaguggcucaugccuguaaucccaccacucuggggggccgaggcaggcggaucacgaggucaggagauugagaccauccuugccaacacggugaaaccccggcucuacuaaaaaaaaaauacaaaaaauuagcugggagugguggcaugcgccuguagucccagcuacuugggaggcugaggcgugagaauggcgugaaccugggaggcagagugagccgagaucgcgccacugcacuccagccugggcgaaagagccagacucugccucaagaaaaaaagaguuggagaaauuagaacucucauacauugcugcagaacggaacaugguacagacacuguggaaaacaguuuggcaguuccucaaaauguuaaacauagaaucaccauaugaccuggcaaucccacgacuagguuugcacccaaaagaaaugaagaccuacuuccacacagaaacucauacaugaaacuuccacacagaaacucacacaugaauguucacagcugcauuaucccuaauagcuaaaauauggcaaccacccaaagguccaaaaacagaggaacggaugagcaaaugguggucucucaaacacgaaccugaucgagcuucgagccucacagcacugccugcgagaacauucuguggugagggacagccaacaggcuguccaccacggcagccaccagccacccagagacagugagcacuagaaguguuucugguacaagugagaaacagcauuauguggguuccacuuuaacuguaggcugggcgcaguggcucacaccugcaaucucagcacuuugggaggccgcauaaggagggucacuugaggccaggaguuagagacuagccugggcaacacagcaagaccccgucucuaccaaaaacauucacaaauuagugagacccugucuuuaaaaaaaaaaaaaaaaagcuaaaucaacuuuaauuucaguuuaaaaaucuaugugcaacuagaggaaaccauaaggggcagggcagugcucacuccaaccagcaacucccagaacacacaugggaggggagcgcacgaggcggcagccggggcaugcagccuggacacuccgggacaagcagcuggguccucaacacacaagcuccaaggagcacccuauggggaaaagggacaugagacacccugaaucuggacucccugaacaaauucuuaaacucagacaauuggagaaguuugaaugcugaccggauagagauauuaaggaaucucugagaguuuuaggugugaaaaugacauucuggucaugugucuuaaagucuuuaucuuuuggagauacagagugagauauuuacagagaaaguaugucuagaaugcgcuaugaaaucauggcaggaagggacuggguaaaggcgcagaucaaacaaggagcccugagcuaacagcgcccgccucgcuugcucacugaggccgggccauggguauguaugaagacauacuuccacacagaaccucauacaugaauguacgaguugcuacucucuagaacugucuacacuuauuuuucauaaaaauacuauuuuaagucaccuuugaaaacaucaguuucuauuuuuauacaaugaauuggcuauuuaaaauacugacuuguuuccuugaauguuagaaguaacuuguguuuagauauucaguugacaugggagagcuggucucacguguaaacaaucuaucacugaguaacuggguuuccucaacacaggcaaucacacuguccgaauuacacagauuaaaaauccuggccaggcacgguggcucaggccuguaaucccagcacuuugggagccugaagcggguggaucaccugagguuaggaguucaagaccagccugaccaacauggugaaacccugucucuacuaaaaauacaaaaauuagcugggcuugguggcaugugccuguaaucccaacuacugaggaggcugaggcaggggaaucgcuugaacccaggaggcggggguuacagugagccaggaucgcaccacugcauuccagccugggcaacagagugagacucuugucuaaaagauaaaauaaauaaauaaaugaaaaauaauuuuuuaaaaaauccugauaaaggcugggcaugguggcucaugccuguaaucccagcacuuugggaggcugagguggguggaucacuugaggucaggaguucaagaccagccuggccaacauggugaaaccccaucucuauuaaaaauacaaaaaaaauuagccgggcgugguggcgcaugccuguagucccaccuacucaggagacugaggcaagagaauugcuugaaugcgggaggcagagguugcagugagccgagacugcaccacugcacuccagccugggugacagagcaagacuccaucacuuuaaaaaaaaaaauuaaaaaauagguugggcaugguggcacaccccuguagucccagcuacucgggaggcugaggcgagagaaucgcuugagcccuggaagcggaguugcaaugacgugcgaucacuccacugcacuccagccucggcaacagggcaagacuccaucucaaaaaaaaaaaaaaaguaaaaagacuuacauuuagggauaaaaagguuuguccuccuuuuucagauagaaaccaccgccauauucacaggccguguuuuaagaaaacaggagucauugggaaaaaccaucuucgacagcaacagacucaacaguggcccuggcuggccacuaacagagccggcagggucagcaggagcaggagcaggcugugauggaacccccgugaccacucacccuguagggcucccagggcuccugucccaaggccgaggccuaccaaggaacugccuaugcugccuucucugucaauggacaagugcuccacaaagagaugaagaaugggagggagggaggaggcaggggcugaagagcuaccuacuggguacugugcucacaacccgagugcaauauagccaagugacaaaccugcaccugcacccccuguaucuaaaauaaaaccugcaccugcacccccauaucuaaaauaaaaccugcaccugcacccccuguaucuaaaauaaaaccugcaccugcacccccuguaucuaaaauaaaaucugcaccugcacccccuguaucuaaaauaaaaccugcaccugcacccccuguaucuaaaauaaaaccugcaccugcaccccuguaucuaaaauaaaaccugcaccugcacccccuguaucuaaaauaaaaccugcaccugcacacccuguaucuaaaauaaaaccugcaccugcacccccuguaucuaaaauaaagccugcaccugcacacccuguaucuaaaauaaaaccugcacccccuguaucuaaaauaaaaccugcaccugcacccccuguaucuaaaauaaaaccugcaccugcacccccuguaucuaaaauaaaaccugcaccugcacccccuguaucuaaaauaaaaccugcaccuguaccccccuguaucuaaaauaaaagcugaaaaaaaaagaggugaagaguggccaccuaaagcacagaggucgugggggcccgugggucaccccacaccaggacauccguccagacaccucccaggcccggcaggcaugcugcguagccaccucccuggaaagcugcgcacgcccuggcugacguccacuugccaaaaauguccucagaggcacacagccaucugauaggcaugugccgcucuguauccuuuggucuugguuagagacaccuuaaaaauguuuucuccauuuaaucaaaaggaaaaauggggccaggcgcaguggcucacgccuguaaucccaacacucugcaaggcugaggugggcggaucacugaccagccucgccaacauggccaacauggugaaaccccgucucuacuaaaaauacaaaauuuaggcugggugugguggcucacgccuguaaucccaggacuuugggaggccgaggcaggcagaucaugaggucaggagcuugagaccagccugaccaacauggugaaacccugucucuacuaaaaauacaaaaauuagccaggccugguggcgugcaccuguaauccuagcuacucaggaggcugaggcgggagaauugcuugaaccugggagguggagguugcagugagccgagauugugccauugcacuccagccugggcgacagagcaagacuccaucucaaaaaaaaaaaaaauacaaaauuuagccgggugugguggcgugugccuguaacguuagcuacucgggaggcugaggcacgagaaucacuugaacccgggagacggagguugcagugagcugagauggugccacuacacuccagcauggaugacaaagcaagacucugucuccagaaaaaaaaagaaaaaaugagaaccggccacagcaucuggaaagaacauggcucugcagccagcaaggcacugagacaucaggcaagcacugccuuccccgccucggccaccuccacccguggacugacagccggaaacguacuaauuacaggacacagccagcgcugccacggucaccucagucacagcggcccugagugccaggccccacaagcagugcuugcgaagguucaggccacaugccaccucccacagcccaacacccacacucgccagcucucgggaggagaggcuucagcuuggacccucagacccucacuggaacccccugcggugaagaugggucacacgugcccaguccaaaggcccgagacccacagcuuucccuucacccucucauuuccguaacacgcaaggggcuacaaaugcaacgugcccacgucuccagagccacagccaagccaggcccaggauaggcaggcgcuccaagcaccccugcuggcucugagggccuggcaagacccuccaggcuagacaucagccaccuccuucuggaucugccaucuaacuagggcggggggguccugaagguggcacauccaaaguucacuucaccaugacuguaggaaaaucaagcugcccgcaggaagcuaacguggugaucaaauccaagacagaggcucccuugggaggcgcggcuaggaggggagggacagggagccuggcggggugcagucugcugcuugauuggaugguaacaggcacaccugcgcuuggggcuccagcuucuguguguaagucagccuuucaguaaaacucuauuuuuuuaaauagcaagucaaggcucuuuuuuuuuuugagacggagucucgcucugucccaggcuggagugcaguggagcgaucucggcucacugcaagcuccgccucccgggugcaugccauucuccugccucagccucccgagcagcugggacuacaggcgccugcuaccgugcccggcuaauuuuuguauuuuuaguagagacgggguuucaacauguuggccaggcugguuacgaacuccugaccucaagugaucugaccgccuuggccucccaaagugcugggauuacaggcaugagccaccacgcccagcuggcauuuuuaauaagucuauuuuuuuuucaaugauggugaaaauccgcugugauuacacugaugggcucuggggcccacaugugcaccagacacccccaucccuggcccagcagggccccccaggccccugagaacuuagcccucaccuccaccucccaguguggccauuccccugugacagcacgggggaggggcacccagccuggugccaccugcagcugcuuaccgggccagccuccgccuugcaggugaggucguccaggcucuggcucugcagcuucucagugaugagugugaccauggucggggccccguguccuccguccacaccaacaggcacuggaguccuggaacaucagacuugcgaaggccccagcauugcugggucagccaaaucucaaggucaugucuccacuuucuuuacagaugagcaguccacgcccacgggcucuucaggauuugugccuguuucucagaagagagaaaucaucaugugauuauacgcaaaaccauuuuguugauguuucugcuacauguuggguccccucuguauaaaguauuucugauaucccaccucacaaacacccucccauuuucaaaacuaccacgcgaguucucuucuggaaaaucuaaucacgguggucuucuggcuaaaggcaaagacacacauuagacccacccgccccggaagccucaacugaaagaagaagauaggccaccccaggccucugcuccaaaaaagaggaaacaggaugggagaugauggcaaggacauucuggaagcugggaagcugcuggaaagccaauaucaagccaggaacacagaaacucugacuacccacccccuucugcuccaaguggccaaacaccccucccgcucccaugccagccagcuaggcaagcgcuccacacugaagcuggggcacaggaagccugccagggucugcaccuggcgugcugacagcaaggggccggcggaggaagggcgagggcucagggggucuuucaggcucugagcucuccagccucaggagugggcagauccgucuguacugcaggcagaggcugcggggcggccccagggcugcucccaacagacaccaaccagccgaggugcccagcaagguggcccugcacccagcguguccccaaacugccccggcuuugacccuucucagggucccacuguugggugugagcagcugccaaggacaccuaguucagacccaacagaggccaaaacagacaaggugcaaacaagcaaaaccagcaacuuggagaagagugcuaggugagagggcaaggccuuccucagcagcagcccucugcccucggagugauacggcaccuccaugaacaccaggacacccucaaaaaggaacuuccagagaaaaagaagagugccugggaauuaagacagcagugacggaacguccacacaaccuccagggugugcguccucagcugccgcccggcuucaguuuccggccagucuucuggggcccacagacugcuccuaggcaaggauuaagggcggacaggacgccaaagcccaggccucaccaccaccaaugaaggcaacccguaggcagcaccgcucaggagcaucugccccaaaagccuggcacgugggagccacgugagccgccccaucagaaggaccgcccggccacgugggccaugcuaggaaggcaggcggcauccaaguucacuacaccugccaguaaaguaaaagggcaaaggagacucacacgcacacuucugccaaugcuggaaagguuucaacacgguucgauaccugcguuccacgcuuaaaauguacacacacaaccgcucucgacagaaaccaacaugcacuucccuagagcccaaaagccagcaucuuccugaaugagggccagggcaaaggcgccaccaccaacacagcagcgacgcgcacagugggccacccagccuggcucagagccuucccgucaccaggcacagccccgcugcugccagguccaggggacugggcagaccaaacccaggcagggucugugcacagguccugacgggugccacccacccauggggcuguuccaggccaggggacacaccacaucagcuaaaggcugugcccgccuggcucacuggaucugaaaucgcgugcucagcacugaccacucccaccacccucggcagccaccacugucaucuccagcccacagccaagaaccccagacuccaagaggggugucgugcacugggcuagggucagccgggcccacuugugaugcuucagaaggaggccucuccacagcaguggcuccauucaaauugucucaaacuaaggagcacaaaucagagccagccacacugcacaccccacgcuggucgaugucagcuggggaaaaaccaccaguaacuggggugccagcucacagccacagcccagacucaccucugucccagcgucagagcccccagcucacagccacagccgggacucaccucugucccagcgucagagcccccagcucacagccacagccacggcccggacucaccucugucccagcgucagagccaacagcucacagccacggcccggacucaccucugucccagcgucagagccaccagcucacagccacagccacggcccggacucaccucugucccagcgucagagccaccagcucacagccacagccauggcccggacucaccucugucccagcgucagagccaccagcucacagccacagcccggacucaccucugucccaccgucagagcccccagcucacagccacagccacagcccggacucaccucugucccagcgucagagccaccagcucacagccacagccacggcccggacucaccucugucccagcgucagagcccccagcucacagccacggcccggacucaccucugucccagcgucagagccaccagcucacagccacggcccggacucaccucugucccagcgucagagccaccagcucacagccacagccacagccgggacucaccucugucccagcgucagagcccccagcucacagccacagccacggcccggacucaccucugucccagcgucagagccaccagcucacagccacagccacagccgggacucaccucugucccagcgucagagccaccagcucacagccacggcccggacucaccucucucccagccucagagcccucacaggauggggcucuauggcugacaagccagccucccucccuaaucccaccaaccacuccugcaaggugaggggccagcucccuucacaccgugcaccacgaggggcugcacacccaccuuccaaacccuccugauugcacaaagcacacacacaacccuagaaaggcaacagcagccacacuauaacuugaaaaaauaauaacuaggauuuuauuuuaaaaacaggccucacagucuguauagaaacggcugauuucagggcuggggcagggaaaagagcuggagccuguugagguacaggaagugaggauggcuccccagcagccugccugugacacagagcaaagcgagcagcagugaacacaggcacccaggaacccaugaaccucagaacccaggaacccauggacccacagacccagaacccacgaacccacgaacccaggaacccacagauccaggaacccagggaccuagggacccaaagacccagguacccacagacccaggaacccaagaacccacggacccacggacccaggaaccaggaacccacagauccaggaacccaugaacccaggaacgcacggacccagggacccacagacccacaaacccaggaaccagccacccacagacccaggaacccaugaacccauggacccacaaacccaggaacccauagacccauggacccaggaacccaggaacccacgaacccacgaacccaggaaucaggaacccaggaacccauggacccaggugagguggggguggcgggaagcgccuccucacggggugguggggagccacuagugagugcagagagaaugagggaaaugcuuuaaaaucaccacuugaccaaugucccaacacaacagucucaggcaagaugcauccaugaugcuggacccgcagagaacguauggcgagaaacagagcucacagccucagagugauccccaaaagaugcucggcagccaccaaggaaaaacaguaacagcagguuugcccggaaggcaccugaacccagcgaucaaugugaacaccccgagagccuccugugaggugcccaggacacaaacacaggaaccugaauuuccuuuuuuuuuuuuuuuuuuuuuuuuuuuugaggcagagucuuucuccaucgcccaggcuggagugcaguggugugaucucggcucacugcaaccuccgccucccggguucaagcgauucuccugccucagacugccaaguagccgggauuacaggcacacacuaccacacccagcuaauuuuuguauuuguaguaaagacagcauuucgccauguuggccaggcuggucucaaacuccugaccucaggugauccacccaccucagccucccacagugcugggauuacagguauguaucaccaccacgccuggccuggaaccugauuauuuaauucugaagaaaugucagacaaucucaaaacaggccaacucuacaaaaugaccagccagagaucuucagaagcauggagucaagaaagagcucgacgaggcccugcccagacuggagggggucccaaugcagcacgugacccugggucagaaaaacggcagggaggacaugucccaaaucugccucagcaccgucagaugccagcaccaugccacacugaugccacacuccuggcugugacuacugccuguggucacgugugaugugaacgccuggagggucugcacgcccucgacagagaaacgaugacgugugugcaagagucacacgcucauaacucacagacuuuaaaacaucagacaggcugggcgcgguggcucaugccuguaaucccagcaccuugggaggccgaggaggguagaucaggaggucaggagaucgagaccaaccugggccaacauggugaaaccccaucucuauuaaaaauauaaaaauuagcugggugugauggcgcacaccuguagucccagcuacucaggaggcugaggcaggagaaucacuugaaccggguggggcagagguugcagugagccgaaaucacaccacugcacuccaguguggugaccgagcgagacuccguuucaaaaaaaaaucagauaaagugugcccgccaagcaccagccagggcaaguguccagcagcgccaaugcggagcacccagcagugucaaggcagcagcucuggcacgcgggaggcgcaugcagcgcgggagggaccacgccuacugccaaaagcagcucccugcugggagcccaggagacgacggggauugugagugcugggcagggaagagacccucguguggaacaugcauuuccugcaggaaggaaggcguuagucaggucaucaccgacacguguguuggcuuccaagaugccagcagggccguuauaacaaucucccauaacugagugggcuucaaacaacaaaaguuuacucucacaguucuggaggccggaaguccaaaacugagguaucaacaggugccuccuucuggaggcugagggggaaccuguuccaggacucucuccaguuuccaggggcucugggaguccucggcaguuccuggcuuauagcuguaccacugcaaucucugccucugucaccaugcggccuucuccccagcgccacagagucucuguaucgcuaucucuucuuauaaggacaccaaugauuggguuagagccgacucuaaucauaugacuucaucuuaauguacauuaauugcaaaagcaucuggccgggcgcgguggcucacgccuguaaucccagcacuuuaggaggccgaggcaggcaaaucacaaggucaggaaaucgaggccauccuggcuaacacggugaaauccugucucuacuaaaaauauaaaaaauuagcugggugugguggcacgugccuguggucccagcuacuugggaggcugaggcaggagaauugcuugaacccaggaggcggagguugcagugagccgagaucaugccacugcacuccagcuugggcaacagagugagacucugucucaaaaaaaaaaaaaaauuacaauagcaucugcaaagacccuauuucuaaauaaagucacauuugcaaguauuaggggugcagacuugaacauaaccuccugggggaugcgauuccacacacacaaugucaggcccgucuccccuuacaagaaacugagccaugaggaugcagcaccagucacgaggcaugauggacagcaagucccucccccuuggcaguucugaggccagucuccagucugcgugagggaagucuggggaaggagcaguucaggaccagaggaagccccugccggagcugggaaagcccagagauacagaaacagugacggaugguggcagugagaaggaugccguaggaccccaccauggcaggacagccuuuucgaggggcgaucagagaggccccucuaaggcagugacauugaagccaggacugaaagcuaaacaagagggucccggaaaaggagacaaaggccaggacaagugggaagagaccucuggguuccagguagauguagaagagacgugggaagugagagaaaccuggcucccgcugccagaacucacugucccugccaccaacaggugaggagugggacccagcaagaacaaagaggacauaccaccugagcuccgggaagcacagccggcaucaggcaucccuugccccuacuccaggaccucucggcgccggccccuccaaacaggaaguggucccucccaagcccacgagcacugcccugagcccaggugaugccuucuccccacacuaagugggcucacuucagaggacggcuacaacgaacucacuuccacuuuucuggcauuaagucgccguccucgcucccaaaggcuccuuguaacugcaccguaaaucccuuccuuguaacugcacuggugacuuagccgacaaccccaggagguuucccugccucucguuccaccucugcacccagcucaagccugauccucaaggucuggaggaccgcagcagccuacacucauucccauacacugggcaacccuuggcccgaccucagcggaaagcagaucacaaugcucuggcccccagaaacagccuccucagcccuuaggacagaggccaaaauccucacccugguccuccaacucccccaucuucuccccucgcuccccaggaucuggccacaccagugcccugcagaccccuaggagggucaaacccagagcuggagcuccacgggggcagcagggacgagcccccaccacaggcagugccucagcucagauggccgccucacgggacagcggcaaaaugcccucggcuggcggcucuggccacucucauucuccaggacuccauccuccaaaaaggcaccaaagcagguucgauuuuucuguguuuuaauuuaauucgauccacaugcagucagauacagcauuuguagagccaugaauuagcuuccuauaaccaagaaucacaaagugguggcuuaggacagaaacgcacuggccagccguccuuggaggcugggaguccaggaccaagacgccagcagggccaugccccucugaaggcucuggggagggacugaucaggccucccucccggcucuggcaucacuccagucuucccaccgcauucucccugcgugugccugugugcaagucuccccauuuuauaaggauaucagucauuuuggggcaggacccaccaugcuccagugugaccccaucuuaacucauuacaucugcaacaacccuauuuccaaguaagugcacauucugaaguacuggggggggucaggacuucaacaugugacuguuggggccggaccucacucaaccccuaaaacaagcuguauuuuauuucaccacggcgacacacacagggugcuggcuuacaaaccaauacugagcuacucccaaacgugcagaggccucaccccugccacuccacaguggccacuuccaccccuucagcccuguccuuggguacuuacuacacccaugcacacagcccgcagacacugcugcuccuggacugugccgcagcgcgccccucugagcaucaucugcuggcuugaaggcacgucacgguguaucucuuugccaacacagccccaccccacaccucccaauacggccgugugaacauuuugucaagucaucgcugacauuaucacgucacuauaguguuuccaguuaggccacacaguggggucuguucuccaaaguucauaauuccuuccuuuuuacaagugcaaaguuucugccuaguauaaacucuugccccaaucuccccagcagauuuauaaaccuccuaggaauaagcccuuuggucaaagacaucaggacaccuucagcccuuuugcuccuggagucccaccuugugcucagcacuggcggggcugugcucuagcccacucggggcaccccucccccucaucuugcagcuuccugagaaggggggcacgugaagaccacaccucuucucuccuccacuucuguaagaagcccacucccaggaugccugcucagcuuucagggucuucucucgccccaacuuuagaaaaugcucaaggcgccucaagcaaggucuuccuugguccagagaccacguccuuccagccuggcucauggcgcacucugcaccccacccuggucugcaucuccgucuguuccuggacuccgugucccacgcuugcugcuguugccgcuguucuaggaucuauccuccgcuccuccaacccuuccaaugacguguguaugcuucacccccaagggcucccuccucuucuccaaaugcccaugucgggaccugucuucacgcuuaucucuaagccuacauauacagggcugcuuuucaugggggguuuuaaauuacuuuuucuggucccugcacucuguaucucagcucccuuagucuucucugcuuuuccuggcuucugcuuucacacuggagguuuccucugauguugcucacucuggcucuccauucacacagagagggaagagcugucaacacgcugucucacugcagagggauacaguggccguguccucccuucagauggcaagagaacucacccugagaccagccuggccaacauggugaaaccccaucucuacuaaaaauacaaaaauuagccgagcgugguagcaggcgccuauaaucccagcuacucaggaggccgaagcaggagguuugcuugaauccgggaggcagaggucgcaaugagcugagauugcaccacugcgccccagccugggugacagagugagacuccaucucaaaaaauaaauaaauaaaguuuauacagagaggcaaacaacccagaauagcccacaugauauuacaggagaagaacaaaguuggaggacugacacuauucaacucuaagacuuauuauaaaauugcugucaucaagaccgugugugcccaggcacagcggcucacaacuguaaucccuguacuguggaaggcuugggcccaggaguucaagaccagccugggcaacauagcaagacuccaucucuacauaaaauuuuaaaauuaccugcgugacuacaauccuagcuacuuagaaggcagaggugggagcacugcuucagcccgagagguggaggaugcaaugauccaugauugcacugcugcacuccaaccugggugacagagcaagacccugucucaaaauaaaaagacagugugggaugggcaaaagaacagacaauuguaucaauggaacaggcagaacagagagcccagauauagaaccacacagucacugaucuuugaccaaggagcaaugguaauacaauagagaacagagagucuuuucaacaagugcugcugaaaaacuagacauccacaagaaaaaaagacaugaggccgggugcgguggcccacgccuguaauccuagcacuuugggagcccgagguggguggaucauuugaggucaagaguucaagagcagucuggccaacauaguuaaaccccaccucuacuaaaacuauaaaaauuagccaggcgugguggcguacaucuguaaucccagcuacucgggaggcugaggcaggagaaucacuugaacccgggaggcaaagguugcaaugagcugagaucacaccacugcacuacagccugggcaacaaagcaagacuccaucucaaaaaaaagacauggaguguauggacccccuucaugaaaacuaacucaaaauggaucacagaccuaaaguaaaaggcaaaacuauaaaaauccuacuagauagauaacacaagagaaaaauauagaugacuuuggguuuggcgaugacuucugagauacaacacugaaggcacgauccauaaaagaaagaauuguuauguugaacuucauuaaaauuaaaaauaucugcucugcaaaagacacugucaagagaauaaaaaacaguuccagacugaaagaaaauauuugcaaaagacuuauuugacaaagaaccauuauccaaaauauaaaaagauauuuuaaaauucaacaauaagaaaacaaccccagccuggccaacauggugaaaccccaucucuaccaaaaaacuacaaaaauuagccgggcgugugggcacacaccuguaaucccagcuacucaggaggucgaaguagaagaaucacuugaacccaggagcugagguugcagugagccaagaucaugccacugcacuccagccuaggugacagggugagaccaugucuccaaaaaaaaaaaaaaaaaaaaggccaggugcagugguucaugccuguaaucccacuuugggaggccaaggcggguggaucaacugaggucaggaguucgagaccagccuggccaauguggugaaaccccaucucuacuaaaacuacaaaaauuagccuggcgugguggcacgcaccuguaaucccagcuacucgggaggcugaggcaggagaaucccuugaacccaggaggcggagguugcagugagccaagauagcaccacugcacuccaggcuaggcaacaagagggaaacuccauuaaaaaaaaaaaaaaaaaaaagaacccaacccaacuaaagaaaaaauuggggcaaagacuuucacagaccccucaccaacuggggccgggugugguggcucacgccuauaaucccagcacuuugggagaccgaggcggguggaucaccugagaucaggaguucgagaccagccuggcccacacaucgaaaccccaucucuacuaaaaauacaaaauuuagcugggcaugauggcaggcgccuguaagcgcagcuacucgggaggaugaggcggcaguugcagugagccaagaucgcaccauugcgcuccagccugagcgacagggcaagacuccgucucagaaaaaaaaaaaaaaguccgggcacgguggcucacaccuguaaucccagcauuuugggaggccgaggcagguggaucaccugaggucaggguucaagaccagccuggccaacguggagaaaccccgucucuacuaaaaauacaaaauuagccgggcaugguggcacaugccuguaaucccagcuacucgggaggcugaggcaggagaaucauuugaaaccaggaggcggagguuucggugagccgagaucgcaccauugcacuccagccugggcaacgagagugaaacuccgucucaaaaaaaaaaaaaaaaaaaaaaaaaacacaccacuacacacaagguaccacuacacaccaauuagaauguccaaaauccagaacacugacaacacccaagugcugaggaggauauggagcaacuguguacaugauccagcaauccugcuccuugguauucacccaaaggaacuaaaaacuuauguccacacaaaaccugcacacagaugcccauagcagcuguauccauaagugccaaaacuuggaaacaaccaagauuuccuguaggugagcagauaaagugugguacauccagacaguguaauauuauuuagcacuaaaaagaaaugagcuaugaaaccaccaaaaaauacagaagauauuuaaaugcaugucacuaagugaaagaaacgggucugaaacggcuacguauuguauaauuccuaccauauggcauucuggaaaagguuaacuguggagacuauuuaaaaaaacaaacaaaaaaaaaaccguggcugccaggggccagggguagagagaggugaggcagggcacagauuuuuaaggcagugaaauuauucugcaugauacuauaaugguugacaaaggucauuacacauuugucuaaauccauagacuacaacaccaagagugaaaccugaugucaacuauggacuuuggauaauaagcauguguccauguagguucaucaacuguagcaaacguacuacuccggugggggaugcuagucauacaggagguccugcaugugugagggcagaagguauagugucuagcaacucgauuuuuuuuuugagaugaaguuucgcuguugcugcccaggcugaagugcaacggcgcgaucucagcucacugcaaccucagccucccgaguucaagugauucucccacgucagccucccaaguagcggggauugcaggcacccgccaccacauccagcuauuuuuuguauuuuuuaguagagacgggguuucgccauguuggccaagcugcucuucaacucuugaccucaggugaccuacccaccuuguaggguccagccccacaaggucgauggguuucuccccgugucucagccucccaaagugcugggauuacaggugugagccaccacgcccggcugaacucgcuauuuuuaagugcacugaaaccacauucgaaguguuccuuuugcaacccaacaaaggagaagaaacucaaaucuuuuuuuuuuuuuuuugacaugaagccucucucuguugccuaggcucacugcagccuccaccucccuggcugaagcaauccucccaccucagccucccaaguagccaggacuacaggugcacaccaccauacccagcucauuuuuuauuuuuauuuuuuguagaaaugggggucucacuauguugcccaggcuggucuccaacuccugggcucaagugauccuccugccucagccuuccaaaaugcugggguuacaggugugagccaccaagccuggccaagaaauucaaaucguaaaaugaagauuaucauuguaaccacuccacuggugagaacaggcugcaccauaucaccacauggaaaaagauaaacugcaccaaguaauuucauugugagguaaagaacacaaggugagcucuggacagcugcacaaagccccggguucagacaccaguugggcccacucacuagccaggccaaggaacuucaccuggacaaguaaccgccucuccaggccuggguuccuuggaaacugaaaaugagaagaaaccacccacuucaugaggcuccaaggaaucagauuaaacuacauaacacaugugagaguuccugagucccugacacacauuuucaaauuauaaccacuuaauaacaaaugcuuaacagauugugaaauucaauuuuucuuuaauaucauugcagaaaaugccaaaagaguuuauauaaaaauuuuuaauuuccuuuuuuuuuuuuuuuuugagacagagucuggcucugucaucacgguggcgugcaguggcgccaucuuggcucacugcaaccuccgccuccuggguucaaaugauucuccugccucagccucccgaguagcugggauuacaggcacgcaccaccacacccaguuaauuuuucuauuuuuaguagagacgggguuucaccauguuggccaggauggucucgaucuccugaccucgugaucugcccgccucggccucucaaagugcugggauuacaggugugagccaccgcgccuagccuuaauuuccuuuuuuagaaaaacauuuucccuguucccaaugcaccggugaaaaauaccuguuuucuuaguucuuuuaucuaccagcuaaaaauguguacucucucggauuagagccucuuccuauuucuguuuccugugcacaucauugcaugugagcaacuaccucuauaacuagaaaggccucacuauagagcaacuaccucuauaacuagaaaugcaugcacuaaaaaaaaaaagaaaaaauuacuuuggcauuuucucuuauauacuucaagugguaacaaaaacguucugugguccccacgugcaaucuaagaaacauaaggacgcauccaaaggggcgggacaauuaccaaggccucagugagugugacccucaaagucgcaacacagaacacaacagagggacaaagcugcagaaucaaaagcucuaaguucacgggacagcacggggaaucaacuaucaagccacagaaggggaucaggacugccaguacccagcgcacaaggaggacucaaggaggcgggacaauggcgccggacgagggaaaacuacaauugucugaaagaacuaccaccuaguuuuccugcgcuaacuaacccaauuuaaagaaaagucacuguuucuaaacaaugucaguuuccauuuugggguaauauugaagagcuucaaauaaaucaaaaccguuucccagccuaccuucagggugcaagggugcacuucccuucuagcacccacucugaugagggagaaggucaggcgacaggaggguguuuaaagcagcaucaauauguucagguuaaauuucuuaaauauugugaaacggaagcacauucuuuuccuuuucuguuucguuuuaagacuagucaagugcaguagugagaaaggggaaagaguggaacaaggaguucgaucuguaauggacugaacaagcaacagagaaaacucacucccuuggcaccagccacgagcacauucuugaagccaaacucauccauccguacugggagauagaugaucauagaaacaucaagugugagucugguuugaguuuaaaacgaaaagugcuuuagaguuauggaaacuuagcuucaaagaagaggcaccaaggaugccgcgcgaaaacucacgaggccacuuaacacaggcugcgugggaaacaggggcuccgcgacugcgcucagauuaacggaaaaagacaccccucuagaguccggcagcagcgggcgggcaccggcgccuucuccacacaggagaaucucggcgauuuacacccccaggcuacgcagaaaaagcggcuucggaauccgccgcaaguccccuccucgggucgccggggaagucuggccucccgcgucuggguccccuucgggacgccccaaggccccguuuaccacggcgacuccccgccucucgcgccaccgaaccacggcgcggggccaccagggcgggccucgccucgugcggaaaagucgccucgacgggcggcgcagacggcggaggcagggggacguaguccacgcgcccagcucggagcgcagggccccgcgcccacgaccgcccgcgcccuccacgugccgcgggcaaagcucggagccggugcgccgaggaaugggcagcguggacaagagaggagggggcggcggcgcgcuccgcccgggcucgguaccugagcgcggccgcgggggugcggagcga

SEQ ID NO: 192933 - RNA, 44381 nt, Homo sapiens
ucgcuccgcacccccgcggccgcgcucagguaccgagcccgggcggagcgcgccgccgcccccuccucucuuguccacgcugcccauuccucggcgcaccggcuccgagcuuugcccgcggcacguggagggcgcgggcggucgugggcgcggggcccugcgcuccgagcugggcgcguggacuacgucccccugccuccgccgucugcgccgcccgucgaggcgacuuuuccgcacgaggcgaggcccgcccugguggccccgcgccgugguucgguggcgcgagaggcggggagucgccgugguaaacggggccuuggggcgucccgaaggggacccagacgcgggaggccagacuuccccggcgacccgaggaggggacuugcggcggauuccgaagccgcuuuuucugcguagccuggggguguaaaucgccgagauucuccuguguggagaaggcgccggugcccgcccgcugcugccggacucuagaggggugucuuuuuccguuaaucugagcgcagucgcggagccccuguuucccacgcagccuguguuaaguggccucgugaguuuucgcgcggcauccuuggugccucuucuuugaagcuaaguuuccauaacucuaaagcacuuuucguuuuaaacucaaaccagacucacacuugauguuucuaugaucaucuaucucccaguacggauggaugaguuuggcuucaagaaugugcucguggcuggugccaagggagugaguuuucucuguugcuuguucaguccauuacagaucgaacuccuuguuccacucuuuccccuuucucacuacugcacuugacuagucuuaaaacgaaacagaaaaggaaaagaaugugcuuccguuucacaauauuuaagaaauuuaaccugaacauauugaugcugcuuuaaacacccuccugucgccugaccuucucccucaucagagugggugcuagaagggaagugcacccuugcacccugaagguaggcugggaaacgguuuugauuuauuugaagcucuucaauauuaccccaaaauggaaacugacauuguuuagaaacagugacuuuucuuuaaauuggguuaguuagcgcaggaaaacuaggugguaguucuuucagacaauuguaguuuucccucguccggcgccauugucccgccuccuugaguccuccuugugcgcuggguacuggcaguccugauccccuucuguggcuugauaguugauuccccgugcugucccgugaacuuagagcuuuugauucugcagcuuugucccucuguuguguucuguguugcgacuuugagggucacacucacugaggccuugguaauugucccgccccuuuggaugcguccuuauguuucuuagauugcacguggggaccacagaacguuuuuguuaccacuugaaguauauaagagaaaaugccaaaguaauuuuuucuuuuuuuuuuuagugcaugcauuucuaguuauagagguaguugcucuauagugaggccuuucuaguuauagagguaguugcucacaugcaaugaugugcacaggaaacagaaauaggaagaggcucuaauccgagagaguacacauuuuuagcugguagauaaaagaacuaagaaaacagguauuuuucaccggugcauugggaacagggaaaauguuuuucuaaaaaaggaaauuaaggcuaggcgcgguggcucacaccuguaaucccagcacuuugagaggccgaggcgggcagaucacgaggucaggagaucgagaccauccuggccaacauggugaaaccccgucucuacuaaaaauagaaaaauuaacugggugugguggugcgugccuguaaucccagcuacucgggaggcugaggcaggagaaucauuugaacccaggaggcggagguugcagugagccaagauggcgccacugcacgccaccgugaugacagagccagacucugucucaaaaaaaaaaaaaaaaaggaaauuaaaaauuuuuauauaaacucuuuuggcauuuucugcaaugauauuaaagaaaaauugaauuucacaaucuguuaagcauuuguuauuaagugguuauaauuugaaaaugugugucagggacucaggaacucucacauguguuauguaguuuaaucugauuccuuggagccucaugaagugggugguuucuucucauuuucaguuuccaaggaacccaggccuggagaggcgguuacuuguccaggugaaguuccuuggccuggcuagugagugggcccaacuggugucugaacccggggcuuugugcagcuguccagagcucaccuuguguucuuuaccucacaaugaaauuacuuggugcaguuuaucuuuuuccauguggugauauggugcagccuguucucaccaguggagugguuacaaugauaaucuucauuuuacgauuugaauuucuuggccaggcuugguggcucacaccuguaaccccagcauuuuggaaggcugaggcaggaggaucacuugagcccaggaguuggagaccagccugggcaacauagugagacccccauuucuacaaaaaauaaaaauaaaaaaugagcuggguaugguggugugcaccuguaguccuggcuacuugggaggcugaggugggaggauugcuucagccagggagguggaggcugcagugagccuaggcaacagagagaggcuucaugucaaaaaaaaaaaaaaaagauuugaguuucuucuccuuuguuggguugcaaaaggaacacuucgaaugugguuucagugcacuuaaaaauagcgaguucagccgggcgugguggcucacaccuguaaucccagcacuuugggaggcugagacacggggagaaacccaucgaccuuguggggcuggacccuacaagguggguaggucaccugaggucaagaguugaagagcagcuuggccaacauggcgaaaccccgucucuacuaaaaaauacaaaaaauagcuggaugugguggcgggugccugcaauccccgcuacuugggaggcugacgugggagaaucacuugaacucgggaggcugagguugcagugagcugagaucgcgccguugcacuucagccugggcagcaacagcgaaacuucaucucaaaaaaaaaaucgaguugcuagacacuauaccuucugcccucacacaugcaggaccuccuguaugacuagcaucccccaccggaguaguacguuugcuacaguugaugaaccuacauggacacaugcuuauuauccaaaguccauaguugacaucagguuucacucuugguguuguagucuauggauuuagacaaauguguaaugaccuuugucaaccauuauaguaucaugcagaauaauuucacugccuuaaaaaucugugcccugccucaccucucucuaccccuggccccuggcagccacgguuuuuuuuuuguuuguuuuuuuaaauagucuccacaguuaaccuuuuccagaaugccauaugguaggaauuauacaauacguagccguuucagacccguuucuuucacuuagugacaugcauuuaaauaucuucuguauuuuuuggugguuucauagcucauuucuuuuuagugcuaaauaauauuacacugucuggauguaccacacuuuaucugcucaccuacaggaaaucuugguuguuuccaaguuuuggcacuuauggauacagcugcuaugggcaucugugugcagguuuuguguggacauaaguuuuuaguuccuuugggugaauaccaaggagcaggauugcuggaucauguacacaguugcuccauauccuccucagcacuuggguguugucaguguucuggauuuuggacauucuaauugguguguagugguaccuuguguguagugguguguuuuuuuuuuuuuuuuuuuuuuuuuugagacggaguuucacucucguugcccaggcuggagugcaauggugcgaucucggcucaccgaaaccuccgccuccugguuucaaaugauucuccugccucagccucccgaguagcugggauuacaggcaugugccaccaugcccggcuaauuuuguauuuuuaguagagacgggguuucuccacguuggccaggcuggucuugaacccugaccucaggugauccaccugccucggccucccaaaaugcugggauuacaggugugagccaccgugcccggacuuuuuuuuuuuuuucugagacggagucuugcccugucgcucaggcuggagcgcaauggugcgaucuuggcucacugcaacugccgccucauccucccgaguagcugcgcuuacaggcgccugccaucaugcccagcuaaauuuuguauuuuuaguagagaugggguuucgaugugugggccaggcuggucucgaacuccugaucucaggugauccacccgccucggucucccaaagugcugggauuauaggcgugagccaccacacccggccccaguuggugaggggucugugaaagucuuugccccaauuuuuucuuuaguuggguuggguucuuuuuuuuuuuuuuuuuuuuaauggaguuucccucuuguugccuagccuggagugcaguggugcuaucuuggcucacugcaaccuccgccuccuggguucaagggauucuccugccucagccucccgaguagcugggauuacaggugcgugccaccacgccaggcuaauuuuuguaguuuuaguagagaugggguuucaccacauuggccaggcuggucucgaacuccugaccucaguugauccacccgccuuggccucccaaagugggauuacaggcaugaaccacugcaccuggccuuuuuuuuuuuuuuuuuuuuggagacauggucucacccugucaccuaggcuggagugcaguggcaugaucuuggcucacugcaaccucagcuccuggguucaagugauucuucuacuucgaccuccugaguagcugggauuacaggugugugcccacacgcccggcuaauuuuuguaguuuuuugguagagaugggguuucaccauguuggccaggcugggguuguuuucuuauuguugaauuuuaaaauaucuuuuuauauuuuggauaaugguucuuugucaaauaagucuuuugcaaauauuuucuuucagucuggaacuguuuuuuauucucuugacagugucuuuugcagagcagauauuuuuaauuuuaaugaaguucaacauaacaauucuuucuuuuauggaucgugccuucaguguuguaucucagaagucaucgccaaacccaaagucaucuauauuuuucucuuguguuaucuaucuaguaggauuuuuauaguuuugccuuuuacuuuaggucugugauccauuuugaguuaguuuucaugaaggggguccauacacuccaugucuuuuuuuugagauggagucuugcuuuguugcccaggcuguagugcaguggugugaucucagcucauugcaaccuuugccucccggguucaagugauucuccugccucagccucccgaguagcugggauuacagauguacgccaccacgccuggcuaauuuuuauaguuuuaguagaggugggguuuaacuauguuggccagacugcucuugaacucuugaccucaaaugauccacccaccucgggcucccaaagugcuaggauuacaggcgugggccaccgcacccggccucaugucuuuuuuucuuguggaugucuaguuuuucagcagcacuuguugaaaagacucucuguucucuauuguauuaccauugcuccuuggucaaagaucagugacugugugguucuauaucugggcucucuguucugccuguuccauugauacaauugucuguucuuuugcccaucccacacugucuuuuuauuuugagacagggucuugcucugucacccagguuggagugcagcagugcaaucauggaucauugcauccuccaccucucgggcugaagcagugcucccaccucugccuucuaaguagcuaggauuguagucacgcagguaauuuuaaaauuuuauguagagauggagucuugcuauguugcccaggcuggucuugaacuccugggcccaagccuuccacaguacagggauuacaguugugagccgcugugccugggcacacacggucuugaugacagcaauuuuauaauaagucuuagaguugaauagugucaguccuccaacuuuguucuucuccuguaauaucaugugggcuauucuggguuguuugccucucuguauaaacuuuauuuauuuauuuuuugagauggagucucacucugucacccaggcuggggcgcaguggugcaaucucagcucauugcgaccucugccucccggauucaagcaaaccuccugcuucggccuccugaguagcugggauuauaggcgccugcuaccacgcucggcuaauuuuuguauuuuuaguagagaugggguuucaccauguuggccaggcuggucucagggugaguucucuugccaucugaagggaggacacggccacuguaucccucugcagugagacagcguguugacagcucuucccucucugugugaauggagagccagagugagcaacaucagaggaaaccuccagugugaaagcagaagccaggaaaagcagagaagacuaagggagcugagauacagagugcagggaccagaaaaaguaauuuaaaaccccccaugaaaagcagcccuguauauguaggcuuagagauaagcgugaagacaggucccgacaugggcauuuggagaagaggagggagcccuugggggugaagcauacacacgucauuggaaggguuggaggagcggaggauagauccuagaacagcggcaacagcagcaagcgugggacacggaguccaggaacagacggagaugcagaccaggguggggugcagagugcgccaugagccaggcuggaaggacguggucucuggaccaaggaagaccuugcuugaggcgccuugagcauuuucuaaaguuggggcgagagaagacccugaaagcugagcaggcauccugggagugggcuucuuacagaaguggaggagagaagagguguggucuucacgugccccccuucucaggaagcugcaagaugagggggaggggugccccgagugggcuagagcacagccccgccagugcugagcacaaggugggacuccaggagcaaaagggcugaagguguccugaugucuuugaccaaagggcuuauuccuaggagguuuauaaaucugcuggggagauuggggcaagaguuuauacuaggcagaaacuuugcacuuguaaaaaggaaggaauuaugaacuuuggagaacagaccccacuguguggccuaacuggaaacacuauagugacgugauaaugucagcgaugacuugacaaaauguucacacggccguauugggaggugugggguggggcuguguuggcaaagagauacaccgugacgugccuucaagccagcagaugaugcucagaggggcgcgcugcggcacaguccaggagcagcagugucugcgggcugugugcauggguguaguaaguacccaaggacagggcugaagggguggaaguggccacuguggaguggcaggggugaggccucugcacguuugggaguagcucaguauugguuuguaagccagcacccugugugugucgccguggugaaauaaaauacagcuuguuuuagggguugagugagguccggccccaacagucacauguugaaguccugaccccccccaguacuucagaaugugcacuuacuuggaaauaggguuguugcagauguaaugaguuaagauggggucacacuggagcaugguggguccugccccaaaaugacugauauccuuauaaaauggggagacuugcacacaggcacacgcagggagaaugcggugggaagacuggagugaugccagagccgggagggaggccugaucagucccuccccagagccuucagaggggcauggcccugcuggcgucuugguccuggacucccagccuccaaggacggcuggccagugcguuucuguccuaagccaccacuuugugauucuugguuauaggaagcuaauucauggcucuacaaaugcuguaucugacugcauguggaucgaauuaaauuaaaacacagaaaaaucgaaccugcuuuggugccuuuuuggaggauggaguccuggagaaugagaguggccagagccgccagccgagggcauuuugccgcugucccgugaggcggccaucugagcugaggcacugccuguggugggggcucgucccugcugcccccguggagcuccagcucuggguuugacccuccuaggggucugcagggcacugguguggccagauccuggggagcgaggggagaagaugggggaguuggaggaccagggugaggauuuuggccucuguccuaagggcugaggaggcuguuucugggggccagagcauugugaucugcuuuccgcugaggucgggccaaggguugcccaguguaugggaaugaguguaggcugcugcgguccuccagaccuugaggaucaggcuugagcugggugcagagguggaacgagaggcagggaaaccuccugggguugucggcuaagucaccagugcaguuacaaggaagggauuuacggugcaguuacaaggagccuuugggagcgaggacggcgacuuaaugccagaaaaguggaagugaguucguuguagccguccucugaagugagcccacuuaguguggggagaaggcaucaccugggcucagggcagugcucgugggcuugggagggaccacuuccuguuuggaggggccggcgccgagagguccuggaguaggggcaagggaugccugaugccggcugugcuucccggagcucaggugguauguccucuuuguucuugcugggucccacuccucaccuguugguggcagggacagugaguucuggcagcgggagccagguuucucucacuucccacgucucuucuacaucuaccuggaacccagaggucucuucccacuuguccuggccuuugucuccuuuuccgggacccucuuguuuagcuuucaguccuggcuucaaugucacugccuuagaggggccucucugaucgccccucgaaaaggcuguccugccauggugggguccuacggcauccuucucacugccaccauccgucacuguuucuguaucucugggcuuucccagcuccggcaggggcuuccucugguccugaacugcuccuuccccagacuucccucacgcagacuggagacuggccucagaacugccaagggggagggacuugcuguccaucaugccucgugacuggugcugcauccucauggcucaguuucuuguaaggggagacgggccugacauuguguguguggaaucgcaucccccaggagguuauguucaagucugcaccccuaauacuugcaaaugugacuuuauuuagaaauagggucuuugcagaugcuauuguaauuuuuuuuuuuuuuugagacagagucucacucuguugcccaagcuggagugcaguggcaugaucucggcucacugcaaccuccgccuccuggguucaagcaauucuccugccucagccucccaaguagcugggaccacaggcacgugccaccacacccagcuaauuuuuuauauuuuuaguagagacaggauuucaccguguuagccaggauggccucgauuuccugaccuugugauuugccugccucggccuccuaaagugcugggauuacaggcgugagccaccgcgcccggccagaugcuuuugcaauuaauguacauuaagaugaagucauaugauuagagucggcucuaacccaaucauugguguccuuauaagaagagauagcgauacagagacucuguggcgcuggggagaaggccgcauggugacagaggcagagauugcagugguacagcuauaagccaggaacugccgaggacucccagagccccuggaaacuggagagaguccuggaacagguucccccucagccuccagaaggaggcaccuguugauaccucaguuuuggacuuccggccuccagaacugugagaguaaacuuuuguuguuugaagcccacucaguuaugggagauuguuauaacggcccugcuggcaucuuggaagccaacacacgugucggugaugaccugacuaacgccuuccuuccugcaggaaaugcauguuccacacgagggucucuucccugcccagcacucacaauccccgucgucuccugggcucccagcagggagcugcuuuuggcaguaggcguggucccucccgcgcugcaugcgccucccgcgugccagagcugcugccuugacacugcugggugcuccgcauuggcgcugcuggacacuugcccuggcuggugcuuggcgggcacacuuuaucugauuuuuuuuugaaacggagucucgcucggucaccacacuggagugcaguggugugauuucggcucacugcaaccucugccccacccgguucaagugauucuccugccucagccuccugaguagcugggacuacaggugugcgccaucacacccagcuaauuuuuauauuuuuaauagagaugggguuucaccauguuggcccagguuggucucgaucuccugaccuccugaucuacccuccucggccucccaaggugcugggauuacaggcaugagccaccgcgcccagccugucugauguuuuaaagucugugaguuaugagcgugugacucuugcacacacgucaucguuucucugucgagggcgugcagacccuccaggcguucacaucacacgugaccacaggcaguagucacagccaggaguguggcaucaguguggcauggugcuggcaucugacggugcugaggcagauuugggacauguccucccugccguuuuucugacccagggucacgugcugcauugggacccccuccagucugggcagggccucgucgagcucuuucuugacuccaugcuucugaagaucucuggcuggucauuuuguagaguuggccuguuuugagauugucugacauuucuucagaauuaaauaaucagguuccaggccaggcgugguggugauacauaccuguaaucccagcacugugggaggcugagguggguggaucaccugaggucaggaguuugagaccagccuggccaacauggcgaaaugcugucuuuacuacaaauacaaaaauuagcugggugugguagugugugccuguaaucccggcuacuuggcagucugaggcaggagaaucgcuugaacccgggaggcggagguugcagugagccgagaucacaccacugcacuccagccugggcgauggagaaagacucugccucaaaaaaaaaaaaaaaaaaaaaaaaaaaaggaaauucagguuccuguguuuguguccugggcaccucacaggaggcucucgggguguucacauugaucgcuggguucaggugccuuccgggcaaaccugcuguuacuguuuuuccuugguggcugccgagcaucuuuuggggaucacucugaggcugugagcucuguuucucgccauacguucucugcggguccagcaucauggaugcaucuugccugagacuguuguguugggacauuggucaaguggugauuuuaaagcauuucccucauucucucugcacucacuaguggcuccccaccaccccgugaggaggcgcuucccgccacccccaccucaccuggguccauggguuccuggguuccugauuccuggguucguggguucguggguuccuggguuccuggguccaugggucuauggguuccuggguuuguggguccauggguucauggguuccugggucuguggguggcugguuccuggguuugugggucugugggucccuggguccgugcguuccuggguucauggguuccuggaucuguggguuccugguuccuggguccguggguccguggguucuuggguuccugggucuguggguaccugggucuuugggucccuaggucccuggguuccuggaucuguggguuccuggguucguggguucguggguucugggucuguggguccauggguuccuggguucugagguucauggguuccugggugccuguguucacugcugcucgcuuugcucugugucacaggcaggcugcuggggagccauccucacuuccuguaccucaacaggcuccagcucuuuucccugccccagcccugaaaucagccguuucuauacagacugugaggccuguuuuuaaaauaaaauccuaguuauuauuuuuucaaguuauaguguggcugcuguugccuuucuaggguugugugugugcuuugugcaaucaggaggguuuggaaggugggugugcagccccucguggugcacggugugaagggagcuggccccucaccuugcaggagugguuggugggauuagggagggaggcuggcuugucagccauagagccccauccugugagggcucugaggcugggagagaggugaguccgggccguggcugugagcugguggcucugacgcugggacagaggugagucccggcuguggcuguggcugugagcugguggcucugacgcugggacagaggugaguccgggccguggcuguggcugugagcugggggcucugacgcugggacagaggugagucccggcuguggcuguggcugugagcugguggcucugacgcugggacagaggugaguccgggccguggcugugagcugguggcucugacgcugggacagaggugaguccgggccguggcugugagcugggggcucugacgcugggacagaggugaguccgggccguggcuguggcugugagcugguggcucugacgcugggacagaggugaguccgggcuguggcuguggcugugagcugggggcucugacggugggacagaggugaguccgggcuguggcugugagcugguggcucugacgcugggacagaggugaguccgggccauggcuguggcugugagcugguggcucugacgcugggacagaggugaguccgggccguggcuguggcugugagcugguggcucugacgcugggacagaggugaguccgggccguggcugugagcuguuggcucugacgcugggacagaggugaguccgggccguggcuguggcugugagcugggggcucugacgcugggacagaggugagucccggcuguggcugugagcugggggcucugacgcugggacagaggugagucugggcuguggcugugagcuggcaccccaguuacuggugguuuuuccccagcugacaucgaccagcguggggugugcaguguggcuggcucugauuugugcuccuuaguuugagacaauuugaauggagccacugcuguggagaggccuccuucugaagcaucacaagugggcccggcugacccuagcccagugcacgacaccccucuuggagucugggguucuuggcugugggcuggagaugacagugguggcugccgaggguggugggaguggucagugcugagcacgcgauuucagauccagugagccaggcgggcacagccuuuagcugaugugguguguccccuggccuggaacagccccauggguggguggcacccgucaggaccugugcacagacccugccuggguuuggucugcccaguccccuggaccuggcagcagcggggcugugccuggugacgggaaggcucugagccaggcuggguggcccacugugcgcgucgcugcuguguuggugguggcgccuuugcccuggcccucauucaggaagaugcuggcuuuugggcucuagggaagugcauguugguuucugucgagagcgguuguguguguacauuuuaagcguggaacgcagguaucgaaccguguugaaaccuuuccagcauuggcagaagugugcgugugagucuccuuugcccuuuuacuuuacuggcagguguagugaacuuggaugccgccugccuuccuagcauggcccacguggccgggcgguccuucugauggggcggcucacguggcucccacgugccaggcuuuuggggcagaugcuccugagcggugcugccuacggguugccuucauuggugguggugaggccugggcuuuggcguccuguccgcccuuaauccuugccuaggagcagucugugggccccagaagacuggccggaaacugaagccgggcggcagcugaggacgcacacccuggagguuguguggacguuccgucacugcugucuuaauucccaggcacucuucuuuuucucuggaaguuccuuuuugaggguguccugguguucauggaggugccguaucacuccgagggcagagggcugcugcugaggaaggccuugcccucucaccuagcacucuucuccaaguugcugguuuugcuuguuugcaccuugucuguuuuggccucuguugggucugaacuagguguccuuggcagcugcucacacccaacagugggacccugagaagggucaaagccggggcaguuuggggacacgcugggugcagggccaccuugcugggcaccucggcugguuggugucuguugggagcagcccuggggccgccccgcagccucugccugcaguacagacggaucugcccacuccugaggcuggagagcucagagccugaaagacccccugagcccucgcccuuccuccgccggccccuugcugucagcacgccaggugcagacccuggcaggcuuccugugccccagcuucaguguggagcgcuugccuagcuggcuggcaugggagcgggagggguguuuggccacuuggagcagaaggggguggguagucagaguuucuguguuccuggcuugauauuggcuuuccagcagcuucccagcuuccagaauguccuugccaucaucucccauccuguuuccucuuuuuuggagcagaggccugggguggccuaucuucuucuuucaguugaggcuuccggggcgggugggucuaaugugugucuuugccuuuagccagaagaccaccgugauuagauuuuccagaagagaacucgcgugguaguuuugaaaaugggaggguguuugugaggugggauaucagaaauacuuuauacagaggggacccaacauguagcagaaacaucaacaaaaugguuuugcguauaaucacaugaugauuucucucuucugagaaacaggcacaaauccugaagagcccgugggcguggacugcucaucuguaaagaaaguggagacaugaccuugagauuuggcugacccagcaaugcuggggccuucgcaagucugauguuccaggacuccagugccuguugguguggacggaggacacggggccccgaccauggucacacucaucacugagaagcugcagagccagagccuggacgaccucaccugcaaggcggaggcuggcccgguaagcagcugcagguggcaccaggcugggugccccucccccgugcugucacaggggaauggccacacugggagguggaggugagggcuaaguucucaggggccuggggggcccugcugggccagggaugggggugucuggugcacaugugggccccagagcccaucaguguaaucacagcggauuuucaccaucauugaaaaaaaaauagacuuauuaaaaaugccagcugggcgugguggcucaugccuguaaucccagcacuuugggaggccaaggcggucagaucacuugaggucaggaguucguaaccagccuggccaacauguugaaaccccgucucuacuaaaaauacaaaaauuagccgggcacgguagcaggcgccuguagucccagcugcucgggaggcugaggcaggagaauggcaugcacccgggaggcggagcuugcagugagccgagaucgcuccacugcacuccagccugggacagagcgagacuccgucucaaaaaaaaaaagagccuugacuugcuauuuaaaaaaauagaguuuuacugaaaggcugacuuacacacagaagcuggagccccaagcgcaggugugccuguuaccauccaaucaagcagcagacugcaccccgccaggcucccugucccuccccuccuagccgcgccucccaagggagccucugucuuggauuugaucaccacguuagcuuccugcgggcagcuugauuuuccuacagucauggugaagugaacuuuggaugugccaccuucaggacccccccgcccuaguuagauggcagauccagaaggagguggcugaugucuagccuggagggucuugccaggcccucagagccagcaggggugcuuggagcgccugccuauccugggccuggcuuggcuguggcucuggagacgugggcacguugcauuuguagccccuugcguguuacggaaaugagagggugaagggaaagcugugggucucgggccuuuggacugggcacgugugacccaucuucaccgcaggggguuccagugagggucugaggguccaagcugaagccucuccucccgagagcuggcgaguguggguguugggcugugggagguggcauguggccugaaccuucgcaagcacugcuuguggggccuggcacucagggccgcugugacugaggugaccguggcagcgcuggcuguguccuguaauuaguacguuuccggcugucaguccacggguggagguggccgaggcggggaaggcagugcuugccugaugucucagugccuugcuggcugcagagccauguucuuuccagaugcuguggccgguucucauuuuuucuuuuuuuuucuggagacagagucuugcuuugucauccaugcuggaguguaguggcaccaucucagcucacugcaaccuccgucucccggguucaagugauucucgugccucagccucccgaguagcuaacguuacaggcacacgccaccacacccggcuaaauuuuguauuuuuuuuuuuuuugagauggagucuugcucugucgcccaggcuggagugcaauggcacaaucucggcucacugcaaccuccaccucccagguucaagcaauucucccgccucagccuccugaguagcuaggauuacaggugcacgccaccaggccuggcuaauuuuuguauuuuuaguagagacaggguuucaccauguuggucaggcuggucucaagcuccugaccucaugaucugccugccucggccucccaaaguccugggauuacaggcgugagccaccacacccagccuaaauuuuguauuuuuaguagagacgggguuucaccauguuggccauguuggcgaggcuggucagugauccgcccaccucagccuugcagaguguugggauuacaggcgugagccacugcgccuggccccauuuuuccuuuugauuaaauggagaaaacauuuuuaaggugucucuaaccaagaccaaaggauacagagcggcacaugccuaucagauggcugugugccucugaggacauuuuuggcaaguggacgucagccagggcgugcgcagcuuuccagggagguggcuacgcagcaugccugccgggccugggaggugucuggacggauguccugguguggggugacccacgggcccccacgaccucugugcuuuagguggccacucuucaccucuuuuuuuuucagcuuuuauuuuagauacagggggguacaggugcagguuuuauuuuagauacagggggugcaggugcagguuuuauuuuagauacagggggugcaggugcagguuuuauuuuagauacagggggugcaggugcagguuuuauuuuagauacagggggugcagguuuuauuuuagauacagggugugcaggugcaggcuuuauuuuagauacagggggugcaggugcagguuuuauuuuagauacagggugugcaggugcagguuuuauuuuagauacagggggugcaggugcagguuuuauuuuagauacaggggugcaggugcagguuuuauuuuagauacagggggugcaggugcagguuuuauuuuagauacagggggugcaggugcagauuuuauuuuagauacagggggugcaggugcagguuuuauuuuagauacagggggugcaggugcagguuuuauuuuagauaugggggugcaggugcagguuuuauuuuagauacagggggugcaggugcagguuugucacuuggcuauauugcacucggguugugagcacaguacccaguagguagcucuucagccccugccuccucccucccucccauucuucaucucuuuguggagcacuuguccauugacagagaaggcagcauaggcaguuccuugguaggccucggccuugggacaggagcccugggagcccuacagggugaguggucacggggguuccaucacagccugcuccugcuccugcugacccugccggcucuguuaguggccagccagggccacuguugagucuguugcugucgaagaugguuuuucccaaugacuccuguuuucuuaaaacacggccugugaauauggcggugguuucuaucugaaaaaggaggacaaaccuuuuuaucccuaaauguaagucuuuuuacuuuuuuuuuuuuuuugagauggagucuugcccuguugccgaggcuggagugcaguggagugaucgcacgucauugcaacuccgcuuccagggcucaagcgauucucucgccucagccucccgaguagcugggacuacaggggugugccaccaugcccaaccuauuuuuuaauuuuuuuuuuuaaagugauggagucuugcucugucacccaggcuggagugcaguggugcagucucggcucacugcaaccucugccucccgcauucaagcaauucucuugccucagucuccugaguaggugggacuacaggcaugcgccaccacgcccggcuaauuuuuuuuguauuuuuaauagagaugggguuucaccauguuggccaggcuggucuugaacuccugaccucaagugauccacccaccucagccucccaaagugcugggauuacaggcaugagccaccaugcccagccuuuaucaggauuuuuuaaaaaauuauuuuucauuuauuuauuuauuuuaucuuuuagacaagagucucacucuguugcccaggcuggaaugcaguggugcgauccuggcucacuguaacccccgccuccuggguucaagcgauuccccugccucagccuccucaguaguugggauuacaggcacaugccaccaagcccagcuaauuuuuguauuuuuaguagagacaggguuucaccauguuggucaggcuggucuugaacuccuaaccucaggugauccacccgcuucaggcucccaaagugcugggauuacaggccugagccaccgugccuggccaggauuuuuaaucuguguaauucggacagugugauugccuguguugaggaaacccaguuacucagugauagauuguuuacacgugagaccagcucucccaugucaacugaauaucuaaacacaaguuacuucuaacauucaaggaaacaagucaguauuuuaaauagccaauucauuguauaaaaauagaaacugauguuuucaaaggugacuuaaaauaguauuuuuaugaaaaauaaguguagacaguucuagagaguagcaacucguacauucauguaugagguucuguguggaaguaugucuucauacauacccauggcccggccucagugagcaagcgaggcgggcgcuguuagcucagggcuccuuguuugaucugcgccuuuacccagucccuuccugccaugauuucauagcgcauucuagacauacuuucucuguaaauaucucacucuguaucuccaaaagauaaagacuuuaagacacaugaccagaaugucauuuucacaccuaaaacucucagagauuccuuaauaucucuauccggucagcauucaaacuucuccaauugucugaguuuaagaauuuguucagggaguccagauucagggugucucaugucccuuuuccccauagggugcuccuuggagcuuguguguugaggacccagcugcuugucccggaguguccaggcugcaugccccggcugccgccucgugcgcuccccucccauguguguucugggaguugcugguuggagugagcacugcccugccccuuaugguuuccucuaguugcacauagauuuuuaaacugaaauuaaaguugauuuagcuuuuuuuuuuuuuuuuuaaagacagggucucacuaauuugugaauguuuuugguagagacggggucuugcuguguugcccaggcuagucucuaacuccuggccucaagugacccuccuuaugcggccucccaaagugcugagauugcaggugugagccacugcgcccagccuacaguuaaaguggaacccacauaaugcuguuucucacuuguaccagaaacacuucuagugcucacugucucuggguggcugguggcugccgugguggacagccuguuggcugucccucaccacagaauguucucgcaggcagugcugugaggcucgaagcucgaucagguucguguuugagagaccaccauuugcucauccguuccucuguuuuuggaccuuugggugguugccauauuuuagcuauuagggauaaugcagcugugaacauucaugugugaguuucuguguggaaguuucauguaugaguuucuguguggaaguaggucuucauuucuuuugggugcaaaccuagucgugggauugccaggucauauggugauucuauguuuaacauuuugaggaacugccaaacuguuuuccacagugucuguaccauguuccguucugcagcaauguaugagaguucuaauuucuccaacucuuuuuuucuugaggcagagucuggcucuuucgcccaggcuggagugcaguggcgcgaucucggcucacucugccucccagguucacgccauucucacgccucagccucccaaguagcugggacuacaggcgcaugccaccacucccagcuaauuuuuuguauuuuuuuuuuaguagagccgggguuucaccguguuggcaaggauggucucaaucuccugaccucgugauccgccugccucggccccccagaguggugggauuacaggcaugagccacugugccuggcccuaauuucuccaacucucaucaacgcguguuauuguccauuuuuuugauaaaagccaccugcauggguguggagugguaucucauugugguucugauuuucauuucccuaugguuagcuauguugagcauauuuucaugugcucauuggccauuuguaucucuucuuuugagaaauaucuaaugaaaucccauuuuuacuuuaaaauuggguuauuucucuuuuuauuuuugaguuguaagaacccuuuuuuuuuuuuuuuuugagacagggccuugcuuuguugcccaggcuggagugcagggucucaaucacugcucacugcagccucgaccuccugggcucaagugauccuccucccucagccuucugaguagcuaggacuacagacaugugugaccacacccagcuuuuuuuuuuuuuuuuuuuuuuuugugauggaaucuugcccuuguugcuaaggcuggagugcaguggugcgaucuuggcucacugcaaccuccaccuccuggguucgagagagucuucugccucagccuccugaguagcugggauuacaggcauccaccaucacgcccggcuaauuuuuauauuuuuaguagagauggaauuucaccauguuggccaggcuggucuugaacuccugacuuugugauccgccugccuuggccucccaaaaugcugggauuacagguuacagccaccacgcccaccccacacccagcuauuuuuuaaaaauuuauaucuuuuagaaagggggucucacuguguuucccaggcugguuuccaccucuugugcucaauggguccucccgccucagccucccaaaaugcagggauuacaggugugagccaugacaccuggccaguaagaguucuuuaugguuucuucccccguucugucauucugucaucucgagagugguguguaaauggagugacacagugcacaagcauuuggguucugccuuuccaucagcaugcuucccuggagauccguccggcgguuccucugcgccaccaagaggugcuccguggcauggaggugcacucuguguaaccauguggaggaaugcugcguccuaaugcaaaucaugacgugauuuuuaggguuguguccucaugggggaccuacacagacgaccaguaaccacaggcaugaggcggugggaggggagugggcacgggugccucgcugagcugccggagcagcaaagaggguuggagguguaaugguggcugagugcuggaagaugggcggggucuuaauguuggggugggcaaaggccauuggggccacagggagggggacguggauggguggguggggccagcaucucacugugcucuggcuggggcuuccccagagagcccgggacagcagccaggaggcgguagggccugaaggucacgugugaaggucauucagcgcguuggggcgucugugcugcacuggcugugcuggguuagcaauauggugcucacuuccugcagggaggcgggugggaagcaggugacugaggagucgcgauagugcaucaggaaaaaaguagagcccaaggggugcugggaguuuacauagggcgccgggcugugaccuccggguggagcuggaaggugggugaugagccauauggacaucuggggagucagccagguggagguucccauggccgugggagccugugagggugggagccugggggcacaggcaucugggaucugacucucaggaguccagagggcagaguagagggccgcggcagccaggaccagagcagcaguucccgggcugaggggcggagagcagggagagcugagaaugucaggguaggggagagaggaggcggugugauggggcugugcugggggcuguaggcgcagggaagcucacugugccgcuggccuggcgggcacgguauggguggguggcgggcugugguguccuccagcccugugcagcugugcagauacaggcugggauugauugguagagagcugguuuuuaaaaaacuuuuaguuuuuuuuuuuuugagauggagucuggcucugucacccaggcuggagugcagaggcgugaucuccgcucacugcaagcucugccucacgccauucuccugccucggccuccugaguagcugggacuacaggcacucgccaccacgccuggcuaauuuuuuuguauuuuuaguagagaugggguuucaccguguuagccaggauggucucgaucuccugaucuugucaccugccugugucggccucccaaagagcugggauuacaggcgugagccaccgugcccagccuaaaaacuuuuagguuuuuaaagacagggucuugcuguguugcccaggcuggagcgcagugcacucagucguucgcugcagccuuggccucccuagcccaagcaauccucccaccucagccucuugaguagcuggaaugacaggcucaugccaucauaucugcuuuuuuuuuuguagagaccagguuucccuguguugcccaggcuguucucaaacuccugggcucaagugaucuucccaccucagcccccacagugcugggauuucccggauuucccuguguccggcccugaaguacagauuucguuuuuuucuucuuuuucugcacggagucuugcucuuguugcccaggcuggagugcaguggugugaucucggcucacugcagccucugccucccggguucacgcgauuccccugccucagccucccaaguagcugggauuacaggcacccaccaccacacccagcuaauuuuuguauuuuuaguaaagacaggguuucaccauguuggccacgcuggucucaaacuccugagcucaagcgauccucccgccgugcugggauucaggugugugcccccgugcccagcccugaaguccagauuuccuuaggcuuaaggguugcauguucacauuccccgaaacccauauguugaaguccucacccucaaggugacgggaugaauauuuggagguggggccucugggaggugcuuaggucauggcggcagugcccucaugaauggaauuaagugcgcauaugugagaggcaucagagaggaagccagccccuucgaccaugcauagauacaaccggaagagccgucugugaaccaggagguggccuuaccagacacugaaucugccugucccuugaucuuggacuucugccuccaggacugugaggaauaaguguuuuugacaagcccccugccugagccugugggaccuggcugcccagccuuuccugucucccggggacccuggcucuguuugucugcugcacccacaucccacacggccagugccacugggaguagcugcugcccccggcgugucuuugcauagagguggucacauuugggaccgugcgggccuguggcuccuucaagcugcccgugagagccaucugugccggcugggaaaguccuuuccuugcuagacguuuuuccguggcagcgucgagcugggugcuguucauguggccccggggaacgggugcugugcggaacaggaggagagcgagguccuggugcuugcugcggggaggcccggggcugggaggaucgacagcaacaagggucccuguggcgugaaagccuucaaguccuuuagcagagcugccucuccucucuuccaucggacccgggucccggggugggagaaccuggaggucgugugguucccgggcccgcaccaggcccuguccucaugguguggccgggugcucacagcuccacaccgccgugcuggcugaggugggaccccguguguaggcggccugucuuuuuucggggucacaaacccaacuuuuaacuuauucccuuuacaggaagcagugaaggauuuccuuuuaauuuuaucguguuuggaaauguuaucauaggacgugaugccaugggcuuaggcguuaacugagagguucugagguguggcagaggagccccacaacucuaaggcaaaaaagcagaggggcugcugugcccggacccugcgggacagccguguccuugucacaggguggccuucuguguucucacagacgaggaagcucugggagguuagggagcuugccgggcacccggcaggaccccccuccugugccccauccucugcagggcccugugucccgccugcacgggccagugcguggaagcagacacauuaauggccuccaagccgugaccugccaagcagcucccugacacuucaugggguagggaagagagcccuguggcauuucccuuagugcccucccuauagacccuccagcugccaccacgcccuguggcuuuccugcuuccagggagggagacccugcccucuggacgucucccuggaccagcaccacacuccagagccuggcuuaggcgcucaggucccgugucugagcuguugcaggugggaaagggccccuugggucuuggcugaaguucuugcugaaaaguaaguaaguggugagguuugcaaagacggcugcagcugaggcugccgaaaggcaggagggccugagcuucaggagcagggacaggaugcaugccuguggcuuggaauaaaaaugucugaggccgggcgugguggcucacaccuguaauuccagcacuuugugaggcugaggcgggaagaucacgaggugaagagaucgagaccauccuggcugacacggugaaacccugucucuacgaaaaauauauuuaaaaaaacaaaauuagcugggcgugguggcagcuuucuguagucccagcuacucgggaggcugagacaggagaauggcgugaacccgggaggcagagcuuguaguaagcagagauagcaccacugcacuccagucugagcaacagagcgagacucugucucaaaaacagacaaaaaaaaagucugcuuaguguuaacagcucuuuuaaaaacagaaaaaauuuuuuaaaaaauuuaaaaauguccguuuacagccgggcgugguggcucaugccuguaauuccagcacuuuaggaggcugaggcgggcggaucacgaggucaggagauggagaccguccuggcuaacacggugaaacccugucucuacuaaaaauacaaaaaaaauuaaccgggcgugguggugggcgccuguagucccagcuacuugggaggcugaggcaggagaauggcgugaacccgagaggcggagcuugcagugagccgagaucgcgccacugcacuccagccugggugacugugcgagacuccaucuaaaaaaauaaaaaauuguccauuuacucaguugaauuuuguuagguuuuaauaaaacugugcuuauuuuaaucacuagaaagaaaacacuggggaaagguagaacgugcugcagugaugaaaaugggggauauuauugccgaauucucacgugucagucacaguauugaaacuucucuuuccugucaguugcaguauucugcggaaacccugaacaagagcggucgucuguucccuuuggagcucaacggugagcacuuuaggagcuguggccggaggccugagcagggcugggacugggcuccugggcugggaggguccuggacgcagaacaugagccggaucugcagaagcccaggaagguguucgugugcccugcacuggggcgugggguggucccugcugccguccuccaacggcugggcccguggucaagaguggucugugagcaggacggcucguguagggugcgggcccagccaggucucucccuccucagcugguggggcccaggggucugcugcgcccuuucuggaaggugcaaggcccacccuguggccacgaaaagaagaggacggcguggcuggcagggcuuguagcgucagcuggagcgugccauggcauacugggcggcccacccacuguccgugcaguggaggguguggcugugccugguucacccgcaggugggcccuucauugauggagagcaggugccccgaguauggaggcuggcugguguucacgggccagguaacccuggggucccagguccucccccagcgaaggucccaggggcaucucccucuguuggcccugcuuaccugacugugacacgcccagcgcccugugucacgcagagugggcccguuaggaggcucaccuugcugagcgccagaugaccaaagugaagguguuuuaccagauucuuucaugaguagauggaaguagcaugugugaggccccagcuggccagagccccacccccugccgggccuguggugcgauguccucaccucagccuccugggguucauccugcacacggggucagaccagccaccuccauccuggcucagagccccgcagcgcuuccuacacuccucacccagccggccgcucucccugccuacaccuccacgucuccuccccacagcccccaucucucucccagucaccccaaggucaucccagggccuuuccccagaggcaggucucacagccuccacuccaaguuccucagcuggacagugacugcacaagccacugggcagacuccaugccaggcccaugcaccuggccuugcucuccaggcuucuccgaaccagcaggcagugggcuggggagcgcguuagacaggcaaccccaggacaguugugcaggaagugagacuugggaaggggcuccaggccuggaccugguggcucugagguuugugaggaguuucuggggcucagacucucccugaagaccguggcagcaggugugacccuguguugcccauguuacuaagggaccugagcugcuuuaagaaggggcccuggagaguccuggccgggguagccgcacauccuugagaugccuggucacagagggagaggggcauuuugaggaugcgggaagaauguuuuagcaaagcugucgggagagcagagccgugcgguuguucucagggaggcaccgguggggaggcugacaccuccuucagacacgguguccccuuuaagaagugagccgagccccgcagcuaacccagcaagggcaggcggggcugguguccacugugcgccacggacaucuuggagaagcacgcccagggguggcggcgaugggguugugcccuugacagcucugccaggcuguuugccgggauggaugucgccugcccuguggcucaccugucucuuccccugccucuuugugucuuuuuuuguagaccagagucccuggaaggucuucaguggaggaccgcccgucagaagccaggcagccacgggcccugauuucuccuuccugccgggccugucugcugccgcucacaccaugggucuucaguggcagccacaguccccgcgcccaggcgcaggccugggugcagccagcaccguggaccccagugaaagcacaggcucguccacggccccaccgaccaagcggcauugccgguccuugucagaacccgaggagcuugugcgcugccggucccccuggcgccccggcagcuccaaggucuggacuccagucuccaagaggcggugcgacagcggcgggagugccacgcggcagggaagccccggcgccguccugccgaggagugcuguguggucgaccggucccaccucgcccgccacgccccggccguccuccgccagcggcggcuucguggacagcagcgagggcagugcgggcucaggcccgcucugguguuccgcggaguccugcuugcccuccacgaggcgccgcccgucccucucacaggagcgacucgcgggugcgggcacuccccugcccugggccagcagcagccccacguccacgccugcgcugggcgggcgccgugggcugcuccggugccgcucacagccuugcgugcucagugggaagaggagccggcgcaaacggaggcgugaggaggacgccagguggacacgcccauccuuggacuuccugaaaaugacccaggugaggcuuucuuauuuccaggggcucagaggggcguagaucuggacagggcggugcuggggugaggcuggcugauucucuggauguggcuguuagcauccggcuggucuucucugggcugggaggaaaggagugaggagagccaucuggagugcgugggagcgaucgggggccuguccuggugucagagcacccagcucaccccgccugcucccgcagaggcagagccccacacacggcccaggguggccggccaggcuugcagugaggccugggggaggcagcagaacggagcuguggguuucuggccuggcugagccgccccccgccucagcugcuggggaguccccugacuuuuucuggugauggcucaggaaguaacaagcuguccugggagccccauucgaggcagagcccgggguccucucuugugggagcuggugggugugcauguugcagcucagagcccagcagcgccugugcgcuuugggacuguacaggcaccuccugcagaaacugucuggauguaggagagagccuucacccacuugaagauucucagugccacccaccucuccacacccccgucacaggccgugguuggcacagaguuaaggaaggaaacaggacugaggaggcuuucccaggucuugcucuguguuacuaagggagugcauucaccagagaccucugggggcccggcagcgcucggggagggagauggcagagccgugacagaguagggugggcugugugcacacucacugggucaucugugucggggaagcuuugggcaguggcagaaauuaacaggacuucccgaugccaacugaguaccagccagggccgaguggggcuguggcuaggguggggcgggaucagugucagccugucuccucaaugaccuguggccuuggcagcccccugaacucucauccccagccccauccuccgggccacaggcuugcccaugcccugccucugggggcuguagauguggguggagcuguccauaguguggcugcacugucuugcucgggugggcugggccugggcauccuguggggacagugacuggagaaggggcacagauggcccagguccuccucgaccuggccacagcccagagcuggagagcaguguggccggcgugccaggugggaucccccaggguccuccaggacgcuaguccuaggccacgcugagggcaccgugagcuuugccucuucugaucagugggcucuccaguugauucuuccggggggcuugaggugaguugaaaacccagacuucccugcuaugaaacuuuucugcagagagcaggguuuagagaaggcucugaucuuuugcuaugagaugggcugaccuggggaagccaguaaaugcuggaaagcugguggcaagcuuuggacauagcacaagcaggcugucccugcuugccagggcuuggggugugcauggcgugggugucaggccccacggggaccaggagggaugggagcagaggagggagcugccggcucagcacguuguggggcggggaaugauggugccagcgacguauugaugaccagacaacaguccuaauguagagcggcccuggguuucucagaugccuugggagacagaccaggugguugggugaguuggugaucgaggcugcauggggcucaguguggacaugggguacccccgguagagugugagguguggguagaggcaaggacucgccagacccaggaccagggcucauggacacccgggugugugguguguuggggagaugggugggagaagggcagggcugccgucaaaugcugugugguguguguguggcacacgugcuaugugcugugugguguguguagugugugcucugugugguguauguggugugugauguguaugugacgucuaugggugguguguggucuauguguuguguguguguaguguguguggugugugaugugugugugggauguguguuguguguaugugguguaguguaugcguggucugugugguaugugugugguggggguguguguggugagugcugucugguguguaguguguggugucugugguaugugugguguuugguguguggugugugugcugugugguguguagcguguggugugugguggguaguauguggugugugugugacgugugugguguguuuggugugugcugugugguguguagucuguguguggugugugugugcaguguguggucucugguagugugugugguguguguucugugugugguguguggucugugguauguguggugugguguauaugugguguauuggauaugucuggugggugugucugguguguguguguguggugagugauguguggugugugugauguguggccuguguguggugugugugugguaaugugugguguggccuguguguaugguagaguauaugguguguggaaugugugguguguuugugacgugugugguaugugugaugugugucgugugugugggguggguggugugugugugaugugugguguguauguggcgugugugugucugguguguguggugugcaugugauguguguuguguguguugugcgugugacgugugguguguguauagcguguguguauggugugugugacgugugugguguuuguguguguguggcaugugugugucugguguaugcggugucuggcgugugguguguguggugugugugcgacuagugugugugguguguguggcaugugugguguguguggcguguaugguguguguggcguguggggugugugugugacguguggugugugugguguaugagguguguguggcgugugugugucugguguguaugguaugugugaugugugugugacugguguaugugguguguguguggcgugugugguguguguguggcguguguggugugugugugacguguguggugugugugugaggugugcguguggugugugcgugcauggugugugugugugucugaugcauaggugggugccugguuucucucugggaggagaaacccccgcugugugggaacuggagccgugaccccuaggacuggggcugcgcggggcauccaucccucagauccaugcagccccggcuuugggucccuugcugagccugcgugucccuguccccggcuuugggucccuugcugagccugugugucccuguccccagcuuugggucccuugcugagccugcgugucccuguccaugcaagcgcuggucacccaggcuggugucccguccucuggauguuucugugauucaguccuccuuccucuugaccccgguuauucugccucaggccuugauacccucuucggcuacugagacaucauccuaguuggcuuuguugccucuaaucuccaucuuuuuuuuuuuuuuuaagacagaauuucgcucuuuuugcccaggcuggaaugcaguggcacgaucuccggucacugcaaccuccacuucccggacucaagcaauucuccugccucagccucccgaguagcugggguugcaggcaugcaccaccacgcuuggcuaauauuuguauuuuuaauagagauaggauuuuaccauguuguccaggcuggucuugaacuucugaccucaggugauccgccugccucggccucccaaauugcugggauuacagaugugagccaccgugcccggcccucucuuaauuuuuuuuuuuuuuuuucgagauggagucucgcucugucccaggcuggugagcaauggaacaauggugugaucuuggcucacugcaaccucugccuccuggguccaagggauucuccugccucagcuucccgaguagcugggauuauaggugcccaccaucacgcccagcuaauuuuuguauuuuuaguacagacgggguuucaccacguuggccaggcuggucucgaacuccucaccucgugauccacccgccucggccucccaaagugcugggauuacaggcgugagccacugcaucuagccagcucaaucuugauaucaaugcccgagugaauucucugcaaugaagaugcgugagcacuguccuaguccucuucuugggacaagcaagccugaauccagcagcuucaaacuucacaccuguguuaaaaaaaaaacaaaacccgccggguguacuggcucacgccuguaaucccagcaccuugggaggcugaggcggguggaucauuugaggucaggaguucgagaccagccuggccaacauggugaaaccccgccucuacuaaaaauacaaaaauuugcugggcaugauggugggcgccuguaguccuagcuacuugggaggcugagucaggagaaucgcuugaaccuggaggcggagguugcggugaacugagaucacgccacugcacuccagccugggcgacagagugagacucugucucaaaacaaaaacaaaaacaacagaaaaaaccaaaaucaaaaccaaaaaccaccacgccugugccaccucacagucaaacaccacaccugugccaccucacagucaaacaccacgccuaugccaccucacaaacaccacaccugugccaccucacagucaaacaccacgccugugccaccucacagucaaacacuaugccugugccaccucacaaacaccacgccugugccaccucacagucaaacgccacgccuuugccaccucacagucaaacgccacgccugugccaccucacagucaaaugucacgccugugccaccucacagucaaacgccacgccugugccaccucacaaacaccacgccugugccaccucacagucaaacaccaugacugugccaccucacagucaaacgccacgccugugccaccucacaaacaccacgccugugccaccucacagucaaacgccacgccugugccaccucacagucaaacgccacgccugugccaccucacagucaaacgccacgccugugccaccucacagucaaacgccacgccugugccaccucacagucaaacgccacgccugugccaccucacagucaaacgccacgccugugccaccucacaaacaccacgccugugccaccucacugucaaacaccacaccugagccaccucacaaacaccaugccugagccaccucaggggucccggaggccgauggggaggcucugcucaggccuccuuggagcucagucagccagguugugguuaccuggaggcuugacuggggcugcaggaccugcuucuaaguucacccauguggcuuuuggcaggaggccucauuucuuugccacaugggccucccugaggggcagccugaguguguucacgauguggcagcuugauuucccauaaugagugaccccagugggcaugagcgggccccacagagcccugugugaccugguccucaccagcugagauuucgucugcuccuuaacucugucuagcccuuacucagugggaggaggaucgggcuccacuuuuugaagggagugauuucaaaaccgcucuucuccguaaggagugucggucagaaacggugcuuguggaaugguguuagcauugaugcuggcucuggugccucccaccccuugugcuggacuuugguuggccacagacagguagggggcuuacagagaggauaggcaggugcagagcuuucuuuguucccuuguuuccuucuuucuuucucuuuccuuuucuuuccuccccuccucuuccccuuccccuucccuuucccuuuccccuuccccuuccccuucccuuucccuuuccccuucccuuuccccuucccuuuccccuuccccuuccccuuccucuucccuuucccuuucuguuuugcucuuguugcccacgcuggacugcaguggcaugaucucagcucagugcaaccucugccucccagauuccagagauucuccugcgucagcuucccaagugucugggauuguaggcgcccaccaccacaccuggcuaauuuuuguauuuuuaguagagaugggguuucaccauauuggccaggcuggucuugaacucuuggccucagguaauccgccugccuuggccucacaaagugcugggauuacaggcgugagccaccacucccggcuugccccguuuucuucagugacuuuguuaaugagccagaacagugaugugggugcugcacaccccauucugcuccugggacucaaccucaccugaaauaaaagcuuuucguuuauuugcuucaugugggggccagguaauaccugcccgcccugaagugugcauugccuuaaauucagccgcuuuggucugcuugcucacgagugucuucagugugaccguagucaucgcuuucugguaaaaagguuuguggggagagggccucaucaaaugucaggaaagccccugaggagacaggcagugucuucaggggccacgucugcaaacccagagcccuccugaccgcggcugcagaggacagugccaagacuccugaggggccagggcugccugcucucccucuuuccagcucuuugcucaucccacccaaaaacuggcucccaccuuucucugugucccucaucugccgucugugugccccucucccugucagccaaccagucuucacccacacccaccuaccccugccugcaccgcaucaccugaauauguggcaccuuuggugaacacuuggcccccagccuggguuaccugucaguuccugguuuuguuuuguuuuuuggagacagggucucucucucuguugcccuggcuggaguguagugguauaaucacagcucacugcagucuccaucuccuggacccaggugauccucccaccucagccuccuaaguagcugggaccacaggugcacacuccugugcccagcuaauauucucaauuuuuuaagagacagagccuuacuauguuguccaaguuggucucaaauuccugggcucaagccaucuuccugccucaccucccaaagugcugggauugcaggcgugcgccaccaggcccaggcuuugccacuuccuguuugugucaagcuccucuccaccucagggccaaaaagaaaugcucugauuuuccucuacaacuuuuauaauuguguguuaccggacaauuaguccugacucugggugggcacacacacauacccaccaugcacacucacccccacgcuuaugugcacacucaggugcacacucccacucaugugcacacucccacucaugugcaccgcugcaugcucacgcucgcucacauccgcaccccggcugugcugugcuugcaccuggcggacucgguaugcgcagcccagcucuaguccggcgucccuggcguguguugugcagucugcgugcgcaacuguguucacccugcagggcuccuaugucggggcuuaucagugggaccguucggcgaucauccucaaccccccgccacccccugcugucugcucugagucuaggcucacaccagcuuccccaggugucagagggcugcucucugagcagggugcaggggcacugccuucccugccuuucccuuggaaacagugcauguuuuccuaggaaaacauuuaggauuuucugcuuuuuuuuuuuuuuucccgagauggagucucgcucugucacccgggcuggagugcaauggugccaucucggcuaacugcaaccucugccucccagguucaagcgauucucugccucagucuccugaguagcugggauuacaggugccugccaccaugccuggcuaauuuuuuguauuuuuaguagagaggggguuucacuauguuggccaugcuggucucgaacucuagaccucaggaaauccacccaccucagccucccaaagugcugggauuacaggcauaagccaccaugcccggcuuuuacuggcgaagcuacuuuuucuguuuuuauuggcaaagcuauguuucaaaguugaaauuaaaauaugaccauugaaaauaugcacaucaguuaugguuccagcagaguguggaagcagcugcugguuucuauaaaagcgugugcuuuuagggcuuugaaaagcuuuugccacguagagaaggcgcucagcugccucuggagagaccgaggcugcugcagagaaagaaacagcuuccuauguggcccugcagcugggucacccagagccugaggaguucuucagacaggcaggcagcuuuggggccagcaguuacaucaugggcuagaaccuaaggacaagcuagaggugcauguggccguguucacaccuucaggcccgcugcguuuuuggaggucuuggguuuagugagcagauggugccuuccgcggccucagucacgagagcgcaaggcuuguccuccaugggggggccucugcugcaccugcugagcuguuuucucugugccuccugggugaaaauugaaaaaccaaaagcuuugagcagcuccugguaccaagaaaaggacugacuuaguuuguuuuugcugcuguaacaaaauacccccgacgacgucacuuauaaauaagagaaauguauuucucaagaguucugggcugggcacaguggcucacgccuguaaucccagcacuuugggaggccgaggugggcagaucaugaggucaggagaucgagaccauccuggcuaacacagugaaacccugucucuacuaaaaauacaaaaaauuagccggcaugguggcggacgccuguauucccagcuacuugggaggcugaggcaggagaauggccugaacccgggaggcggagguugcagugagccgagaccgcgccacugcacuccaaccugggcgacagagcaagacuccgucucaaaaaaaaaaaaagaguucuggaggcugggagcccaagacccaggccccagcaagucugguguauggugagagccugcccucugcuuccaagauggccucuuguggcuguguccucaccuggcggaggagauagaggacgcggaggacugaggcugguucccuccagcccuuuaugaggcucucgugucuugugcaggcccgcaggaccugaucaacucccaacaccaugguagagauuuggagguauacguucaaacuguagcagggaccaucaagaacauggaauguuugagacggcgcagaccgaaaaucuggaauuuguagcugcugauuuuucuugcuuguuuucucagaccuucucuccaggagccaugcccaggguggucagagguggugagugagguggcagaagcgagugcugggcagggggcgcacugcugggcacucacuccauaccuccugaugggcacuggcugucccaucccccuugggaugaggagccggugccaucaguggcugcacggucagggcggagaguccccuccuucugccucuguguggagggcuggggagacagggaggaucuuuguucuccagcuuccuggcuuuguaaggcugugugccccucacagcccgagcagguugucugagcagggcucacucagccaguuuuuucaugugccgucggccagcuccccugucuagaaugcuccaguccguacuuuccuaauaacccucucuucugcaggguugggagggcgcucaccagaggcaacaaggggucuagggucccggugcuucucacacuggccuccucgccugacacacgcacggagcuugcucuggccaucucugucccugccugugccauggacaucccugcgcccugugggccucuguggcuuggccggccugugccucccuguggcaggagggaggugcuuggcucugcuuggcugccuguuucaacaugcacugugcugcgcuccaggcacugccaggcccuuggggagcaccccccacccuugacugcugccuggcccugcugcagagcggcccacggccagggccgccuuggcugugaggggacccugugagccccucccacaugguggauggagcuugcgcuuucucaagagaguaaacccguguuuuaguuugacaaaagccagaggcuuuggcaaggggcagguacagauguggcugagacagggcccuggacguuugcugagugacgucaggucagcucguaggaggcuucccugaccuuccagggucucaccggcuuccgguagcugaguuaacccaccucaggugcuggaggcccuccagcugucagcugggguccgugcaccccccagacugccuggagggcuucgcacacaguuugaaaggccucugcgcuuuggagcccaauuuggaacuugaaggcuugaccuuuguguuuuggacaacuguuuuguguuuaaccucagauggaagugaccauccaaccagagugaugguagcaggagcugggacggagccccggggcuggcgcccagggacagggggcgcgaggcggauggguggcgcaguccaggccagcaucggccccgugggccucgguuuccaccgucucuacagcguggguggccccuucaguuccguguggccuucgcuagcgcuguugggcgcugagcuguacagcugccgugucugugggcagaaguuuuuucuccugcaccgacugugucguccagaggcguucagagccugcuguuuucacgcucuagccgcacagcugugcccgcgagugcgagucccgcguccgaggccucggcgugagcuuacagcaucugucggguccgagcagucaguccagagggucgacucugaaugaaaacaaaacgccgugguuugaaauggaaggaaaccuggccccugaaggugcguagcguccccgccaccccggugcguguguagugcagccugguggugcuguggauuggaggccauccugugugggcagcacggcagccagagucugcaaggucacgggugacaccagaccgagcuggugagacccggaccuccacgccauccagcaggggcccagcagaccagccacauccucaugccgggccuggggcuuguacggacaagugauguccaugggcaaauucacuuugauuugaaugaaaaauaaguuaugcaucccuauuuugugaccaaaacauguggccaguuguaucuuuaaagauuugaguggggcugggcgugguggcucaugcuuguaaucccagcacuuugggaggcugaggcgggaggauuguuugagcccaggaguuugagaccagccuggucaacaaagcgagaccccaucgcuacagaaaauacaaaaauuagaccggcaugaugguauguaccuguugucucagccacuugagaggcugaggugggagaauugcuugagcccgggaggucgaggcugcagugagcuaugauugcaccucugcacuccagccugggaaacagagcaagacccugucucaaaaaaaaaaaaaaaaauuauucuuuagaauuuuacuucucagugauucacuuuuuauaguagaaccacaaagacagaaaauaugucaauucgucuuuugucuauuuauuuauuuuuuugagacagagucucacucugucucccaggcuggagugcaguggcccaaucucggcucacugcaagcuccgccucccggguucacgccauucuccugccucagccucccgaguagcugggacuacaggcgcccgccaccacgccugguuaauuuuuuguauuuuuaguagagacggggcuucaccguguuagccaggauggucuugaucuccugaccucgugauccgcccgccccggccucccaaagugcugggauuacaggugugagccaccaugccuggcgucaauuugucuuuuagagcccaauaauauccuuagaaaaaaggagcucuguccccgagggccaugugcuuuuauaaaaaucagucgcuggaaguguuuccaggaaguguuugagguucccgucugugggguguuuccuugcucuggacgaaggugauuuggggaguuucuuggguccuguggaauuggugagcuugugcucuaggucauaacuuuagguggccgagggugcugugucaguguggccuugucaucggcaucauggcgccccugugcccugcaggcguggccaguggcacccacgugcccucacaagccugagccacgaggugaggcgucugaagccagcgugguguggucgaggaggggagccuugacccugaggaggccuggaggugacccggcagguggggcuggguaggaaggcugcucccaguggcaguggacgaguggcauggacggcgcugggcaccacagacgggggacuugaggcaaggacugggagguggcggggggugggggcccgggagugcugaggggcuggugcccuggucguggccauggacucgugccccagcuggacacaccugcugggucucagggcccuggagacgcccaagagagcacgccuggguggauggagacuguuugcagcucagagugcucugguuggggggugcagccuggggggacccccuauuccuaacaggccuugggaagggaggcuacugagugagauauagccggggggcagagugagaagggggugguggcggcaccuccggagggcagagggagggccggagccuggcacucagggaccugcuguggacaggccugggcguggcauggggguacuggaagcuacucgccugggaugagggcgggccuugcccaggggagaccccugugugugcaccuguuugucgcacguauuuugagaugagaaggauuugcauguguuucuauuagaguaacuauuaggggaggaggugcaaggacagagaaggugggagcugcgucuggugggccccugaggacaccgacgaggugggguuccaggggccuuaugggggcagguggaggagagacagagccaccacagggccucagagguggcugugaggugcuugcugagagcggcccuggguggggcuguugucagaaguggaggcacaaggcacccucucuggacaggccaccugccaaggacaagacugggauaaggcugucaccugugagcccugggcaucuuggggcuugcuuaggugucaggugcccaccaaccugguccguugggucugggcagggccaggcugugcgucucugcccacaccagcugggcgggggcugaggagagcugaggggccagcugguugggcuggggcgggcaugggcagggucugagaaaggggcucugagagcuguggcugguguacaggggaccaaggccccugcuuuguguggucuuggggauggccagagccccagcacaccgagcccucgauggguuggugggaugcugccuccugugugaucugcuagaaaugcuuuaagcccguaucuuuucuauugcagacuuuaaaaaauucaaaaagccuuugcucccucaauuacgaagaugacgaugaggaugacaccccagugaagacgguucuguccuccccaugugacucccggggccucccuggcaucaccaugccuggcugcagccagaggggccucaggaccagcccuguccaccccaaccugugggccucuagggagucggugaccagugauggcucccgcaggagcagcggggacccccgugauggggacagugucggggaggagggcgucuucccccgggcccgcugggagcuggaccuggagcagaucgagaacaacugaggcuggugggggcuggucggggccauggcugccgccugcaccugcccuggggcacagaguagguuuccugugagcuggucggggccacggcccggcaccugcccuggggcacagaguagguuuccugugagcuggucggggccacggcugccgccggcaccugcccuggggcacagaguagguuuccugugagcuggucggggccacggcugccgccggcaccugcccuggggcacagaguagguuuccugugagcuggucggggccacggcugccaccggcaccugcccuggggcacagaguagguuuccugugagcuggucggggccacggcugccgccugcacugcccuggggcacagacuagguuuccugugagcuggucggggccauggcugcugccugcaccugccccagggcacagaguagguuuccugugagcuggucggggccauggcugccgccugcaccugccccggggcacagaguagguuuccugugagcuggucggggccauggcugccaccggcaccugcccuggggcacagaguagguuuccugugaguuggucggggccacggcugccgccugcacugcccuggggcacagacuagguuucaugugagcuggucggggccauggcugcugccggcaccugcccuggggcacagaguagguuucguguugcuuggaacauuaaggcguaauuuugauucaguuuuuccuaaagaagcauuuugcauuuuuauggcuuuugcaguucgggagaaagcuucucuauuuuggaugcauuucagaagggcguucuauuaaacaugaaucugcaaacagauuaacaugcgucuguguuccccacgaaaggccugcugugcagggcgccuugugugcuuuaguugcuaggaaaccccgggcguugguggucagagucccacuggccccgugugucccccccucccgacgggucacggugcuuggggcuugcgcaugggcaucugugcccaugaaccuugucacccacgugccagugaaccgccagcuuguggccgccugguuuuccaccgguggcagugauggccuuuggggcagaccaaggugccaugagucccugcuucccguggccugggagggcccuugcaccuucaggugggguguagugccagaccucugggaaggcuguccugccggcagcacccgucagcacccacucugugaauuuaauacaaggccuuugcuuugugcauacgacuucugauuaauuuucguuuccaccaucugaagugggccuggcugcgccucaggccucuggucucuggcucagaaccagacaaggcaagggauuuccuguuuuucauucuugcacuuuuaauaaaaucguagggguuucgaguuugcgauagcaaaagaaaacauuaa

SEQ ID NO: 192934 - RNA, 24957 nt, Homo sapiens
accccuggagcugggacacgucccauuuucuuuuauuuauacaaaaaguuacuuuuuuaaauauaauuuaagaaccccuccaagcaccggcguccguuucuggguuccaccaccaacuaccgcccuuuucacuaccucaccccacaccccuucauaggacacagcuugggggucccaggcgggguccggggaugugggaugaccaaggcacuguucuggaaacagacaugaugaugggccccuguuucaacuugggcaaaggaggccauagugaaacagguucccuccaacacaaaguuaugacaaggacgguagaaaaacaaaacgaagaaacaaaaagggaacggggagaaaaauuaagaccaaaaacaaaacucaaaaaccuucaauaugaaggcagcagcugggggaggggcauuuacaagggaaaaaaaugauugaguuugguggugacagcagcaaguugggacuacaaaccccaaugauuuugucacugggcccugacaccccuucuugcccccugggacagcccccccacucuggagcuggcaagggagucacacucucuuuggucugcgggaacgcacccaucaaggugaggggggcaccuggggaggcugggagauguugggcacuuccuuuuccucuggucacacccaguccugagggaaaggcgcccucacccuuggucuggaguuccccgagguggcuggggggugauuuuccccuccuauuauggcagaacccccaaauccugucucuccaaauugccaacuccucaccccacgggcucaaagugcaauccagcggggcacagggcugggggccucugugaguccccacucugccccggaaaauggggaggcggugucccugggguggggaguuccugcaggucaguacugcggggccgguccuccugucccacccgggguucccggcuuggccugggacuucaugugcuggacacuggccaagauuuucuucuggugucccgccagagugacuccgauucggagcaggucccugcagaaggaaaggagagcuuggugagacccuagguucccuguggccgcucuccucucuuggcuccugagacgguccuagccucaggauuguaagccaaucagaaaagccagcgggggagggagaacagaugucaacaguucccgggcaguuuuuuuaagagcugggcagccauccuucugugcaaccgcagaaggggguagggcuggaggccagaggcagggccuuuggcuugggugccagggaaggaaagaaaagagagaaaagcccgcaaaaugagacugggggaagaggcugcacagauugccguagagggaaauggagugugagaaagaaaaggccgaagugggagaggaagagcuggguggagaggaagaggagguugcugauggcuggaggcugagauaaggggaaaaaagggagaggaggcccccugggucagagagaggcugggaagaauuagggagggaugugcccaggccccguggggcaggggcagacuggccugagacccucuggcucuagccuccugaguagcugggaccacaggcacgcaccaccaugcccagcuaauuuuuuuguuuuuguuuuguagagaugggguuuugcuauuuuggccaggcugcucucaaacuccugggcucaagcaaucgguccaccugagccucccaaagugcugagauuacaggcgugagccaccaccuggccuucacauuucuuuuuuuuuuuuuuuuuuuuuuuugagauggaauuucacucugucauccaggcuggagugcaguggugcgaucucggcucacugcaaccuccaccucccggguucaagcgauucuccugccucagccuccucaguagcugguauuacaggcacgcaccaccaugcccagcuaauuuuuguauuuuuaguagacauaagguuucaccaaguuguccacaauggucucgaacuccuaaccucaagugaucugcccaccucggccucccaaagugcuggcauuacaggcaugagccaccaugcccggccuucagauuucuauuccuucuauuucuguuauucaaccuggggugagaggagaucuugggagaggaacgggaaggcagaaagggggaguagcagacaaaggccaaguggggauacgcagccuuugggaggcaaggaaucauaaaaccauuucacauaaaagcugaagaggaucuccaaaaccuagcccaaucuucuccuuuuaugguuggaaaaagagaacccgaguugacacauuguuaccgugagagccgggccuggaaugcagauagaugcacaaagauagcuagaagugagaggcggaagcgcgauggcccagggcugugauggcaggaggaggugaggcgggcaggcuggccccaaagaguccuuggguccucagcuccauggggcugugacugcuccucuggggcccuucuaggcauggcaugagcgcagugcaagaagacagcauuggcacccgaagcugaccccaaaagccccuggagaccccgugggccugacuccagcugccccgcucucccagccccacuccagcuccugccacugcuuacucagcagagaucuggcugaccagcucgaaggagccaaagccagcggcugcgaaacuuucuucguaucuucccauuuugauggcccgaagccacucgcccacagagccaaaagcugaguagugaggcugccgcugguccaggagagggugugaggcccuagggggcaaggauggggaggaaugcugaguaccaggcccagguccgggggaggagguggaacccagccuugcagaggcggacagaggcccucccacccaacaccaaugaacggacacuucugggcaaggagugggggcagagagcgggaaggagggcccauucucugcaguccucacccgccauucucccgggccacgauuuugaggcuggcgggguuccggaucaucuuguccagggcgcugaccaccugggggaagcggggccgggcauuccggucuuucugccaacaguccagcaugagcugguggagggaggugggacagucugggggcgggggcagccgguaguccuguucaauggcauugaucaccuggaaagaggggaagaagcucugggugaggcuguccaggaaaagcaaagaugcuaacaggcccaggaaauggugacuuggaagaugguaggauaggagccacagccccccaaaaaauaacagauccaggaauccuccuagccggaguugaagcucucuguggcugaaggccccagcagcucuugggcuaugauacagacauguuaccucucaacccugcccuccaucucugcauccuucugcgacccaaauaugcuguacccaacucuuuuauuuauuuauuaagacagagucucgcucaguugcccaggcuggaaagcaauggcgugaucucagcucacugcaaccucuguuccuggguucaagcgauuauccugucucagccuccugaguagcugggauuacaggcacccgcccaucaugcugggcuaauuuuuuguauuuuuuuagagacgggguuucaccauguuggccaggcuggucuugaacuccuaaccuuaggugaucugcccaccuuggccucccaaagugcugggauuacaggcuugagccacuaggccuggcccuguaucucaacucuuugauacaaagaucaauucuccuuuuugucaucuccauggucucaagaacccagcagugaugacucucugggaacccacccuucaccccaaaucccaggugagagaacacucgaggaaagcuugguaggaccacgggacacuuacguccugauugcucaugucccaguacggccucuccccaaaugacaucaccucccacaucacaaucccguaacuccaggcaucacuggcggaagugaacuuccggaaggcaauggccuccggggcaguccaucggaugggaaucuuuccucccugcagaaaaaggagaaaaggugagcugggggacucacugagggacucaccagacccagcacacugccccccagucccccaccugccucugcuuuuucccccuagcucaggccccaagccuccuacucuccaacucuguuugcccagguuggagugcaguggugcgaucuuggcucacugaaacuccgccucccggguucaacugguucuccuaccucagccuccugaguagcucggauuacaggcguguaccaccacccucagcuaauuuuguauuuuuaguagcgacaggguuuucccauguuggccaggcuggucucgaacuccugaccucaggcgauccuccugccucagccucccaaagugcuggauuuacaggcgugagccaccacaccuggccacuguucuuuugagacagggucuugcucugucgcccagucugcaguacaguggcacauucauagcucacugcagccuccaacuccugggcuuaagcaauccuccugccucaaccucccaaguagcugggacuacaggugcaugccacugcgccuggcuaaucuuuuaauuuuuuuguagagauggggucuugcuauguugcccagguuauccaacuguuauuuuccuagacaucuggaagucggcuuccuggagcugacuguccccccacccacagccugcuccuguauccucucccuggagcagggcugccaaacccucagccucccaccuuuccaaccugcccugcccaccuggcccuaagaagcucacacccaguauuacccccagcauuaccagggagcucguguaggugggaucggaagaguucuccuccaggaaucgggaaaggccaaagucagacacuuugcagacgagguugcuguugacuaggauguugcgagcagccaggucucgguggacguagcucaucucggcaagguaccgcaugcccgaggcgaugccccgcagcaugcccacgagcuggaugacugugaacuguccgucguuuagcuggagagcagauagggugggggcuuggugaggacagcccacccaccguucccccucccauccacaucuuuuuuuuuuagagacagggucuuguucugucgcccaggcuggagugcaguggugccaucauagcucacugcagccucaaccuccugggcucaggcaagccuccugaguagcuggaacaauaggcaugugccauuaugccuggauaauuuuuuaauuuuuaguagagauagguucccacuauguugcccaggcuggucuuuaacuccuggccugaagcgauccuuccgccugggucucccaaagcacugggauuacagauguugagucaccguacccagccucccguccacuuccuaaacugcaucugucacuuccagacccaccucacaacucaccuguagggcaagccccccaacucccucaggugagccuuccuccuuucucuuuucccaaguuuucucagcucuugcuacaguaucacaacacauugcuuacaaugguuccugcuucaaugguaagcauucagucucucccaaucggauuaugaguugaaaaauuauuucaacuuuuccuuccauuuaaccugguacacugcuuuauacccaggaaauacucaacaaaugcuuuucuguuuuuuaguuuuuuuagagacaaggucucuuucuuucccccagguuggagugcaguggcacgaucaugguucaccgcagccuuaaacuccugggcucaaaugauccuucugccucagccuccuuaguagcugggacuauaggugcacaccacugcaccuggcuaauuaaaacaaagggguuuuuuugguagauauggggucucacuguguuucccaggcuugucuccaacuccuggccucaagcaaucuucccaccuuggccucccaaggugcugggauuacaggcaugagucaccugagcaacccgucuacagguggagauacauuggugcugauccaaccacaaagcuguucagcucucuuggacuagcuguguauggauuugcaagagaagagugaggaacugcaguaugaccaaugaucggugcaaaaaccaaggucugaagcccaaccuugaccuuuaaagaguuugcucucaccagggaaaccaacaagucacagacaguaaacaaaucccguauucuggguuccgcuaagauuuggcagaccaucugcagcccuacagaaccagggacauagacuccaaaaacugaauuuugaauccauccuccagaccugcaccugcccuacuccccgcucaguuuguggcaacaccaccacuugccagauggucaggguauagaccucagaguuuccuuugacccccuuuucucccucaccagccacuuccaauccaucagcaaguucugcuggugaugcuuccaagacaugucccaaauccaaacccuucccuucaccccacggccuggaugcuggcaacaggcuucugcugcaggccucucccagcuccugcucuugcucccuagcacccagcaaagaggucuuuuuauuuauuuauuuuuuugagauggagucucgcucuacugcccaggcuggaguaaaguggcgugaucuuggcucacugcaaccucugccuccugaguucaagcgauucuccugucuuagucuccugaguagcugggauuacaggggugcaccaccaugccuggcugguuuuuguauuuuuaguacagacaggguuucaccauguuggccaggcuggucucgaacuccugaccucaagugauccaccugccccggccuccccaagugcugggaucacaagugugagccacugugcccagcugggauccucuuaaacuacucuccugccaaagcccuccagcggguucccgucacacugcccaaugcagcaucuaccaucucuccucuguucaccaguuucaccugugcuggucuucccaucucucucucuuuuuaagagaugggaucgcccaggcuggaaugcaguagugcaaugauggcucacuacagccucgaucucccaggcuuaagugauccucccgccucagccucccgaguagcugggacuacagauaugcaccaucaugcucugcccauuuuuguauuuuguguagagacgggguuucaccauguugcccagggugaucucuaacuccuggccucgagugauccaccagccucagcuucccaaagugcugggauuacaggugugugucacugaaccuuuaagacccuuucugucucuucgaccaggcacgguggcucacgcguuuaaucccagcacuuugggaggccaaggaggguggauggcuugaggccagggguuucagaucagccuggccaacauggcgaagcccugucucuacuaaaaauacaaaaauuagccgggcauaguggcucaugccuguaaucccagcacugugggaggcugagguggugggcagaucacgaggucagaaguucgagaccauccuggccaauauggugaaacccugucucuacuaaaaauacaaaaauuagcugggcaugguggcacucgccuguagucccagcuacucaggaggcugaggcagaagaaucucuugaacccaggaggcggagguugcagugagccgagauugugccacugcacuccagccugggcgacagcaggacuccaucucaaaaaacaaacaaacaaaaccaaaaaaaccccacaucagauagagcuucucuuacaggaaauacagagagacaagcuaaaugaucccauaagaagaauuucauaaauccagaaaucaagacauucaggcggacaagggaccuaacccuucagugugucagugucaucaugaggaacugcucaagauuuagagaggcucgaaaauauaauaaucagcaggcgugguggcucacgccuguaaucccagcacuuugagagguuaaggagggaggaucgcuugaguccaggaguuugagaccagccugggcaacauagcgagacccccaucuccguaaaaaauuuaaaaauuagccaggugugguggugugcaccuguaguuccagcuacccaggaggcugaggcaggaggaucaccugagccaaggaguuuggaggcugcagugagcuaugauugcaccacugcacucuaaacugggcgaaagggcaagaccuuguuucuaaaauaaauaaauaaaauauauauaauaaccagguacaaagcccggucuugaacuggauccugguuggaauaaagcagcagugaaggacaucuuuagaacaacuagagaaacgugaaaaucaacuggguauucaaugacgcuagggaaucgcuauaacucuguucaaugcaauguuauuuugcuacauagaaaaauguuuugauuuuuuuaaaaagaugccuaggccaggcaugguggcucaugccuguaaucccagcacuuugaggggccgagauggguggaucacuugagcccaggaguucaagaccagccugggcaacaugaugaaacccugucucuacuaaaaauacaaacaucagcuggguaugguggugcaugccaugcaauuccaagcuacucaggaggcugaggcaggagaaucacuugaacccaggagguggacguugcggugagccaagaacgcaccacugcacuccagccugggugacagauggaaacuccaucucaagaaaaaagaaaagcuuaauaaaguuaaaaaaaaaaaaaaagucaguaaaaucugguaaagugaccaaauaaauuaagcaguucucuuuccucucuagccacaucugcaugaaggaccccguuugcuuuuuuucacauuugaaaugauuuguuuacuuuuuuaaaaagccugucuauuuacuugcuaauuuucagucccccugccccauuagacccucugcuccccaagaggagaaauccaguuugccguguguauagcuuuauuccuggggacugggaggaugaccggugcguagaaagcacucaguaaauauuugucaaaagaaggaaugacaggccaggcacaguggcucaugccugcaaucccagugcugugggaggcugaggagggaggcucgcuugaggccaggaguucagaccagccugggcaaccuaucgagauccugucucuacaaaaaauuuuaaaaauuugcugagcauggugguacaugaguguaguuccagcuacucaggaggcugaggcgggaggaucacuugagcccaggaggucaaggcuacagugagcuaugaaugcaccacugcacuccagccuagaggacagagugagacucugucuuaaaaaaaaaaaaaaaaaauuggccgggcgcgguggcucacgucuguaaucccagcacuuugggaggccgaggcaggcggaucaccugaggucgggaguucgagaccagccugaccaacacagagaaacccccgucucuacuaaaaauacaaaauuagucaagcgugguggcacaugccuauaaucccagcuacuggggaggcuaaggcaggagaaucgcuugaaccugggaggcggagguugcggugagccaagaucuugccauugcacuccggccugggcaacaagagugaaacuccaucucaaaaaaaaaaaauucaauuaaaacaaaauuaaaaaaaaaaagaaggaaugacaaccuucagcuguauggggcagugggaaaggaaggucccaggagcccagccuuucccagagggaaaauuaaaggcagagggcuggccaggcguggugccucacaccuguaauaccagcacuuugggaggcugagguggggagaucacuugaggucaggaguuugauaccagccuggccuacauggugaaacccugugucuacuaaaaauacaaaaauuagucagcaugguggugcaugccuauaguaccagcuacuugggagacugaggcaggagaaucgcuugaacccuggagguggagacagcaaugagccgagaucgcgccacugcacuccagccugggcgacagagcgaggcucugucuuaaaaaaaagaaaaggcagaggaccagggcuuagcccaagaggaaaaggcuggaggaggugaccugggacccacugucuguccuggcuucuuaacccaaguggccucuggguguaagugggaacuccggguggccgcagaagccagggagggugcucacccgcaggaaggaguccagggcgccguucuccaugaacucugugagaaucaugacgggcaugcuguuggugaccacgcccuccaggcggaugauauuggggugcucgaacuggcccaugauggaggccucgcucagaaacucacgccgcugccgcuccguguagccacccuucagggucuugauugccacacagcucuccuucuucccuggggccuugagccgcccccggcacaccucgccaaacucaccuucaaacaaggacgcagaggucaucagcucucccgcuccaguguggcccugcccacccccgcuucguucccaggugcccgggcagccuucggcucucaccugcaccaaucaccucuucaaucuugacguaggagacaucgaucucuuuugcaaauucccucacagccucauuagggucuucauaagugaaggggucgauguagaccuuaguaccugagaaaucaggcagggccccgucagcugggaauuaacucccacuggacucggaggcucggcucauagcuuuuagccccaaaccccugucuccgugguuuuuuuuuuuuuuuuuuuuuuuccugagauggagucucgcucugucacccaggccuggagcgcaguggcgcgaucuuggcucacugcaaucuccgccucccggguuaaaaugauucuucugccucagccuccugaguagcugggauuacaggugcccaccaccaugccuggcugacugauguauuuuuuauagagauggaguuucaacauguuggccaggcuggucucgaacuccugaccucaagugaucugcccaccucugccucccaaagugcugggauuauagauaggagccaccacacccggccccaagccccuauucccaucaaauuagggcaacccaccauguccgaugagauacuguccguguuuguccgaauauucugcuucucucccauugcucugcuuccuguagccgaugggaaaggaacaaaagguaaacugagucacacaucuuuaugaggcacacacaccaaaggaaggagcagggauuggagaagauuucaaguaaaaagaggcuggggacagccagaaaggcuuguccuguagcacccaggcagguggccaucaacugagggcuuccaggggccucugggugucagagcccuuaccugaggcagagaacugcgaccacaaugaccaccaggaccaggaccacacccacgacugccgugcccgcaaucagggccagcugcucccgccagcccucgcucucugcggaaggaaaggcugcugaucaggagaaacugaugguccuguaggaggccccagccccggcuuugagcaaugaacugugaucuccugagaacagguccccaguacaggggacagguggagggagaggacacaagcaggcaaggucagggaacaaacaguggguuucaaacucucccccaggggccagcaggcuccucugaaguaccucagggcaagggaggaaguuucgaaaucuuuucuuacugccagaguaauuuuuuguuuguuuuuuugagacgcagucucacucugucgcccaggcuggagugcaguggcgcaaucucagcucacugcaaucuccgccucccggguucugcgauucuccugccucagccuccugaguagcugggauuacagguguguaccaccaugcucggcuaauuuguguauuuuuaguagagaugggcuuucaccagguuggacaggcuagucucaaaccagccuaggcaugcccagccgccagagugguuuugauuugguucuaguauaaauaccagaguccacaaaaaaaucuccauucaaugaaacguucuaaaggugaaacauuuucagguuuuuauccaaaaagucgauacaauugaaauguucaccaaaagauacaauaaaaaacaaaaucagcuauuuccauacaacugauuauuacgucuccauaaaaagaaaugaaauauuggccaggagcaguggcucaugccuguaaucccagcacucugagauacugaggugggaggauugugugaggccagguguucaagaccagccugggaaacauagcaagaccccgucucuaucaaaaaauaauaauaauuagccaagcaugguggugagcacguguggucccagauacucaggaggcugagguaggaggaucgcuugagcccaggaguuugaggcugcaaugcacuaugaucagaccauuacauuccagccugggugacaaagcaaaaucguguguucaaaacaaaaacaaaaaacaggccagguccaguggcucaugccuguaaucacagcacuuugggaggcugagguggguggauugccugagcucaggaguucgagaccagccugggaaacauggugaaacccugucuuuacaaaaaauaccaaaaaaaauuagcugggcaugguggcucaugccuacagucccagcugcuugggaggcugaggugggaggaucacuugagccugggagguugaggcugcagugagcuguaauugaaccacugcacuccagccugggugacagagcgagacccuguuuccaaaacaaacaaaaaacaaaccacaaccaaaaaaacccacggauauauacuacaacauacauaaaccuugaaaacauucugcucggugaacagucacaaaagaccacacuggaagauuucaagacagaaaguggguuagugcuugccagggacuaaggcaacagaaagaucuggguggggggugauggcuaagggcuauagggucucuuuugagggugcugaaaaugucccaaaauuacuugugguggugacugcacaauucugugaauguaucaaaagucaucgauuguacacuuugaacaggcaaauuguauggcaggggaacuguauuucaguaaagcuauuacagaaaauuacaagguuuagaaagccacugguccaaugcuggguguggcggcucaugccuguaaucccagcacuuugggaggccgaugcgggaggauugcucgaggucaggaauuugagaccagccugggcaacauagggaaacugucucaacaaaacauaaaaaaaaauuuaguugagcacgguagcacaugccuauagccccagcuacuugggaggcuaagguggaaggauugguugagcucgggaguuguaggcugcaaugagcuaugauggugccaccgcacuccagccugggugauaaaaaagaccgugucucuuaaaaaaaagaaaaaguuaggccgggcgugguggcucacgccagcagucccagcauuucgggaagccgaggcggguggaucaggaggucagcagaucgagaccaggagguggagcuugcggugagcugagaucgcgccaccgcacuccagccugggcaacagagugagacuccgucucaaaaaaaaaaaugugaaagaaaaaagaaagccacuggccuagcauauuaaaaauaaccuguuaccuccaauccucaaagcccugcaggaagcuucaugauauucccauuuuguuggauggggaauggggagcucaggggucagguuguugcuaaaagucaagccugcggugagcuuuuuuuuuuuugagacagagucuugcucuguugcccaggcuggagugcacuggcacaaucucagcucacugcaaccuccaccucccagguucaagcgauucuccugccucagccucccgaguagcugggauuacaggugugcaccaccacgcucagcuaacuucuauauuuuuaguagagacgcgguuucaccaugcuggucagacuggucucgaacuccugaccucaagugauccuccugcuucagccucccaaagugcugggguuacagggugagccacugugccuggcugugcagugagcuuugaucgagcaacugcgcuccagccuggggguacagagugaagcaggccagacuucacaaaacucagcuguugguuuugguuucgacaucuuacguucucuccucucuagggcaugccaugugauccacaggaagaaggacaugaagauaggacuuugaccgggugcaguggcucaugccuguaaucccagcacuucgggaggccgaggcgggcgaaucacaaggucaggaguucgagaccagccuggccaacgcggugaagccccgucucuacuaaaaauacaaaaaaucggccaggcgcgguggcaggcgccuguaaucccagcuacucgggaggcugaggcaggagaauggcuugaauccgggaggcggagguugcagugagcggagauggugccacugcacuccagccugagggacagagcaagacuccaucucaaaaaaaaaaaaaaaaaaaaaagaugaugggacuuuggagaccuggggucuucccaggaacuuugggggucuuuccaacccccacccucacccccuuccccaggcucaccauccaguugggucuggcugugauguuccuggccgaagggcccguagccggccucagagcgcgcccguaccugcaccagguagcuggcuccccgcuucagcccccgcagcucugcccgguuuucugacgucuucaggaaccgcacgcugcugggacccucggcgcccuguccgggagagguagugggguggccgucacccgggaacccaaguuccuguugcucuuccugccuccuucccucgcccuccacucccaucacuagccugccuugcaacuggugaggccuuugggagaacuuacgcaugcaagccaugugcuguauucauaauaucauuccuuuuuuuuaagacaaggucucacuuucucaggcuggaaugcaauggugcaaacacgacucacugcagccucgaccucaagucgagaaucacuuggguuccagugauucuccugucucagccuccugaguagcugggauuacaggggcccgccaacacacucagcugauuuugcuauuuguaguagagacggggauuucaccuuguuggccaggcuggucucgaacucuucaccccagguguucuacccaccucggccucccaaagugccgggauuacaggcaugagccacugugcccagucuaauuuuuuucauuuuaaguauuuuuugcguuuuuuuuuuuuuuuuuuuuuuuuggagacagagucuuguucuuucgcccaggccggacugcaguggcgcuaucucggcucacugcaagcuccgccuccuggguucacgccauucuccugccucagccucccgaguagcugggacuacaggcgccugccaccgcgccuggcuaauuuuuuguauuuuuaguagagaugggguuucaccguguuagccaggauggucucgauacuccugaccuugugauccgcccaccucggccucccaaagugcugggauuacaggcguaagcuaccgcgcccggcccauuuuaaguuuuuuauagagaugaaguuucaccauguugcccaggcuggucucaaacuccuaggcucaagcauucugcccgccucagccucccaaagugcuugguauuacaggcgugagccaccgcacccaaccucagccacuguguccagcugcugguaacuauuacaguaacuauuuuauagaugaagagucugaggcucagacaggccaaggggcuuacccaaggcugcccagggaauccauggcagagcuggaauucaaaugccugccaggugccugcaacccaggugucccagccaggagagcacaacccauugcccacccaccccagggcugggggauggccuuaccuucucaugguauuugaccucguaguccagcacagccccacugggugcccggggaacagcccaggccaggcucaagcugcugggugaggaccgcgucacccggaugucagacacugcaggagguacugugagaggcagagacacagggaacccuugugcaugguagcucugucccuuaacuuaaaaaaaauuuuuuuuuucgagacggagucgugcucuaucacccaggcuggagugcaguggcgcagucucagcuuacugcaaccuccgccuccuggguucaagcaauucuucugguugcuucccaaguggauuacaggugcccaccaccaugccuggcuaauuuuuuuauuuuuaguagacaugggguuucaccacguuggccaggcuagucuugaacuccugaccuugugaucagccuggccaugucccuuaucuuuuccaacacuuccucugcuggcuacacuugucucaauuucccccuggcuguuucgagaauuccuucugauucucucuggccccagucccacugggggccuuccuguacuuaacucuccagcccagcuuuacgagcuccucacccucucuuucuuauucauuuauuuugagagaggaucucacacugcucugucacccaggcuggcaugcagcggugcgaucauagcucacugcagccuccgacuccugggcucaagcaauccuccugccucagccucuugaguagcugggaccacaggcaugcaccaccucgccuggcuaauauuuuuauuuuuuguagagagaucuuccuauguuacccaggcuggucuugaacuccagggcucaagugauccgccugucucagccucugaaagugcugggauuacaggcgugagccacugcgcccagccauugcccucuuucugccucuugcccccaaagccuuagccccucacacuuccgggguacccaacuucacagccccugccucuccccuucaggcccucagugacaucucucccgccagaccaccagccgccccagcccccaagucucacccucucggucaguggugacauugacaggcucaaaugggacgggccccguggcuaaggaggauaccccguucaaugcagugaccucaaagguauaggugaagucaggacguagcccucgaaccaccacccagggcuccaccaggucccgggggccggggucaaaagucaggucucccccgcagggcgcacaggagccuccgggucggcacucccggcagcggagggcguaggugagguccucucggccaccagacuccaggggggcacuccauuccaggugcagggaggagccguucaggcgggaaaccacgcuccgcggagccgaaggaggggcugcaggagaccagggagucaggcagaggccgaccugcucugcggugguggggagagggcaauggaggcaccagcagccaugcuggacucuugccuuggagacagugggcuccacauguuccuccgggcuagggacaagcaugccagggacaaagggaagaagcccagggaggaugggggccaugugaggguccaccucagaggucugugaccccuccccagugaacugcaccugggugcuggucacuuacuggugcagggugcaccccgggggucugugcgugcccggaaguacccgacgcggcacuggcagacggcugauccaaugguguuagaguggcuauuggcugggcauggcuggcaggacccuucuccugacaggggcuugaaggugcccugggcacaggcugagagagagaaagcauucaucaaaagcaugcacaaaaacauccaucugcacggugggcucgguggcucaugccucgaaucccagcacuuugggaggcugaggcuggaggaucgcuugagccaagggguucaagaccagccugggcaacauaucgagaucccaucuccaaaaaaaaaaaaaaaaauuccagcuucuuuuaaggcugaugaagugcuaaggugggaaaauggacaaaagaucucaaaaccuuuccucuuagaggagaaaggagacucucuccagagaagggguccucaccuguuucgacccugaucucggcagucuggugaagcccacagaaagaccucuacuccaacuuaugauuuuaaaagcacuccacaaaauacauaggaauaccagggaaaccaauuaagcugaaaugcaaugaaacaugaggaaaaaaguuugggcuacagcaacauuugugcuucuuucuuaacauauagcagcaagucuccuaacaucugugauacugaagucaccaugagcaaaaacaaucuuuuggcacuuggaauggccuguaaauaccugugauuuuuuuuuuuuccugagaaggaggccaaagagggcagaucacuugaguucaagaccagccuggccaacaugguggaaaccugccucuacuaaaaauacaaaaguagccgggugugacgaugcauaccuauaaucccagcuacuccuugggaggcugaggcaggagaaucgccugaacccgggagguggagguugcggugagcugagaucccaccacugcacuccagccugggcaaaaagagcgaaacuccuucuuguuggagugcacucccagaccggagugcaguggcaugaucucggcuuaccgcaaccucugcuuccuggguucaaaugauucuccugccucagccucccaaguagcugggauuacaggcaugcgccaccauguccggcuaauuuuguauuuuuaguagagacaggguuucuccauguuggucaggcaggucgcccagauaauuaucuaaaaaguuuuuguaauccgggugugguggcucacaccuguaaucccagcacuuugggaggccaaggcgggcagaucaugaggucaggagaucgagaccauccuggcuaacacggugaaacuccaucucuacuaaaaauacaagaaauuagccgggcgugguggcggggccuguagucccagcuacucgggaggcugaggcaggagaaugguguuaacuugggaggcggagcuugcagugagccgagaucgcaccacugcacuccagccugggcgacagagcaagacucugucuugaaaaaaaaaaaaaaauuuuuuuuagagacggggucuugcucugucacccaggcugaucucgaacuccugggcucaagugauccucccaccuuggcaucucaaagugcuggcacuaugggcaugaaccacugugucaggcaauaccugugauuuccauggggcccaagugucagguccugcuacaacugcagguggaauuucaaguggaaauuaaugaauuucaggugaaaauaaagucuuuuuuuuuuccagcuggguguggugacgcacgccuguaaucccagcacuuugggaggccgaggcgggcaaaucacuucaggucaggaguucgagaccagccuggccaacauggcgaaaccccgucucuacuaaaauacaaaaauuagccgggcgugguggcgugugccuguagucccagcuacucacgaggcugaggcaggagaacugcuugaacagggacccgggaggcaaagguugcaguugagcagagauugugccacugcacuccagccugggugacagagcaagccuccauuucaacaucuaacuauacaaaauggaaacuuaagaaguggguccugaguggaguucaggacucucccccggaugagcagcagucgcaggggaagcuccagcucucaccucggcacuugguguuccccucagcugccucgaaccccggagcacagcugcagcccgugaccggcuguucggcccacuggccauccucacggcaguagaggcuggggcuggggccaggggcggggacggcauccaccacgcagcuaccggccacgggcacaaccagcucccgaggcacagucuccgggaaucgagucagguucacagucagcugggcgcacuuuuuguagaagaggugcagggauagcagggccaugcaggcacccugguccuggaaggccagguagaagccagccuugcugagcggucccagacgcagcgucuugacauucaccuucccgguggccucggccccagggcgcuuccgggugagaugcuccgcggccaccguguccaccugccggcgggggggaggcacaccgcugcuguccccacucccugaggacccagcggacuguuguguucuucccagcucacccucccggaccuccuugguucccguuccagaaucuucccuccaccuuccccagggcacacuuucugcaggcccccacacuguccauucagccuugcaaagcuccugcgauaugcccggccucuggccugcaccucucccccuuuuuauucacucguucuacaaacauuuacugacacugacgccaugccaggccuugaccucagagucaaggagacagcgaugaaugaauccuggggaaguuauaaaguaccaugaggccgggcguagugccucaugccuauaaucccagcacuuuaggaggccgaggugggagaaaucucuugagcccaggaguuagagaccagccuggguaacguagaagaccccgcuuuaaaaauauagauauaaaagaaaaauaaauaaaguaaaaugagugccgagacaggcagguggacagagguaugcaggauuguagggaggagagagucagccaagguggcacaggcaagaucucgggagcuggaacuccgaagacaaguaggggugugagaggcagagaggcccccagguggagacaucaccgcugcaaagucuugagcuggaaaccagccaggugcagucagggaaugggagaaacucaguguggcuggagcacagugggguagggugguugaggugacuggaggagaagccugacccuugggccucccugggggccgggccaggcagcccccguauauucugcuccuccgcccagaagaucacccccuucccuccccagaccuaagccuccugcuuccagcccccagcgcgcgggccagaggccucgcaacuacaucggcugcccuccaggccacgggccugcuggcuggaaucccaccuuggcuguggcugagcccugggggcacccagguaccuugauguagggguucuccauccaggcuggcgugagggccguggccguguccgcaucgcucucauaguagaagacggugaaggucuccuugcaggagcgcccagcccgaggcagggacaggcacucgagcauggugaagcgcagcguggcguacacguggacggcgccccgccgugggacccaaccugugcgaagccagugggccuggcccggggcacgcugcacgucacacacuucguaggugcgcacgcugugcuguuccucauccaggccgcucaguuccucccacugugcagagaaggaggucagcaagggggcuggggagccgccagggagagggcugcauggggugaauccuauaaagugagagggacugagaaaggggggcugcugguacugcgaggagggcgccucugagaagggcucagacgacacugcuggggcugcugucaucuggggggacaggggagaggaguggcacacagaaagcaggcggcacaggcgcccucuccucccucaguuucccuccagagcuccagcuccugggugcagcucucaccugcccguccaccugagggaaugucacccacuucagaucagcaguuuccaauuuuguguucagcagggucucugagacagacagagagacagagucagugccuggggugggggagggaggucaggaagaccagaucccugggaaccgaggcagguggauccucuuagcucugagcuagaggaguuggggggccaagaggggagcaagcccugcccucugcacccgccugauuucuggccucuucugcuaagugccaaccccacccccaacaucugguaggcauggggcucccuugggauaccccagaucuaggccucccuggaggagggagggagaucaaaauguacggggagaaggggcggcagcucagaaaggguuaaaaugagagcugcgcccugguccugacccccacgagcagaggcugcuggugugggaggggaaccucuugucucagccuccacguuuccuccccuaagucccagaaucagccucucuaccccacaauuucauucccuguccaagaccccucucugcuuucagaccaaacaccccguccuucccuccuugaagggagcgcuccgugccuggggcauagcccuggcccccaucccaguaccucccuccccacgagugcccugaucaggaagcacuggaggucgggaugcuaggguucccaggcucccgccgaggccucacaucuggauuugguuaugggaaggcagaggggaggagauucuggggggcgguaugaaugggaggggugaacacaccuggcuuggcucggaucaucgggggaggggacaggcacuggaggaaggggggggauuaggaaaaacugcacagccccuggcaguggagaguggaggagggaggguacaggaauccccucgggggccggcaauguggggggcauugggcgcugggaaggguggagaggggagccagaacaccuggcucccaccccaugggagcugcaggagagaagagaaagagggugggugaggcagccucuuccuggggaccaaaugauguccuccagcuaggggucagaugggaagccagccagccugaggugagaggcgcaagguccccauggguggcaagagacagcccugcucacuggggacaggaugcccggguucugggaaggggguggauagaggcugccgucuccacccuccauuguuccagccgggauaguguuuuccugucuccaauuuacacacugucucugccucgggcuguccgcagcccagagcaagcgcaggcucccuuucugcgucccagcucagcugcagccacgcuuugaucugucaguucgcaugucucucaccuaucucuccuccacucucuguccaccuccguuucucuuucugacagucacuaucucuccuucgcuuucggccuccacuucucgcuguuccucgcggcacagggccuuggauaaacuacuuaaccuuaacuaagccccagccuccucaucugaaaaaugggggcaauaauagcaccacccuuagcguugcuggaugggugaaauuaauauuuguaaggcgcucagcacaggccuggugcuuggaaacacucagguaauaggugucacaaucaccauuuccucuuugcgucuuuccuucucaccacaccucguccucgugguuuuuccaccccuuuggccuuccucuuccccucguucaugguuuuuguucccccuucuccguucucugagcugggcaagccuccccucacucccaaccccacaccuagccuuugauccccagcccagggcaguccugcccagccagggggagaggguuuuucuaacgccgcugaauccuucccuuugggagucccucauagccuaccgccccauaaccacuuucauaccagacagagaaagggggguguuggcagcucacugaaaggacauuagggacacaggagaguuucuagggcucuuggcucccccuuuaggggaccaggagggacagcgauccauggccaaagaaaugcuuggagagaccaggaggugggagauagacuggguuaguuagggcgaugugggggcuguguaggucaguuucuaccugggggcuguguaggucaguuucuacccgcuccuaggucucaagggaagcccgggacucaccuggggccggggucuagaccgcauuuaaagggauggggugcagccuguagaaaccaaggagccacccuauaccaggggcaggagcagugggcgggagagcgguuuggggguuugcugugugaaugcaaaggaggccauccuguugcaggaguguggaacuggaggaucaaggugugaucgcuaaggaauuggcgcugggggucguuuuagggccuagcacgaaaaguugugccuugucugcuguugcuucuccagaaaccuucccucauguacggcgggaggugggacugggacagaaacuuugcagauaguuuugaauagugggguagggaggaaaggaaaggcagccaggggcguauguaaucagcagugagaguucggggagcccgggcaggggaaugucccgggucguagccagacuccaucucuuucccaaacaaaagaaaacuccacuacccgucgggcgccucuuccccgccccccucccguuccagcacuaucgguccgaaguguuugggacugcagugcccggguagggguagucagaggccggccccuccacuccgaggcccagauguugggggggaggucccaggagugacggggugcgcccccccccgcaaggaaacucaccuuccaaagcugcggccaacgaagcccagcagagcagcacccggagcuccauggcgccgccucacucggguaggauccgaacugaguuuggggggcccucgcccccccaggucugacucucccugggcggguggacgccgauacuccgcgcgggacuccucgucggggcccucagcgcgggcccaugcgagcgugcggggcaccgggcggcggcgccaaguguggccccgcgucugugccgcgcgcgcgggcggcgggcccggagcgugcuggcaguggccgcgccgggcgggcgcgcagcaagacguggcuggaguuggggucccuccggggccucggggucccgccccggguggcgggggcugagccggccgcucgcggucucccccccucccuggaguggcucugcucgcgccgccgggccgagugcucuccucgcgggcggggauggugggagcccgagcggggacggagcgggagggagggagacugcggcgcggagccgggcgggccgggccgggcaggggcugagcugcgcuggaa

SEQ ID NO: 192935 - RNA, 656758 nt, Homo sapiens
  misc_feature (22048)..(172047): n is a, c, g, or u
gaauggaaaauggcggccuagacgcggaguuuccugcccgacccgcggcggcuccggcggcgccaugacgcgcugggugcccaccaagcgcgaggagaaguacggcgugggugagcagcgccgccgccgccgcgccucucgccccaagcccaggcuccggcggggcgggugugccgggcgccuguugccgccgccccgagcggccgccgggccggggagaggcgcuuccgcccgcgcccgcgccgccgccccgcucgcaaugcccggcgaccccggccgccccgcgcccccggcggcgucagcuccagccccggggaugcgggucgggaacacgaggggguggggugggaaugggggcgggcgcgucccucccuaggguguccccuccgacgcccgcuccucuggaccucugccguggagccccccgggcuacccccaacuccccggccccggccgcugcuaucugcgcggcugggcccgucagggaagcccaggggucacugucucgcggcggcuucugcuucuuggaugaacuugcgucccgcguccgggcucugggugggcgggcucaggucggcgcggucccagcggauaauuccgcccuuucccggcggggaggagggggcgcgaccuggguggccagcgccccuugccccucggcggucucgcuggggaccgugugggaccuuggagagaaggcgagcggccgagcgccccaguggccccaggccuggagacccuuccgggagagcgggggccuguuuuugcuccgcggcucuuugucgcuuccgaggggggauggaaggagucggguugcaaguuuacauuucggacccgagugcgcauuccugagagggaggcuuucccuugcggcugaauagacgggcccguccgcgugggacccgcauccuugcgccccggggacccgcagccggucgccgaggccugcggacgcccaccucuucgugaucugcgcgccuggugucgggacugggccguggcuacucuccugcucucccggguccgggaucuucccaguugguuuucgggcuugcuauuccccgucccaccauccacagacauccuugaccgccugccucauccaggccacucgacccgacugggaagaccuuugguggucucgccucccacagcccaggcuguguccuccaagggcaccgucucagcagcagccccgcgcccauucugugccuggcccgugcuggaccugcccgacccucugcuggugugguucgaauccuggcucucugacuuuugggaagcgcccuggcagcccuuguccccggagcgcucuccuuucugugaacaguugcuucucucugcugucaaugacuuacaguaugcccugaccacggagccagcuggacaguggucacggggacaguccugggacagcccuggguccuaccgggccugcacuuagcuuguuccacaugcugggaggcauagggggccuccuugcuucaggaccauuaugacugagcuuccuccccaucuccccauuuugcagaugaggaaacugaggcccagacacauucacaaaagugcaggagagcucaucugacugcagacucaguguguaaccugcacccugugcaccaccuaauggauucagucuggggcacuuggcacgggccuucagucugcaucagaggcgagagguucgggguggauauuccaccugagaaugcuuggguuguggcgacagugggggucccugcggggguaguguguagaggagagagcugaggacugacucccagggaaccuagcaccagcacacgcagagagagaggaagagguggauaggcaggagaggcaggaggcuggcagaggagcaggcaucccauagcccuggcccugcugaggaagcaacuuaggugcccauggccagggugcaguaguggccauuggggguguagugggggccaucggggugcagugggggccaucacugcucccauucuacagaggcaaggaagagguggauugcuugccugaggucacaucaccaguaaguggugccuccugggugugaaguguggccgcccuggguucagcugccacaguguccugugcuugccugcagauggggagggcuucucuuugggacgccacauuuuaagagaccuuguuacccuucgucugcccccagagagaccuggauggugucaguuaggauccuauaguguagcuggauggucuggagaagacugaaaagaauguucguagaugggagaacggggucuccuugcuggggaggaggcugagggccagaacagggcggugcgcuugagucucacaccuuccagaagcuucaccagcgcucaugguggugacuucuaacaucacaccucuugcuaauacuuugguuuuaagaaaacuccauguuugauuauuaagaaaaaauaaauuuaaaaaaguuaaaaaaagaaaaaauagaaaacuguuggaaaauuuuaaaaggcgaaaaguaucugggaugguuuugccaggaaaugcuaggaaagaugugaagggcugaagguagagaagagaguggcugcugugcuuccucucacugggugcagaugacagcuugcuggguagacaguaaugagacagcaccacuccaucggcauccagaggcacuuuaaccagagucccccaucagggagggugggaggggagcugagcaugagcgcaauggggccaucccaggcuccccacuugucugcaagugugcagugggaggauuuuagugguucucacgaaggaugcugacugggaaggauguaggugcugggauguagggauuuauugccaguaggugauuggcuguuuccaccuaagggaaaauuacuggaggaccccuccaccauccuuaccaacuccagcauuuuucggagcuuaacaacagggcuguguuucccuggaggcgcucugguggcucuguggguggaccacacuuccacucuggccacuuggcccaugaacgaaucacgagggguaagaaaaugauaaaacuccaucucauuuggaaacaugaaucacagcuuauuguuugcaaguacuuggaaucuguuagaagcauuguuuguaaaugagauacuucaguuguauauuuauuuuguaaaauugggaaaggaguaaacagcugaucugggguuccuucugcaaaggcaggaaaugcugguuccucccaauucauuccacugggggcugccugugaaauuuaccagcccgcguuucccccuugguuuugaguuggugggucauguuuacgggccuggcauauuaacaggcauaaaccuugacucagcugucacacuggccagaugaucuuuucucucacagcccaguaggcaguuuuaugucccgacgucaauaaaauuauguugccauggauccuguuccuaagauuaggugaaaagaugcaguauguucuagaaucacacgugaggaccaugugcucacucacucacaucucaacaaugguguugaaggcagaauaaugguccccaaaaagguccacgcccuaauccccagacucugugaauucaauauguuacauggcaaaagggacuuggcagaugugauucagguuacuuggaauucguagaugggagauuauucaggaccauccacgugggcacagagaacuuuggcugucaaaguugugaaacaggcagucagaagauccuauguuuggaagcacaguugcuggcccugagauguaggggcucacuugcaaggaccagagagaggccucagggagcuacgggaggccccuagcuaaugaucggcaguuacaaagaauuggauccugccaacacccugaaugagcuuggaaacagauuuccuccccagggccuccugcuaagagcccagccagccaacaccuugauuuugagacccugagcugcugggcguguggccuguggaacugagauaauacauuugugugguuuuaagcuggcuggguugugggaauuuguuacggcagcaguggaaaacuaauacagaugaugggagagaagcuugcagggugaggcucucuugcacccuugagaucuguuacuaaguucauugaagguagugaacccaagugugcucuucacuuuggccacuuccaagugcagcucucaaaugggauggggcauuggcacugcucuuacucauaaugggacccuugagcaaauuacucauacuuucuuagccuugguuuucucaucugugaaguggaaccaagccugcuugcugccgagucgugaggacucgcugagaugauguuggcagagaauuuagcccugcguuuaagauaugccaaguacucaacgaagcguugcuuuuguuaacuuuuuauuuaauaaagcauaaaguuuagaaacauagugacaagugacuucugugugcgguuaacggguugcuggaaaaaugccuuucuucaaaaguugguuucuugauaguguguuuugcuuccuaauugggguagaagucacauuugcucagugugaggagccugacuugcgugccuucacauuagcucuaagcaaugauaauugcuaggaauagugugauauccaaauaaauuugggagcgugggaguugaugagagaucucuuuuguuaucuagaguagcaagcaagcugcuacuuuggggaagaaaaauuagauuugaucauaaguaaauagaaaugcaggcauuuucauucacuggaauugcagcaaaaccaaaucagggcauauuauauuucuacaaaccugauuuuacuuuggaaacauaagaaauuuaaauuuauuucuaugccauuguuugccuaggauaccagacaucugaucaggauugucuuagugugugucaauaguucugucucuuuaucaccucuguggaugcagguagugaaauggggaggaagaaauaggccacgugguguccuuugcuggguguggcgcugacgccccagggccaucgcuguagcaagcgcacacuuguacgcuguucccacccuccuucccucccucccuuuucccuucuuucuuuucuuccucucuguacuuuguauuuucagaugauugcauuaaacuuuguauuuucagauaauuauagccaaaugcggguguaaaauauaauucagggagaucaugaguagccauuacuaguuucaccuaagguuacgucuuguaaagcuguaguacagcaucacgacugggauauugacaucgauagucaagguacagaacauuuccagcaccacaagcaccacgccuaccucccuccacgccuuucuccccucaaauccuggccacccuuugccuguucuguguuuuuauaauauuguccuuuaaagaguguuccguuagugaaauugcauaggagguaagcuuucgggauuggcuuuuuucacucaguaucucucucuggauauucauccggguguugcuucuuuucuuugcugaguaucauuucauggucuggauaugccccagauuaacuguucaccugucgaaggacaucugaguuuggcugugacaaauacagcugcugucaacaagcacauacagguuuuagugugaaccuaagucuucauuuucugggauaaaugcccaggagugcagaggcugagucgucugguaguuggauguuuagcuuuuuaagaaacugccaaacuuuccuggaguaacugugccaguucacauucucaccagcaguguauaugugauuguagauuucucggaauccuugccaucauuugucaccguccuuauugcuuguguagguguguaguugucugucauugugguuggaguuugcauuugccuugguuucauuugggagccagcgugcagcucccugugcugcugcgguacaggagaaggcagcccacccagggggugcuggugggagcgcuguaugagcggguccacugagcugugaaauuguccaguguauucagggaaggacuuugauccaguuugaagagacaucauggaguggaaggcugaccgggcacaugcaccaguguggagaccacgguuaacaccagguggucgcuugucaagaugcgguugucaagauguucacuuuucaaacccuucagugcauccggaaggccuucagggaggaaaugaggaggcgcccgaggaggggucagaguuugaguuuuagcccugacaaggccacuguucaugcauaugacccagggugaguguuugaaccucuuccagccugguuucugcguuuuuaagcagcgauguucuggaugguacugugggcuuugcuucacugagguugggcugaugggaguugacaggaacuaauuaauguaucuuaaggcaguuuggaaacauuguuaugcaaauggauugcauuugccaucagccacuguuccucaauuugcuuuuauugauaugaugggaagugcuuuggagcugacguugaaaucacaguguggaauuuguguguuaguugacuggagcuaccauaacaaaggaccacaagacaggguggcuuaaccaacaggacuguguuucuucacaauucuguaaugccggagucaagguguuuuggugguugguuucuucugagaccucucuccuuggguuacagacagcugucuucacccugucuucauagggucuuccuucggugugugucaguguccucauuuccucuucuuacaaggccacuauggccagccucgguggcucacaccuguaaucccagcauuuugggaggcugaggugggcgggucaccugaggucagggguuagagaccagccuggccaauauggugaaaccccaucucuaguaaaaauacaaaaaauuaaccugguaugguggcgggcgccuguaaucccagcuacuggggaggcugaggcaggagaaucacuggaaccucggaggcggagguugcagugagccaagauugcgccauuguacuucagccugggcaacaagagcaaaacuccaucucaaaaaaaaaaaagagaccgggcgcgguggcucacgccuguaauccuagcacuuugggaggccaaggcggggagaucacgaggucaguagaucgagacccucccggcuaacacggugaaacccugucucuacuaaaaauacaaaaaacuagccgggcgugguggcgggcgccuguggucccagcuacucgggaggcugaggcaggagaauggcgugaacccgggaggcggagcuugcagugagccgagaucgcgccaccguacuccagccugggugacagagugagacuccaucucggaaaaaaaaaaaaaaaaagaaagaaaggacacuagucaugcuggauaagggccuacccuaccguaaagaccacacuuugacuuagucaccucuuuaaauucccugccuccaaauacagucacacauccaggaugcugaauuucugagguuagaacacugacauauggauuuggagggacacaguguagcccauaacaguaugauuuugauaacauaagacuuuucaucuacaguuucccucugucuuuaguggccuuugaauuuuuuuuuuuuuuuccugcaagcccaugggucccuggugcuacuggacucgagggagguaaggagcuuucuaaugggacuccaauuuguuucuguucagaucuggaaauuccuuguaaucaaauuagugacagaacaaugcaaucagguaguuugagauccaaacaggaacuucagagcaguucuuuaagugugaucauucuccugugaguguggcucagucucugagcucaaccuaccugggcuuaagcugcauuuagcauuaggauauucacacauccugcuuggacuuaauuccaguuucuuaccauuuauguuuuuguagcaugaguagggcagccucauauuggcucuggaaucccaguuggacagugauggcaaaacccgggcuuuggugcuggugucacacacuuggugacccagggcugucccacacaacuccagggggcacuguucuucuccacagcccacgaggcuggcuucuguccuccacucgcaccuugcguggcccuccguggccuugggccgucagaaaagcgcuuuaauaucaggagcucauggggcaagggagggggcuuggcucgugacaaauaaaugacaccgggcuucuugaugaugacuuacaagcucaguuuuggccugccacucugcaguuauccacaugcccacaugcacgugggaaacugaguauccacgcaggcacucccugucuucaaaaggcagaugguuucaccccagacagaugucugucaguucguugaauuuucauuugggugccuugaggagaaaaagaugcuuucucuuggcauauagugugugcugucaaaacagcucagguuaggggucauagagauccgucuuugaauaucagccuggugucuuauuaggcaugucaccuuggggguuauuuaccuuaagccugaguuucuccuuuguaaaacuggugauaacaccaaccucuuugggcccuucugaggagaaagagauaaccuagcccaaaccgggcccauggucugugcuugauaauguuaguuucuuucauccuuuauugauugcuuuguaaguagaaggcuguguugcuugggacugaaucucuagcuuaauucaggcucuccccagcccugcugcaugggccccauugcuucuguagccccugccuguugcaaagugcuggucagaauuuuaauguuagcucugagguuagaucagggacuguaguucuuauugauugcugggggguccugaagggacaggaugaaggcagaucucuacaucucucaucagaaauguuaccuugagucuuuaucuagaugcaguugcuguuuagaccuaugauuuguugcugcaucuccugaggagugugaugcaagauuuuuaugccauccugagugauuuguuucaguuuuaaauuuuauuuuauuuauuuauuuuuauagacaggcucuuggucuacuggccagaccagagugcagugaugcgaucauagcucacugcagccuugaacucccaggcucaagugauccuccaacccuggccuucugaguagcugggacuacaggucuagcuaauuaaaaaaaacuuuuuuaaggagauugggagagggucuuguuauguugcccuggucucaaacucuugaccaaagugcagggauuagagaugugagccaccacacccaggggagugauuuaacuuaauugguuacacuagguaaacuuagguguauuuauguaacagucaugauuuccuuucugacuguuagcuagcugcuguaacaaacagccccaacauuuugcuggcuucauacaauacaaguuuguuuuucauuugugucaaagugggcgguggggagggugagcaggggcucugcucugcccagccauucagagucucuggcuccuuugacccugccagucugcccuccacugcccuuccccauucaaccuguagauggggaaagaaagagaugaggauggugcauagauuuucuuucuggccuggucuggggguggugcccaucccuucugcucacauuuucucaccgugaccugagucucuggucagaccugcagcaaguggggugggaaauguaaucugacugugugccucgcaggaagaggagaauguggauuugguggucuccuccacguguuccuauugaugcuuauuuuccauuaccaggaagaauguuagucuggacucuucagcuucauuggcguugagcauagagguuguacauccucaggacuuucacccugaaagucacuuggcagaacagauguucaugucccuauaaagacggaagugaugccaaggacagacgccgccuuuuuccuugggguguauuuugcuacuuauguccuauagauuucaggauauucuucaggguauaccaagcccgagagcagugcugcuuucucaaugugucuuuuucuuuuuugggggcgggggggggauggagucuugcucuguugcccaggcuggagugcaggggcacaaucuuggcccacugcaaccuccgccuccuggauucaagcaguuuuccugccucagccucccaaguagcugggauuacaggugugcaccaccgcaucugguaauuuuuuguauuuuuaguaguaacacgggguuuaguuacuaacacggguuaguaacacgggguuucacuguguuagccaggauggucucgaucuccugaccucgugaucugcccaccuuggccucccaaagugcugggauuacaggcgugagccaccgugccuggccucaguguguccuguccuuuucauaucugucuggcuguuccuguucccaccauccaaaaacacaugcacaccccaggccccuuuccugugcuguuuaauucuuuuggccucagaaggcuguguacuaaagcuugcuaaugagaaccgugucuuuguuuuuaaguguuuuuugucuuuauagaauggaaucucuauauucugaaauaacucuugucuaugaguauguaugcaaugagaaaggcuauaaaguuaaaucaaggagagcaacagugacuuaaaaguuaggcguugggacacuaugguguggaguuuagagcacuggauugacagccugaauaauagggucugguauuccuggguacagcacuuaacugcugccaccucugcccucccugagccccaggccccuuaccuggaguuagggcauauccuagcacaucugugcaucucagcucugcccaggggagagagcaggaccguguguguggaagagcuuugagaagagaaaguacuacuuaguguuggguuauucauguuaaacuauuauacagucaauauuaacuucuuauagagaaaauauaugauuucuggugauuguuuuaaauuggaaaaggacaguguggcauugugaguuucacuuuccucaaaguuuuaugauuuuuauuuuacuuacuaguagacaaguuuucuaguaauugauuauguugugaguagaugaacaucuugcauaagcagcuagccugggcugcuguguaaccuauguauagagacgaauggugaugaagccuguauguuucagccucgguuaggaaaccuucuguccuaagccacagaaaaguuaaagaagacucugccucgaaauaacucauuucuucccucccuucuccccuucuucccucauuccuucuguccuuucuuccuccccuccuuccuuuccuccuuccuuuccuccccuccuuccuucuaccccuccuuuccuuccuucccuucuuucuuccuuccuuccuguuugcuugccagcccuguucuuagacauugguaucuggagcugcccucaugggguuuauagucugauacagccaacucuuccauaucugaaacucucgaggccagugguguuucagaauuccaguuugucacagugcagagagacaggugggagcugugugaggccagcgguguuucagaauuccaguuugucacagugcagagagacaggugggagcugugcgaggccagcgguguuucagaauuccaguuugucacagugcagagagacaggugggagcugugcgaggccagcgguguuucagaauuccaguuugucacagugcagagagacaggugggagcugugcuuguggcuccugugccagacaccccgagcagcucugggcaacacccuggagucgagcauauugauucugcugccaugagcgugugaacauucacagcacgagggaagccauccguaauuagcuccucuccgcucagguuagacuuuugcaguuaaaugaauuacagaaaucucuuuggguuugggaacuuuguggguauuucgggcuuguggguaaugaacugucgauguuguauuuuuucacagcucaaccaacauauucagguuuugucuucucagggccugucauucauucugguucucugaucagauuuccucagacugugggugccugcagccagcccggaagcccuuuaaaaugcccuucguggccauccuggccucauucccagauccacuccuguccagcugggugccuggcugguccccggucacagucugcaauucccacuccccugccucagcuucacagggucuguggcugauccgagucaggcccugggcacugcuggccucaucacauuggccuccggaccccuucuggaagagacuuaucccuuuguuccaccccgggcuguggggacaagauuuugcgagagcugagggcccagugagaauggucuugaguccuuagggccugggagcccuagguggaagugggaaggaggaggaggagaguggggaggagaugugaggacuaagcgcacccagggccaguuuaagaggucagggucgaggacauuagaggccugucucccccaggcgcauaaagcugugaguuuuccuucuucaguuccuuaggcagaaccccuaaagcagauucuggggugauggaacucuggguaugaguucuuguuagccaggcauaguuaggagcuugggccugcaucuggacgagagagacucagcugugcccauugagagcuugugcugccugcaaagugaccugccugaggcucauugccuggucccugugaauauuaaguggcuucaacacaaagaagggacuuccaggggaggcugcccgggauugccagugcaguggggcuccgcugaugcucaggaucaccagcgugcagcggggacuccacugaugccugggauugauugccagcaugcagcggggacuccacugaugccugggauugauugccagcaugcagcgggggcuccgcugaugcccgguauccaccagcgugcagcgggggcucugcugaugccugggcuugcaugccgcugccgcugccuacuggugcguggcgguagccgccugugcccagcuggugugcuuguccaaggugaugacgguacuuuuuauugcacagaguugcuggagaguugaaugaccugggucaugucagcacaguuucucagucccugcacuguugacauucugggcaggauaauuuuucacccuggggagcuguccuguaccuugcuggauacuuagcagggccugcccaguagaucccgguagcaggaucccccuccagcucuguauguucuucagaugauuuggggauaucacugguauuuuaauaaguucuagaauuucccccauugacauugccaggaugucaagccaggaugucucagccauugccaacugucccggggguaaguggggcgggauggccuaacucaugguaaacacucaacagcugcuuacuguuacuaaugauacuguguuauuagcagcaaagucagcgaagucacuucuguauauuugggaagaaaagcuagaaaccccaacgacuuggucuggcagggugugcaggugggcacggaggauucggacaggugggcacggaggauuuggaggaggagaaagucaaggugcagaugggcacagaggauuuggaggaggagaaagccgagagggagugugggggcccuucggccaagcuucuuggcugucuaaagaucauuaggagcuggcuguguuucauucuccuucugagagacaaacaugaguuucucuugaggccaggagugaugugcagaugaacacgaauuguguggcucaucccaacauguccuuuaagaaaccccaugcaggcugcuuagagaccuuccuaaacgcaggaacucaagcauuugcuucuuggaguuuuauuugcuggaauaaaggcacuuaucaaccucuuuuuuauuuuucgaaaauaauaacuuauuuucuuuaacauaauugacuucaccagaggcaaauaccgauuuagcaggaaggaaaugugauuauuuuccuuucuaauugcugugcuucuauuaacuucacaagauuuguuuucaaguccuccuaacgucauaaguguuuuccugacaauuuuucaaaggcaggaaucguccuguuccuccaggcaccguggccaaguggccagauuucuucacauuauucuuggggguuguugcuuugagaaucagcccagugaggccaaggggaaggggaggugggggugugugcaggaggccugagacuuaggugaccccgaugacggucugugcuauuuccauacucaggcucuguggccgucagcccguugcucugagggacaaaagcuuucuuaucccaacccaggcuggaugaccccccgaucccgcguugcucucugcaguucugcgacaugcuuccccuccagucccccugggggcaggugguggcuccguguccccugcuagacggagggcccucgagggugaggccuuaauccuguugcuuucucucuucccagcaccugcuguggucccuggcacaccuugccguacauugaaugaaggcaaagggagagauuucaucauagcaaaaugucaugaacugccuggagaaccaugaguuuucuguugguggggaguuacgucuuggagggggcaccacuuccaggacuaaggcagugucggcucagcucgagaaugcagugggugacggggucagcagcccuaaaacucccuccaccccggcugugggaagcacccacugggggcuccaucccgaugggcuuccugagcuaaaaugggugcuuuguccaugcuggauaaauauguggcgauguugguggguugggcaagucaguuacacgacucuguauguucuucagaugauuuggggauaucacuguuauuuuaauaaguucuagaauuucccccauugacauugcuacaaggcaauuaaauuaaauuaaaguuccuucuuaauaaaauguuccaguaaaacacuuuccuaguccccuuguugauacguuugucugcagugacuggauuagcuggcgggagaauagaagaaaaguggauuuugaagggagauugugcuugagucacgcuuccagcuccuagucauugugggaccccaguggggcuccccagagcuuucgggucuugaucaucuguaaaaugaggguccugccaccagucuuuucugcucccaaaugcaguaaugaaaagccaaugaaaucaaaguauauaauauauaugcuaaaguacuuuguaauuauaaagcauuaaacagcuaaaaggaauaauaaauucuguucagagcacagauuggcaagcuuuuucugcagagaucuagaaaauaaauacuuuagguuuugcaggccaagaggcaaaauggaggauacuauguuaagacauuaaaccuagaacuaccaucugacccagugauucuucucuuaggugugcacccagaagaaguagaaacaguucacauaggcugguccgagugcagugguguuuacaacuagcugaucacaaccaguuacugaugucauuguuccuucuccacucccacugcuucacuugccuuuacaaaaaguucaggccgggcacgguggcucacaccuguaaucccagcacguugggaggccgaggcgggcagaucaccugaggucaggaguuugagacuagccugggcaacauggugaaaccccgucucuacuaaaaauacaaaaacaauuaguugggcguggugguucgcaccuguaauaccagcuacuggggaggcugaggcaggagaaucacuugaaucugggaggcagagguugcagugagccgaggucgcaccauugcacuccagucugagcagaagaguaagacucuaucucaaaaaaaaaaaaaaaaaaaaguucaaacaaguaguuauuuacaauuguucguagcagcauuagucacaauacuuaaaagguggaaacaauucaaauguccaucauuggaugaauggauaaacaaaacaugguaugucccuauaauggaauauuauucagccaugaaaaggaaugaaacaccgaucaugcuacagcaugggugaaccuugaaaacaugcuaagggcaagaagccagucacagagggacauacaugauucuauuaauaggaaaugugauucuguuuauaugaaauguccagaauaggcaaaucuguaggcacagaaagcagauuagugguugcccgggacuaggggagggcgugauggggaguggccucuuagugggagugucagucuguuugcauuacuauaaaggaauacuugaggacgggugagagagagagagacagagauuuguuuguuuguuuauuugagauggagucucgcucuguuccccaggcuggagugcaguggcgcgaucucaacucacugcagccuccaccuccuggguucaagcgauucuccugccucagccucccgaguagcugggacuauaggcaugcaccaccugccugguuaauuuuuguauuuuuaguagagaugggguuuugccaugucggccaggcuggucucaaacuccugaccucaggugauccacaaggcuagguaauuuauaagaaaagagguauaaggcuggacacagugguucaugccuguggccccaaaaccuugggaggccuaggcaggcugauccuuugagcccagaaguuggagaccagccuagacaacaugacaaaaccccaucucuacagaaaauuuaaaaauuagccaggcgugguggcacacaccuguagucccagcuauucaaaaggcugaggugggaggauuaugucccuggagcccaggaaguggagguugcagagauugcaucacugcauuucagccugggugacagaguacgacccuguaucaaaaaaaaaaaaaaaaaaaaaaaaaggaaagaguuauaauuggcucauguuucuguaagcuguacaggagucauggugcuggcaucugcuucuggagaggcauccggaaacuuccaaucauggcagaaggggaagggagagccaaugcaucacaggacaagagcaggagcaagagaggggaggagcugccacacucuaguccagucuagaccacacacuggucuagagucuuagaaucuuuuaguuuuagaauaaugaccauuauuuuuguaacaaccagugucucgggaacucacugaguaagaacuugguccucaccaagaggauggugcgaagccauuccggagggaggcgccaugauccaaaucccucccacaaggcccaucuucaacauuggggaucacauuuccacaagagauuuggaggggacagacauccaaaugguaucagugacuuugggguuuccuuaugcagugaugaaaauacuuaagaacuagacagagguggugguugcacaacauuaggaauguacuaaauauuacacacuacuaaauuguauacuuuaaaaugguuaauuuucuguuauguuaguuuuaccuccuuuaaaaaaaaagaugaggaccggguacgguggcucacgccuauaauuccagcacuuuggaaggcugaggugggcggagcaccugagguugggaguuugagaccagccugaccaacauggagaaaccccaucucuacuaaaaauacaaauuagcuggauguggcagugcaugcuuguaaucccagcuacucgggaggcugaggcaggagaauugcuucagcccgggaggcggagguugcguugagccgagauugugccauugcacuccagucugggcaacaagaacgaaacuccaucuaaaaaaauaaaauagaauaaaagaugggaaccauucuuagcuuaugggcaguauaaagcuaagcugugggccacauuuggcccauaggcuguaguuugcugaccucuggucuagagucuuagaaucuuuuaguuuuagaauaaugaccauuauuuuuguaauaauauuguaugcuaguuauuaaaagauugcaaacuauauuaaaguuaaaaggauguaaaaaacuuaggcauggcugggugugguggcucaugccuguaaucccagcacuuugggaggccgagguggauggaucaccugaggugaggaguuugagaccagccuggccaacauggugaaaccccauaacuacuaaaaauacaaaaauuagccgggugugguggcaggugccuguaaucccagguacucgggaggcugaggcaggagaaucgcuugaacccgggaggcggagguugcagugagccgagauggcaccacugcacuccagccugggugacagagcaagacucuguuucaaaacaacaacaaaaacaauaaaaauccuaggcauucuccaagcaaucugccacggagaaaggagcgccauucucggcaucucucuccaugugcgaugguccguacccucccccuccccacuucauacacagaaaccuaaucaccaaggugaugggauuaggauauggagccuuugggaggugauuaggucaugagggcugaggguccuucuaaaagaggccccggagagcuuguuccuucuacccugugaggacacagugagaaggugccuucuaugagccaggaaacaggcccuugccagacaccaaauccaccugccccucagucuuggacuuucccagccuccacaacugugggaaaugaauuuccauuguuuguaagcugccugguuuaugauauuuugauauggcagcccgaacagagguagauaccauguguagagagaaacaggcagagaaauaggagaguugaaggguaccccacccuccuugauuucuaguugaggaaauggaggcugugagugcuggaacugagcggggggacuugagugcuggaacugagcagggggaacugaaugcuggaacugagcagggggaacugaaugcuggaacugagcagggggaacugagugcuggaacucaguagggggaggcugugagugcuggaacucaguagggggaggcugugagugcuggaacucaguagggggaggcugugagugcuggaacucaguagugggaggcugugagugcuggaacucaguagggggaggcugugagugcuggaacucaguagggggaggcugugagugcuggaacucaguagcgggaggcugugcaugcuggaacucaguagggggaggcugugagugcuggaacugucucuggggagcccugucuggagccuuaaaaaaggcaaacggcccuugaaacggcaggguggggagaguugaccaaaagguuaaaaagcaauuuaacagaaauccaacucuucaggauucuugcuucuuccaccguguugccuccagaagaacagaaaaugaaaucucauuuugcaguuuucgucugaccagcaguuaccauggagggccagguguggucaagggcucuagaacguuugucugcacaguuucccucuuugaucucugugauuuauagacaggcacuuaaaggugggauuaauguguaaagagccuucagagugaaggaucuaagucccuggaaaugaaggauuggaugaaaguguuucuuaaggacaaacuuuuaauaauuguggcauacauacuguagcauuaguacuuccauuguacaaacucaguauuugacuuaccugccaaagucuacugcuuaccugcacauaggugcaucagcuuugcagauucuuuuuaaaugugucaacccacguuuuuaaaaacugguuuagaaaauucucacugggcuucccgccucuaucacugaucuagucaugauucaucuuauggcugggaaagcaucacuagccuggagaaacugaacggugguguugagucuuguuuucaguuuuuauuaguauuuccuguuucauacagcccaccuuucugggcaauaagccuaacauaccauaggcugauuuucuaaaacacuuuuauuuaugcacacacacauauacauguaguuagagcugggugaaguccugccaguaaccagaccugcuuuuucauuuuauccaucagaucucuuggugucuucucuuacuacucaggguacucaugugaacauuuuuguuuuguuuuguuuuuugagacggagucucgcucuguuuccaggcugcagggcaguggcacgaucucagcucacugcaaacucugccucucggguucaagcaauuaucuugccucagccugccaaguagcugggauuacaggcgcccaccaccacgcccagcuaauuuuuguguuuuuaauagagacgggauuucaccauguuggccaggauggucucgaucucuugaucucgugauccgccugccucggccucccaaagugcugggauuacaggcgugagccacccuggccggccuuaugugaacaugucuaaacacauacacacacauugcagagucugugugugugugugugugugugugugugugugugugugugugugugcgccuaggugcaucugcagaaauaggucuacaacuccaggcuauagcuggagaaucuccaggaugggcuuaugucacaguagggugugauguggggugugccugcuauguguguugggugggguuggagugggauggguugagcugguaacacugagaaucuuuggcccugagcuccauaaacugaacccgugagggaggugccuagcugggugcaaacuccuuaauuccuguuugacuuuggcccaguuaguuaaccgcucugagccucaguuugcacaucuguaggguggggauaaauaguacuugcuuccugugacuggagaaaagagugaugugauagggguaaaauguucagcaucgugcccgacaccugguagccaccugcuacaugggaguaccaucggggcaccauguaagccugaaaauugauccggugacagagccaccgaaguguuuugucuucuguuuucuuuucuuucuuucuuuuuuuuuuuuaaauacuagagagcuguuaagaaucaucagauuuccacauaaaacacuugauguuugcucucagcucgaaaauagguacaaacgucagugugaauugagauuuccaggaaaaguagacaaaagaaaaaaaagaacuuugaacaacauuuucccguaaguauuuucauauauuuacaugucaacuuaagggaaaacacaacuacuuaucuugcaguuuuacgacuguaucacuuaauaaacauucuaugccagaggagguuauggguugaguccccugaaaagacagguugaaguccuaacccuuagugccucagagugugaccuuacuuggaaauggggucaucacagauguaauucguuaagauguggucauacuggauuaaggugggcguuuaauccaauaugccugguguccuuguuaagaagaggagggacacgugagaacucagccaagugaggauggaggcagaagugggcguuacacggccgcaagccaaggaguguccagcagcccguagggcucccuggagcuggaagaggcaaggaggaagucucccccagaggguuuggagggagcauggcccuguaggcaccuuaauuucugacaucuggccucugaaacugugagaaaauaaauaucuguuauuagaagccaccaagcuuugguacuuuguguggcagccccgggauacugacacagucguagaaaugcaguugagacacaggggaaaaaguauuucuguuagugggcaauugagaaggagagacuuguaggcuuuuagugcucacuucagaccauuggcgcccugcaucuugucuuaucuccagucauugaggaaauaaggcucagaacaauugugcuccgguguauuuugcgucgucuuuuuagaagaaaacugccuagagagugcgguggugacuaccacgccaggugugugaccaugauagcagauuuccgucucugaucugcuuuuucuuucaguuuggauuugaugugaauguuguugaccagaacuggaggugagcaggagagaauuaacugccuuccguccagagggacuaggcauugaaaugugcauuccagauuccccuggagcagugaacuuuggaguuagaggccgagcugaugaucucuuccuuucuuuccaaagaggauguccgugaguuacugucucauucuuuuuuuuuugagacagggucucacucugucgcucaggcuggagugcaguggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngauccuaauuuuuucuuuuuguuuuugagacggagucucgcucuguugcccaggcuggagugcaguggugcgaucacggcucauugcaaccucugccuccuggguucaagcgauucucuugccucagccucccgaguagcugggauuacaggugcgcaccaccacgcccggcuauuuuucuuguaauuuuaguagagacgggguuuugccuugauagcuaggcuggucucgaacuccuggccucaagugaucugccugccucagccucccaaaaguaauccccccaaaguguugagauuacaggcaugagcugccacacccggccaagaugcugaauuucaucacccucgcagugccccuguggccgugaaagcuuuuggagucgucuuuggagggcuguuacucuaucugcauccuuccgcuccucucuccuacucccuugucaaauacccuugcaaggcuggcuuuuaauuugucuucauauaugggauuauuuaaucauuaguccuaaaaugaacaaagggcuaggggcugggcaucugggguugugaucuugacuggguugcaugauuuggggccaugugcauaaccccugaggcucuuuuuuuucuuaccuacaaaaucauggguugucuggcucauuucacaguuaaaugugaaguuuccauauccauguaugagauuucaaucacugcuuuccacugucugcuuuagggauuggggaguaggguauuuagaggugaaacaggaagaaaggaauuauguguaugugcuuuacaaauucacaugugcuugaauguauuuacccuugaugugcucauuuuauuucauuucuaugauuuuugacguguuuauuuuucccacgucuagaacagaauaggugugcuggcagggaugcuguuaggaacugugauagauguauuuaugguuccugaagguuuacgaauacggucaugcugagcuggggaaguccagccucugcccugggcuuccuucaccugaugcaguuauuucuuguuaaagauucacuguaaaaugccaaauaaacuuaauaacuaacuaauaaccaucuuugucaguugaggacacuuacauuuuaugaauuuuggggaaaauauaggaagauaccugaggaaauagaauuuucaauaucauaggucuagcuuuugauauuacagaauuuuugugcacauguggcaaugugcuugcuuuggcuuucuaaaaagaauucagguagcgguagacaucuugauagcaguaaaaaaaauacaaccaaaaggaaggccuucaccguuaccugaguguucaccauggaccccauugugccagauccaacaggggcaucauuuucucuaagacacaaaacacacacgcaauucuacgaggucaguauccgguccuuauuuuggccauugaaaaccugaagauagagcagaucguuugccagagggcaggcacccaggggcucggggaggggugcugcccuacccacuuuagcugucuguagagaccaugaacgugaacaccaggaggcugcgugcgccugaaauucuggacuuuacagccugaggugcagcucaggcagcucagguuuauggaggccauuccuuguacggcuaagcaccuuccuguccuuggaggugugggcaggaaauguugaaagguggguggcucugcccucugguggcuuuucuuuaguuggggaugucuuaacacacacaucugaaauaagacuggcucaugcagaacaagagaugggaagcuuugcguggugccagggcuguuuggaggagcggaguuaaaagaucaaacacagacuugggucuggcuuucgugaugaggugcacccagugggaaggcccagcuggcgagggagaaguugguacccaaagaugugggcuggacuggcuucuuuccuucaguagaagcaagggcccagggaagggaguguguggugggaagguacgguggcccgugcuugccagaggaguuugcacaugacaugguuuaauuuuagagaauuuuagaggugugccacaaugcaggugccuuuugugcauagccucgccuggcugggcugugcaggauggauggaugagagcuuugauccgcgauuuugaagaugaguuuuauauugaaugcuauauccuauuagguagaggcuguuggguaggaggaacauuaauauauauuuuuuuaaauugagagugggcuaguugaauacuuuuugggccuuaaacacuuuguagcauccuuuuuacaccugugacugcugccuuuauuccauaaugcaugagcaaaagugugguuggaauuuaauggugugacuuuuuaggggcuuauguaggagcacuaugauccuuuugcaaaauaggagcagcuuuaugucaggauaaacaugggauuucagacauuucuugcuuaucauugucaguuuuaaggauuucuucuaacacaggacauauuuuugucuacugugauuguaaaaucuauuggcuuaauaucaacauugcuauaugauaauuuuuuuauuaauuugguuuccaaagaauauucacuccaugugcaauugauucauaggcagauaaaaaucuauuaguggaaauaaaagauaguauugaagugucaaucaaaauacuguuaacaaugucuucuuaugucacuuauggucaucuggugucauggguaguuaugaauuucuccuccuuaaacuauugacccuuuauauuugucugaaagaaaaggucacuucuguggguaucagagaggaugaugcaggcagcgacugaauguauuucaauauuaaaaacaacaacauuaaaacaagccaacacgacucagcauggucacuucuaucuuuacuauuacuaauauauuuccccuuuuuucaucacagcuuuuuauaacuaugaugccagaggagcggaugaacuuucuuuacagaucggagacacugugcacaucuuagaaacauaugaaggugcguaugcaucuugguaucuuuucucuuacauuuugggcagauggcacaccuucucagugccugcugggcaaagcauuccucuguuacagacacauaagacagucaugcuuccuucucaggcucccuuuucuugcagauggauacuguuucagguaaggguaguagugaggcuguuguuuaauacuuucugaaggugaacuuaaaacugaaauucccauuuuuaaacuccuuggcuccuuauuuucaagcauguguaaaucuuuuuuuuuuuuuuccuuuugagacagagucuugcucugucgcacaggcuggagugaggugguguaaucucagcucacugcaaccucugccucccagguacaagugacucucaugcuuuagccucccgaguagcugggauuacaggugcccgccaccaugccuggcaaauuuuuuuguauuuuuaguagagacugcauuucacccuguuggucaggcuggucucgaacuccugaccucaaaugaucugcccaccucagccucccaaaguacugggauuacaggugugguccacucugccuggccaaguguguauaaaucuugauuguuaacaguugaccacuugauaaaaaauagguuuaagauaguuuacuucguuguuuugagacagggucuugcuccaucgugcagguuggagugcaguggcacaaucagagcucaccgcaggcagccuccccaucuugggcucaagcagucuugccaccucaggcucccaaguagcugggacuacaggugcaugcugccacacucagcuaauuauuuauauuuuuuguagagacaggauuucaccauguugcccaggcugguccugaacuccugagcucaagugauuugccugccucagccucucagaaugcuggaauuacaggcgugagccacugugccuagccugcuucauuguuuugauguguuugaugugaacuaagauuucuucuuuuaauguccucacuuagauuuguuagcaguauaugucucagaggaaccccaauuuucauccuuuccuuuuuuuuuaaaccuguaauccccauuuucuugggaugaacagagauuuaucauaguuauaugggaugccguccaaugaagcaauauuuuuuuuuguuuuuuuugagacggaguuuugcucuuguugcccaggcuggagugcaauggcgcgauuuuggcccaccacagccucugccucccagguucaagcgauucuccugccucagccuccugaguagcugggauuacaggcaugugucacuguacccaccuaauuuuguauuuuuaguagugacgggguuucuccuuguuggucaggcuggucuugaacucccaaccucaggugauuugcccgccucggccucccaaagugcuaggauuacaggcaugagccaccgugcccguccugaagcaauuguuauaauuauccaauaaauaaacuauuggugacagugguuuuccaauguccuuggcuuuucagacaauuuguuuuuauauuuuguguuugcaaauaauuugagcaugccauauuucauuuuaugcugugguuauuguugcacagaagggaagaaaugaugggcuugauuuuuuaaagacuguucagaucuggagguuuuggugagauuguguuuucuuauuguugucggcuuaauuuccugcuugaaagggugguucccauauagcauaugaauaaaaaggauaauuucaguagaaaaacugcuuuuucacagagguuuuuuagcaaaacccuuccacaugggagguugggggugagaggggaaauugaagacaucccguaguaaucagcaaauugaacuuccaacuugaaauccacuuuacaaggaaugaaguaugcccagcuuccugcucgaggcaaacugugaccagcuccugguagacuccucugagaaacacagaccuacuaacagauccauguucauggcccuuauuuccccaucugaugcaugcuguaccuucccuaaaaaaguccugucugaaaaaaaaaaucgacuuuaguggccucugcguggaagccagugcagcucugcaaaaaccagccccaguccuuaagcggaugaguaguugugauggggucuucugcuuguuuuccguguuuacagcugacagcuguguucccuuaucuccucucaguauauacugcaugugucugagaggagacagagagaaauuaaguagagguuaaggaucaaaccgcucaucucagacacuuuucugauuugaagggaaaugcucuuguaucuuguuuuacuuuugcugccggucaguugaaguugaaauccugguuaauaaacacugggcaaugaugucauuccugaauaguuaaugauuuccuguggccccugggccuguggagacugcauuuuuguucuuugcuucauaagaggaaugcgugugugguggugguuuuuuuuuuuuugagauggaggcucgcucugucgcccgggcuggaguaugguggugcaauuucagcucacugcaaccucugccuccuggguucaagggauucuccugccucagcauccugaguaccugggauugcaggugcccaccaccaugcccagcugaggaauguguuuuuuaaacaguggacuccucgggcaugucagugguccuuguaauacguguaacuucaaaaauaucugauugcaggcauuugacuuuuuggcugacaucaugauaagagaucuacagugaacauuaauuuucugggcuagucauucuuucuagauucugaugaaaauauuucagucuuuguaaagacucuuuagcauaaaaugaauuuccguuccuugacaacuaacuuuuugguuuuaaucugaaucuaaucagagaaaugcauuuggagaaguauuaauaguuuugacuuuggggaguguggugacuuuuugucauuaaauaaaaagagaauaauguacuuccauuuguuuuccaauaucuuccucuuguuuuaucuaaauuucauggcuuguauuagagucuggcauuuucuuuuucuuuccuuggcucuccuuuuccucuaagaugacuuuuugguuuagcaaguuugauuuucuuuuuuucuaugauccuuuccaggauauuacagagcuugcuccagaggcuauaauuucuagaugauaaaucuuuauuuuaggguucaaagacuaaauuuaccuucaaguugugguuaauuucucuuucuugagcucacgaaggcuuacagcauagaacaaagaaaaugagcuuucuagcucaugguggaaguggaaagagcuuugagagcucauucgugcagaccccugccuuuaaacaauguccuaccuccagauaggagaggugaggccaggccccaguguugauugagugacucuugucuggucaagggcgugccaauccugcugucgacucguuuccauaggguccccagggcuuccauagcguccccagggugagaugcugcaccagaggcaagcugcaggcauugcccaaaguugaggaaauuguccuuuugauucagccacauucaaacuuaauuuauucaacucuuuaaaagggauagugaugcauuuucuucuaaaaugacuagaccgccauuuuccugugcuggacuguguccuccccgaguuugggaccugugucuugccuguauuugccuguucccuggguggaugucucuuuuuuuggagcagguugguugacuacguggaggccacuugcaagccgugccagggagaaguuaauucuguaacagcugugaaucuuucuccuuccagccucauccccucuuugcugugccccagagcagccagguaaucguuccguucuguucucuuacucuccggugcaaaaccucugccgggacauccucucuccuucaugccgaacucugucaugcagcaggguuuguggugugaccccuacuugucuuagggcacuuccaguuucugagcucauggaggacagagauugggucuaaucucuuucuguauuuguggcacccaguguggucucugguacauggugugcgggcucacuuuguugaagaaauagugcaugccaaaaaucguggggaggaaaaccaugguuuucauuuugcuuaggaaggccauuagaagaggaaucgacugccuaugaacauuaaauaaagacacaaaacuccuugccuuucaugccuacugcuuggcccuuccuccuccugccucccauagaaaaccuuucuacugugugugaaguggccucucguuugccuguguucucgugcuguuuggugugcaucuguuuuuaacagauguaagugugucauuauagucuuguucuguuuuuuauuuucccucgugcuccauuuaaaaugcacuguguucucugugucccuuuaguccauggcucuaacugcaucgugugcacauuucauguuuuacuaacugccugccuccccggguaugagcacuuagguuguccccgcuucccaccacccaagaucaagcugcccugagcaucccauguccaucucacucugcagggcacacagaugucuuugggcugcguucccaggaggggguugcugggucuuggguguggagauguagacuuuggauaagcagggccugcuucucccaggcugguugccgcaguggacacugccacccacggugaccaggggcuuccugcauccugcaguguucugccuucuaccacucuuaacuguguacuuuucauuucucugacuauuauuaaacugaagcaucucuucauacauguugaggucuuauggguuucuucuauacauaguuuauaaacuuugcucauuuucuuucuuuucuuuuuuuuuuuuuugagauggagucuugcucuauugcccaggcuggagugcaguggcaugaucucagcucacugcaaccucugccucccugguucaggugauucucagcuucccgaguaccugguauuacaggugcacgccaccacgcccagccaauuuuuuuuuuuuuaguagagacgggguuuugccauguuggccaggcuagucuuggaacuccagaccucaaguuaucugcccucuucggcugcccaaaauaccaggaugacaggaguaagccaccacucuuggccucauuuucuuacuauacuuaguugcugucuuuuugugucucuguauuauuuccuuauguauucuaagacguuaaucuuugucaguuucagaaaagaaaggacauauuaauguugaaaaugcaggaagacuauaauaggauaaaggacaguuguugaaacugaguacacagcuuugcauaacucauucaacugaccuuucuuuuuccuuuuugauauaugagcacugugucauagaugggcuuugauauaugagcacugugucauagaugggcgcugauacugggccagcuuaucaaaaccacugaacuugacaauauggcuaucaggagauaauccuucaaauguguggcugaagucuaggcauuuuguaucugagguucccccaaucagucuguugagucuccagucaagagagugaaaugaguucaguucaucauaacugggucuuagcaaaaccuuugccagaguccuggcaguuucuguccucuuuucuggauaugcagaaaacagcugguuagucaucccuuggggauucugcucaucuuaacaccaucacuuucugguucacaaucauccuuuucaucccugguugugaaaauuuucaccuuuugagagagguggaggccaguugcugugacaauggcccguuuucacaucugucugaucuuugguucugagguuugccuuuuuaauaguguaaagaaacccaguauuugguuauucucugggaauuuacccagcucacguuuuccaagugcccucugucacucucugacaggguccuuuguuccuauggggcagaguugggauuugucuuuaagcuuuuuuuuuuugagauagagucuugcucucucauccaggcuggagugcaguggcaugaucuuagcucacugcaaccucugccucucggguuuaagcaauucuccugccucagccuccugaguagcugugaucauaggggcuuaccaccaugcuuggcuaauuuuuguauuuuuuauuagagaugggcuuucaccauguuggccaggcuggucuugaacuccugaccucaagugauccaccugccuuggccucccaaaaugccaggauuauaggcgugagccacugugccuggccucuuugagcuuuugauuagcuuuccagaaacuagauggccuggagugacuucagaauguuugggaguaaaaaaucauccaucugaacucacaaaugguggggugcuuggaggcuggauacugacgguagaccccuaggccuuugcaggggcaguuccuguccucagccugagaggggugccagggguguggcugggucuggucccuuguugaagggacucuucuguguggcauccauggcaugcggaugguucgagugugucuuucuuucugcucucacuauuuucuuucucucgccacuuggaaggagcgagaaguggagccugggccaaacccaaagggcagguguguccugugcuuggcccuggagcuuccuguggguugagggcuguauuguugcuacagaaguacuuugugaggucguggcugcuccaggaaaaagugcccugucuugaagugggaggaaguucucucucaauggguuuucuguuuuggggcagcgagaugcugacaugugcccuuggagagaucuuggucuaaaucaggcagagggagagugaagaaaaugcauacacaaggagccuacucagggccagugguugaaaggacaaguccugcucuuggaacugugcaucugaacuucaaacugcugcuuccgaaccacaugagaugacggaggugaagguauggaggcccaugugugaagguugccagcugggcuccgggugcgcuguugaaaugcucucugggaaaccacguaguauaucuccaaagccuuagguucacugaaaaaugcuggugacaaacugaccucacugguucugccaaacagugaguucuacacaucaugaauguauugugaggacccuaacaugucucuuuguacuaacuguuucaacuuuguguuuguuuagggugguaccgagguuacacguuacgaaaaaagucuaagaagguaaguccuucuucuuaaacacagugcaugucucuucauaaaucacaccuugagaggaaaucaauuccaucucauuugugucugaggguuuuacuucuauaucucuuucucugaauuuaaaaaaauauauggguaggaaugugaacgagcuuggauuguuuucuucugaacaauauguguacauagaaauuguagcuucaucuccgugagugaauugcuaguuugugauauaguguuggccuguugucuucuguucaugaauuuuguguccuuuuuaggucugugugugucagagaaugauccgaguaaagcgacuucaggaaaaaaauuauuucucacaguugucaaucuuauguuguccuuaauaauagauuagcaaauuugcaagcucaugcaugcuguuucccucuugcauauaacuguuuuuacucugccuaagucaagcugugaaaaaaggaguucugcucuccuagagcaguuugcaugagugguuguuugaauuucugaaacuaagacauguaauuacaccucggaucauuguggugggcacucccauacacaauucuguuguggcuuuaacauucuuagcuucauggaaccuaauuauggcucuucuguuucauucuacgauguuaagauuuugaaguaaccucuauucuaagcugugguugggcuguccacguuacccaauauguuuuaauaucuaauuauguuugacccgauguguuuuaauaucuaauuauguuugacggaugguucauuuuacuuuuguguccuaaauuuaccucucauuaucuccuuauugggcuggacucuggauugugguccugagccuguaauaaguccuccaaagucuaguggcccaagugccaggguccuuccacucugccuuccccagagccccuaacccaggcuuugcugagcaggucagaaugggucauccucucgcaacaccagcacuugggaaggauccaggguggucccuauggcagccauccucuggcacagucaugucuaaugugagagacaguguuaggaaaucagugagccagaucugcaaauugggaccaggaccucuuaccuccaccuugccaaccucagacugggcuacaggucucuacacaucagugaccuauagccuugaaguuugcacaagaucgauuucaauccaguggaugguggaauagauuucuccaaggaaaguucuauuuucacauugguuuucccuuccccaaucaagagugaauuccagccaggcccaaagauaugcaccuguaggcccagcuacuugagagacugaagugggaggauugcuugagcucaggagauugagaccagccucugcuggucauaaugagugagaucuaucccuaaaaaaauaguguguaucugcagaugaagcucugaauuuaggaaagcugcaguugaaaccuuuaguaauaagagauuaagaucauggacuaauaugccccucccccaucacauuccuacauaggacacaacugccacauccugggcuggaugugccccaggcaagcuguuccuuuuucuuugaaucuuacuugguauuuguuaucaccuuccccaauuugagaucucuuccauucccacaaugccuccugaaaccacaguauuucugcacuacaccugggcaccuagacaucauaacucauucauaacucaucaacacaguagcgcuggguagggcauagcuauuuuuccaucuaagaucuccacugguagaugaauaaauccaagcuuuacagagauuauaaauuuguaaggggccuccuaggcaguagcagaaaagggaugugggcccuaggaauccuggcaccacgugucuguaaacaacuuuccuguaguuauaagugugcaguugauugggguggugcugagcaggcccagcggaaguugcgcauuucaaaccugcagguguguccagccucacucagucauuauccuuccuguggcuucaugauucuccaguggguuugcugagauugaggguugucuccaccuguggacauggacaagacugggacugguuuuuuguuuuucucccccaucuggguggacaccuauugcuaucauggaaagaaacccaggaggguguaccugggauuuggaggugucccggauaaccaggaccugaacacagcaacccagcguugggucccuucagacuucuguuuuuuuuaaguuaauguuuuauuuuuuuggagacagggucucacuuuguggcucagacugagugcgguggcacgaucauagaucacugccaccgcgacuuccugggcucaagguauucuccucccucagccucccaaguagcugggacuacaggugcacaccaccaugccuaacuaauuuguaaaaaaaauuucggcagugaaagggucucaccaucuugcccuggcuguuggugagcuccuaggcuccuaggcugaagugauccucucaccuuggcuucccgaagugccgguugcaggugugcaccucugagccuggcccagccuuguuuguugcucagccucugacucucugccugacgccuucccucucugugauaauucuucuuuauauggaauuuggccacuuuccuuguuggcagaagcaacaugaaucauuggugccugcuagaccaguucagcccccugccugcccccugcccacccccugcccuucccaaacuugauuaguagcuuguuuucugcaucauucagggcugaaugccggggaaacccaugcagaagcuuccauucccacaacaggugccuugaagccacaggggugccacuuuaucaauuucugcugcaugcacuaaaucucaugcaggaagcgguagcugggcugcguugcacugcccaagaccccaaccccguugccucuuuucuuaccuuugcuuuauuccaguaagggaguuauuuugcuugcucagaaagcaggacccuacguuuuuuuuuuuuuuuuuccugaggcggagucucgcucugucgcccaggcuggagcgcaguggcgggaucucugcucacugcaaccuccacuucccggguucaagcgauucuccugccucagccuccugaguagcugggacuacaggugcccgccaccacacccggcuaauuuuuguauuuuuaguagagaugggguuucaccauguuggccaggcuggucuugaacuccugaccucaggugauccacacaccugagccucccaaagugcugggauuacaucgugccuggccucggacccaaacucuugauaaagcucuuucuggcacuucacagaaugugccugaggcugaauguccuguugagaaacucuccccaggcuucauucucuugggcucacaugugcauugcacuugagggaggccgaccagcuuaucagcggaagcuaggguguacccccagguguugugcagauugggcgaaauucggccugucuuucuguauuuuaccagagggccccccuguuggggaagucucugagaaagucucugugggucuggguacguggucagugcacaagggacaauuggugguguaaaccaacuuucaucauuuugaaagaggagaccaucaucaaaaauugcuuuugagacaucaguuggccuuuguucugccugcauugaggccaaaaaggugugaucuauggagcagccugcaaauugccuguaucuuuguggacuuuuuccuuugcaaguguguugccuguuugcuucuaagacaucggcagacugcaauacaagccaaaugaguugccgucuuuucuacuucuuuguguuuucuuugauauguuaagacuuaaaaaauuaagagcgaucuagccaccccucaccccaccuuuuugggaacuauuguuugauuuacauucagcaauccuauugauaauaaaagcuacuguuuuuuuuuuccucccaaaggguauauuuccugcuucauauauucaucuuaaagaagcgauaguugaaggaaaagggugagucuggucuugauguuuaaaugaagaauugcaaguacuauauuuggccuugcugcucuuuuguacgauggcguaauaugagagggucaagacaaugggugugauugacuccugggggacaggaguuuuggggagagaaaggggacuugugauucagaguuguguuuaacauggcuuuuauccuuuauggagucugaagucagcaccauacuuggcaguuacuguccuugaaccuggggucacuauuggaaagcauucgcccuggugcucugugcuuccucugugagcuacugacuucauuuggcagagacuccaaagccccccagcucugaguccccuuuuuuuugggaagacauugcaggcugugauauaaauggaguuuagggugaagcaacaguuguuaaauugggacaugcaggaguuuacauuuugucuaauugugauguauguuuccuagaggucauaaaacugauguauaagaucauuaaaaggacauuucuagaacaggaacccauuaggcaggaauggcagaugaauaaccaggugugaacuuggaagaaggaacauuaaaauguuuucuuuuuuugucucugcuacaucuucacacucaguuaaauauguaaauuauaaaauuacuaaucauaugauuacugcauaaugacaucucuuuggcugauuacaaaauugccuuuccaagcacuguacuuuuaacauaugaaaagaaccguucggguuccauaguuccaugaugcauacuuaaaaugaagaaaauaauuuagaggcaugaaugaugaugaccugcaauaugguacuuuuuagacagauaaaguguuuuguaugcaaaguuuuaaagggaagaaaaagaaaguugagacuuuuacucuguggaaguaacuggaucaagugugcauuuaguguacuuuauaucugcauuagaauccuuauacagggcagacuguguaugauuauuuaaaaagcacuuugauguauacaaaagaauauauguaaaauguaauuaugaagcaugauaauaaagugaacaacagguuauucugagucucaauaaguagagucacaccuaaccagacaggcagacagagacacauuugguuccuguuccugggccuucugguccaaggugccccacugugggcaaaugcauagagcuauggugaaaugaacaguuuagaaacaauuucccugccuuugcuuuggguucccugugauuguucuccacacuguuuuccuggcucuaucugucucccuugccacggccacucaagccuagcugcccaacagcuccuucccugaagaaccccggccuucaggcuugacaggugaucucaucccucuucuuuuccuccagguuguuguagacuuccaccuucccuucuucuccugguccuuuccccuuucuagugccaaugugggccacgcuuucaucccaccucugccugccuucuugcucuccaaguuuauuguccugucucucuugcagagucugucucuuucaggaucugucucuugcuggucucuugcaugaucguucucauauggccucugucuugcaggcugccuuguaagccucucuuucuugcaugagcucucucuugcaugaucugucucuugcaggcucugucuuucucuugcaggcucugucuuucuuuuacaggcucugucuuucucuugcaaggcucucucucaugugaucucucucacaguaucuugcuugcauugacucucgugaaggaucucuuuugcuuugucucucuucucucuggacgcugacuucauucauucucagacaucccaaaugauuacucuaugccuguuaccacugauucuguaccuauucccccauaaccaaagcaauucccauuuuguccuccaugcuuuucccaguacugacaugguuagcaaugccuccuuaugucuggaccucacagugucuucucauccucugccucuggagcuccacugcagccuuggacacguugguccuugcuucacugaaagccccucuuaacgccgaugcucuuauccucuucuuauuaugcugaccuacugcucaggcaugucaccgucuccucuguccuguguccgcuacucugagggugcuguccuagccuucuccuauuucuuuguugccccucccugauugacauggccucuguugcguuucccucuucagcugaucugucucugugggugaugcucacaucgggaccaccagcccugauuugucucuugaccccucauucaguuaggcagccaaguaacuaaugagaaucauccccacuguugggugagcaucugcuaugucccauucauucucuuuucaaaaaaaauuauuauuauuuuuauuuuguauuguguauuuuuauuuuaugagauggagucuugcucugucacccagguugaagugcaguggcgagaucuuggcucacugcaaccucugccuccagguucaagugauucuccugccuuagccuccccaguggcugggacuacaggcauucaccaccaugcccagcuaauuuuuguguguguguguguguguuuuuuuuuuuucaguagagaugggguuucaccaugguggccaggcuggucuugaacuucugaccuuaagugaucugccugccuuggccucccaaagugcugggauuacagaugugagccaccgcacccggccaaaaaauuauuuuuagauuugacaaauaaaaauuguauguauuuauggugugcaacaugauguuuugaaguauguauacauugugggauggcuaaaucaaacuaugugugcauuaccuuacauacuuaucauuuguuuguagugagaacacuuaaaaucuacucucagcaauuucgaguauacaauacauagcuauuguagucaccuugguguaggauaggaggccuguugaacuuauuccuucugucuaacagaaacucggugucccuuugacccaucaucuccccacuccccuaugucccauucuuuuuuuuuuuuuuuuuuuuuuuugagacgaagucuugcucugucgcccaggcuggagugcaguagcaugaucuccgcucacugcaaccucugccuccugcguucaagcgauucuccugucucagccucccaaguagcugggauuacaggcgcacgccaccaugccuggcuaauuuuuguauuuuuaguagagacaggguuucaccacguuggccaagcuggcuuugaaccccugaccucacgugcucuacccgcuuuagccucccgaaguguugugauuacaggcgugagccaccgcguggagccccauucauucuuaaagaugcucugccuugaugcacuuucccucagucuuaccagcagcccuaugaggcaggcauuauugggguuacauauucuugaacacuggcagguaacaaggugguaacaaagguaagacaauaaagccagaucaaauguguuaaugccagcuggcacauuaaucccagggauccacugggccuaccagaagggaggaaccuaagguggaaccagaaccaacagcaggacauggugcaugcacugaggcccuauucacaugguggaagggaggucguugagcuccaggcuucucauagccagugugaggagcaccagugcacucaacccaggauccguaagaugaaaacagcccagucguuguugcagauccucauacugugaguggaaggaaauuucucccugcagacuuuauagggaugacaccguagcauguaaugaaccgcauuuccaucagcauccuuacugggaaacuuggggacauccuuggcagggcuguuuuaauagucauguucuucaguagacacugaugguggcccaugaaagggucauuuuguuguuguuguuuuugagauggugucucgcuuuguugcccaggcuggagugcaaugguacaaucuuggcucacugcaacuuccgucucccggguucaagugauucuccugcuucagccuccugaguagcugggauuacaggcccgcaccaccaugcccggcugauuuuuuguauuuauuuauuuuuaguagagacgggguuucaccauguuggccaggcuggucucgaacuccugauccacccaccucggccucccaaagugcugagauuacaggcgugagccaccacacccagcccaaagggucauucuucauagcaguuuucuaggggaugguuuugccugcacccuucccucugaugucugguucuggaacuauccaugagaccaccguucuuccaggguccccguugucuguugcuuugggauccuccccuccacugucaauaagucaucacaggccugaucuccaaucgugagccagucaggguuccuuccacaggucugggcucugugcacaucaaggguuguaggugggaacuauuguagcaucccucggcaucccaugcuggccacauucuugccuguucaggacacacagacaaccuguggggccagcuagccuaacuacaccagccacaaauucacucucucccccuaacccucaguagucugagucuuacuuagcauagugccugacccagagcacaugcccaggaagcagugguugauuugaugaaaacgagcgcauaaauagguaaugaguuaagaauaagucaaggggcugggcgcgguggcucaugccuguaaucccagcacuuugggaggcugaggugggaguaucaccugaagucaggcguucaagaccagccuggccaauauggugaaaccucaucucuacuaaaaauacaaaaauuagccgggcaugguggugggcaccuguagucccagcugcuugggaggcugaagcaggagaaucgcuugaaccugggaggcagagauugcagugagccgagauugcaccacugcacuccagccugugugacagagcgagacaccguuucaaaaaagaagaguaagucaaagguuaaacuuuuggggcggaggaaaaaggauaagaaagaggauacagaguuuaaucagaguuggcaucagauagaguaaccauggacauuuggaagcuguaaccucucucauauuucgccaaggauaacugcuuccuguauuaucauguaaugaguuuuaugcgugauggaaaauguaaaaguaaucuuaacccaaaccugcauuuuaaugccacauggaccggcuguaauuuauggcaucuuuaagauagauggguacacauauuaugaauauacuuuccuuuugccagaccuugacauucuguagacuuuuaauggaauauuauuugccucuuucaucuuacuuugacguaugagguggauggcuuacgugcaggguaauguaugaaccuucccaagcucuguacaaauauaacuugucauucguagagacguauguauuuauaugugugcaugcagucuuauuuguagauuuucuucccauuugcuuaauacugaacgcuauggccuagaugugaaauuuaccagguacuacucauagcaggcagugaaaccguggacucagcugcucuuuccuucuuuccucccaggcaacaugaaacagucaucccgggugaccucccccucauccaggaagucaccacgacacuccgagagugguccaccaucuggaggcagcucuacguggugagaaaaugagauauucauucaaagcuuagaaauagagagugggcuuuuuugacccugauaugccaaugggauguuuuuuuuucucagcgaaacuuaaaagcagagcuuccgagacagaguuuuacucggaauuggcaaaggaagcgacauggcugagaguuuagccccugcugggggcugugugcccuucgaccugccauguauuuggguguauuacagugagcuguagcagaagggacuguaggaugugucuuuccuugcauuggaaggagaaaugugguuguuucaggccccuggaaugcaggaucgggcaguggguguugaugucaccuuuuaaacaguaauaggugcuuauuuaaggauccgguagagggcaauuacuauuuuuuuuuuuuuuuuugccguugucugacaguagguaauaccucuuaucauuuaagaaaaacaacagucuucuagauuuaccuguguuugugacaggaauagggaaauauuuuacauucuagcuucgugugcaauuguccaguucuccugaucacagaagaagucuuauuaaugcagagagguugaagcucugacaucuuccauuucguauucccucggggcauuucuuugcacauaaauucauauuugcaguagauuaccuuuuguuaagcuuguauuucuauucagaguguugauuucucauaugcuaauguuauuaccaccaagccagggcucuggaaggaagucgguacguucauuucuugagaacauagaaaacuuccuaaaguccugcagcugcuuguugggcaggcuuguuguuuuugauuauacagugguuuccuauaaaugcacaguaauaagcaguugcaguaauugucaucaaacguacugaaaaaccuaaaagcguaaaguuagccaugaauguuuuguguaaaucugagcaauucuguagucaggguuucaucuucaacuuagcaauuuuuaaacaaaaauauggcaacaaaacaaacaggaguugaugcucauagucaguggaccuacuuaagucuguaacccuagaguagguauucuuaaugagcaccuugguuuccuuuuacaaaacuuaaauuugccucugauagacuuacaugguuggauuugugcaaagaaagcuaacccccaaaauggcuauaauauuuuuauaugggcugggcgcaguggcuuaugccuguaaucccagcacuuagggaggccgaggcggauggaucacuugaggugaggaguuugagaccagcccggccaacauggugaaaccccgucccuacuaaaaauacaaaaauuagcugagcaugguggagcaugccuguagucccagcuacuugggaagcuuaggcaggagaauugcuugauccuggaaggcggagguugcaaugagccaagauugcgccacugcacuccagccugaguaacagagcgagaccccuucucaaaaaaaaaaaaaaaaugcauuuuuuugcugcacauuguagauauuagcaaaauaguaaggauuuuagauaguugauacagccuuagagcaguggacaagagaaggcagcguggauauuagaaacuccuagaaagaagguuaaauaccagagugagcucaguacgugguuuagauauguagagggggaguuuuuuaaaaaaguggcagugaacaaauuuaauguuuuaaagggaccaugacauuuagauaccuuuuuauuuauuuauuuuuugagauagggucuugcucuguugcccaggcuagauugcaguggcaugaucacagcucccugcagucuuaaccucccaggcucaagcaaugcucccaccucagccuccugaguagcugggacuacaccugugagccaccaugcucagcuaauuuuuuuaauuuuugaagagaugaggucuccuuauguugcccaggcugaucuccaacuccuggacucaagcaauccucccgccucugcuucccaaagugcuaggauuauaggccggagcuaccaaggccagcaugcuuagaguuuuaucacauuagguuccaccuaaauuucuuuucauggaaagaaccacugaguuauuuuccuucagauaaucccuaaucuccuugauuauuguacgcuuguaauugcaagcugcaaacuguugcuuuucuuugaaccgucaaucccaucaaaauucuuagaaagugguaagaagugugaguuuugcaucuuauuugcauuuuccucuugucacaaagcaccaagagcuuguagauugagauuuggccucuugcagaagugucucuuguggguuguacacaccacagugugcagcagcccgcccaggguggaaugcuucuucuucccuauagcugagcugagagcgaggccgaggaguucagguucucagugugcugagaaggguccagggugcaggguguucugaagaccguauguagguuguaggauucagaucuuuaggcucagacuaauuccggaggagcuuuagacuugcccaucucugauccagaugcaggaagcucacgagcagguguugacgcucaaggucuagccccuguugggaucaccuuuuugcuucagugggacacaggauguuggaugaagucuuggggauuaugcauuacuuuuuguuccuuuaaucuuuuaaugucgcauggaaaccaaauuccguauaauauguuuuaguuuaugcugaaagcaccuuuuaauucaacauuaacuaaaucucaugaucuagugcuuauaccucaugcguauuugaagagauagccauucucuaccaucuccacaaugcuguuuuauaacaaaaucuuucugauuggguuuuuccccguauagcaagauaacagggagauguuucgaagugugcggcacaugaucuaugaccuuauugaauggcgaucacaaauucuuucuggaacucugccucaggaugaacucaaagaacugaagaagaaggucacagccaaaauugauuauggaaacagguuuguuuauuugaaagaugauuuuacgcuuaaauuauccaauguaauaacaucacuauaagucuucaggagaccaagaucauauuuuaucauaaaacaaaauuucuaccaucaaaguaauggcauguuuuucauuuugaaaaggaugagguauuuuccacuggauucugaacuggggaauuuugugagccauucuugaaaccuugucauucuucaagggauagagucaagaagccagggagccugucauuuucaccguucuggagggaaccccaucauuacuccccuagcaaggaacuuuuacuuucugaccauaguuuuugacuuugaguccagaucuggggggccuugcauagugacaagcaacagguuucuuucuguggaaucccagguucugagcauuggaguggacauuagaucacuggaaaguuugucaccuguguaggcuugccaguuuucacaaacagaaauacagcccaguuaaauuucacugcagauaaacaacaaauaguugcuuugugcaguuaugucucuugccagagcaagaguucuucccauccauagcaggcauccccccagcucugcaugagugccuuuagugcucaccccugccuacagcuguaccuucuauguuagcacguguuuuuugaugcugaaagcaaacaagcugcucugauccuaauucugcuggguccuguaacuagaaugaggccaugcccuuuuccaccugguaauauuuaguuuucauagaauagcagagcugcaagaagccuuaaaaaguaucuggucacaugguucccaaaugcucuucuauuucagaaucacugggauagcuguugaauuauagaaucccaagaccuaccccuuaaggcucugauuugugauaucugggaugcuggcuggaaaucuccaguguuuuuuuuuuguuuguuuguuuuuuuuugagauggaguuucggccuuguugcccagacuguagugcaauggcaugaucuuggcccauugcaauccccgucuccuggguucaagugauucuccugcuucagccucccgaauagcugggauuauaggcaugcaccaccaugccuggcuaauuuuguauuuuuaguagagaugggguuuuuccauguuggucaggcugaucucaaacucccuaccucaggugauccacccgccuuggcaucacaaagugccaggauuacaugcgagagccacugcucccagccggaaaucucaaguuuuaaaaauagaguuggguugugcuggacagcagauuuggaaaacuucugguuuaauucaacccccucauuuuacacauuggaauguggaagucagaaaagggaagggguuugcuuccagccauucagcagaaaggaguccggguaaaucaaggaaccuuucuguaaaaucagaauuaucacauaauuuucugguaauuuauauuuugaagugugaaaaacuucuuaaagcaacguuaugagcaagauguaggguuuggauuagaaaugcuguaggagagauuuuuauuuuuuuuuccagaaagccugagauauuagcuauuguugcagcaaaacccauuucaagaccaccugcuuaaaaaagcagacuuuuggagcuuugauuugauuuucuauuggaguaucauaauuuaaacuuauguucagagaccaccugcuuaauuuggcugcaggaagcuagcaaaguacauuguaucauggaaaaaucuaguuaaggaaggaaguguuuccaaauacaguuuacuacuuugauaggaaauacaguccuuaauaagacagguuuuuugcccaaggaucuccaggcucuuccauaauuucuccaaagcccagcgcucugcauauaucuuccuaguucuuccuucagaaaaccuaaaugaugcaaaaugauaccacaguguugaauguuugauuuuaagguggguggauuuaauaaggaaaagauguuuugcgucuuuuucauugaucgcuuaggcauucuugcuuuuuugauugauuuuuaaccuggguggagggguuugaggagcuguuugagaaugugaugaaggucuuggaccauaucucuagaaaaauguacauacacaauacacaaacacaggcacacagacccccccaacacagacacacacacacacacacacacacacagacagacacagacacacacacacagacacacacacacacacaguucuacacaugauuucagguggggaggucucccacccuguccucauagaugcauugggcuuccauggacuucaucucuccauugccuugcugugauaaguugcaccuucauaauggaaacucacucugauucagaaccagcugaacacugguugcugagaacaaugcguagaaggguugacugcacaggccacuucguuugaugguuugcauguggcauucuggaaggagcauggcucugccauuggagaguucugauacagaacccaggaucugguuuuggaauaaauaacuucuccaagcuuagguuuccuccuuugugcaaugggucugacggucugcccuggcaggugugaggugaugauguggcaggacgugcacagcaggcuggcacagggccguccucucguguguucccugagggaacccaauucugcguggccuguaggaccuacuggcugggccuccuaagcugguucuuuguagcugcccuggcaccagcacugacgugcccauaccagaacugaucaugccuacacuagaagugaccaugcccuacccacaguaguacugacucuauccacgcauuacugaccccugcccauaccaguauugaccccacccacaccagcacaaaccaugcccacaccgucacugacccugccuguaccagcacguuccuaggggccgguucagggauaggauaaggaguaguauuugggagggaggagcuugcuuuguuagugagacauauuacaaaaauaacuaaugagaccuuaaaaugcuuuuuacauuuucuccagaugucuuucuguuggucuugaggcacccugcuuacauugcagccacugcggcuguuuucaugcagugcaaaaagccucuauuuguuuaaagucuguuuacccugaugcuguugacaggcccaguugguccuccugcuucacugucaguggaauuugcucaauagauauuaaaaggaaaaaaucaguuuucuguauuugucuucccagugguacagugcuugagcaaaacuccaaagacuaaauauguuugagaugcuggcagacucguaucuggcuuuaaggugugugaccucaagacucgaagucucaggguaguuuuuuagauggaacauuuauuggcaauucaacuuuccucuuuaauuuguaacuauaaagauguucucuaauugaaauuuaucauucuuucaaaugacucuguuuccuuuuucauauuguuaaaaaagccuguuuccaucggcuuguuaauuacaggaauauaauccuaacggguaagaggcaccuaugguuaauuuucugcccuuagaccugcguguuuuguuaacaagaaagccagaaccuacugccagaucacaacucuugaucucuuuuguuacacaguugucuguguucuuuaaauaaaaacugugguaaaaaucaucuuacaauuuuguuggauuugaggaaucagagagaauauuccccaaaauauguacuguuuauuuauuuauuuauuuauuuauuuuuaguauuuauugaucauucuuggguguuucuccgagagggggauuuggcagggucauaggacaauaguggagggaaggucagcagauaaacaugugaacaaaggucucugguuuuccuaggcagaggacccugcggccuuccgcaguguuugugucccuggguacuugagauuagggagugguggugacucuuaaggagcaugcugccuucaagcaucuguuuaacaaagcacaucuugcaccgcccuuaauccguuuaacccugaguggacacagcacauguuucagagagcacgggguuggggguaacgucauagauuaacagcaucccaaggcagaagaauuuuucuuaauacagaacaaaauggagucucccaugucuacuucuuucuacacagacacaguaacaaucugaucucucuuucuuuuccccacauuucccccuuuucuauucgacaaaaccgccaucgucaucauggcccguucucaaugagcuguugcguacaccucccagacgggguggccaccaggcagaggggcuccucacuucccagacggggcggccgggcagaggcgccccccaccucccgaacgggguggcugccggguggaggggcuccucacuucucagauggggcggcccgucagagacgcuccucaccucccagacgggguggcggcggggcagagacacuccucaguucccagacggggucguggcugggcagaggcgcucuucacaucucagacggggcggcagggcagaggcgcuccccagaucccagacgaugggcggccgggcagagacgcuccucacuucuagacgggaugacggccgggaagaggcgcuccucacuucccagacuggguggccgggcagacacgcuccucacuucccagacgggguggcggccgggcagaggcugcaaucucggcacuuugggaggccaaggcagguggcugggagguggagguuguagcgagccgagaucaugccacugcacuccagccugggcaacacugagcacugggugagcaagacucugucugcaaucccagcaccucgggaggcugaggcuggcagaucacucacggucaggagcuggagaccagccgggccaacccggugaaaccccgucuccaucaaaaaauacgaaaaccagucagguguggcggcgcgcgccugcaaucccaggcacuccgcaggcugaggcaggagaaucaggcagggaggcugcagugagccgagauggcggcaguacaguccagccuuggcucggcaucagaggcagaccguggagagagagggagagggagaccguggagagggagagggagaccguggagagggagagggagagggagaauguacuguuauagacuggacagauuuauuagccagauguugcuuguguuuuuaguuggugacuacauuuagccaucuggccaggaaguugcuuaaccuuauuguagauaacguccauauguuugguguucacauacaauagaacaucuguauugaaaaucuuccuguggccucauguaaggacucgaaguagaaggggagacaugcagggaucccuauuggggucaguggggaguaaaaaggugguggauagaucucuccuccaaguuuucuucccucucuccuuccucaacucucugaugaugucacaacugccagcuauguguuuggguugauggauguauaugugauugcauauauaugugaauguguguguguguguacauauguaguaugccuuagguggggugcaguggcucacgccuguaaucccagcacuuugggaggcugaggugggcagaucaccugaggucaggaguugagaccagccuggcuaacauggcaaaaccucaucucuacuaaaaauacaaaaauuagccgggugugguggcacacaccuguaaccccagcuacucgggaggcugaggcaggagaauugcuugaacccgggagauggagguugcagugagccgagaucgcaccacugcacuccaguaugggcaacaagaacgagacugucucaaaaaaaaaaaaaaaaaaaaaaaaaguaugccuuaaaacuuuucauauuuuacauaauaauuaguaauacauacuucacuugggccuuguagaucuguaaaacuucuccuugcaagacaaagccacuguugauugcaauggaaauaaaaauugaggauuuuuuuuuuuuuuuuuuuuuuuacuucucccaagaugacacauuuuaagcuaaagaaagcagccuccaagaauuuuauauuccuaauauuuugggcaagcccgaguuucuagguuguuuuuaccugcccaguugcugugguggaaguugugcuagaaaauucagccuccuuggucuaugucugugaacuuacuaaauucuuguuguucuagaauucuagauuuggaccuggugguuagagaugaagaugggaauauuuuggauccagaauuaacuagcacgauuagucucuucagagcucaugaaauagcuucuaaacaaguggaggaaagguuacaagaggaaaaaguaaguuugacucugucauaugccauucacguuuucucaguaauaaguuuucaacauuaguaaaguaucagucaagcccaaaauugucacuaagaaagaaccugaaaaggaguagcugcagaguuuguguccuacagucaugaguggaauggagccugguggcacaggaugucacccaugacaugaaagggggucggacagcauuguguuucaucguaggagacaggauccuaaugauguugauuuuguguucucaucugucaaaugagacacaagacuugauucugcauuuccucucggauaaugguaggcaggucauguauuccaagcucauugagggcagagaguacaugucuuauugucuuuucgucuucuaugaucuuuaaugguaucauguaugcauuagccuguucucgccuuacuauaaagaagugccugagacuggguaauuuauaaagaaaagagguuuaauugguucaugguucugcagacuguauaggaaggauaguggcuucugcuucuggggaggccucaggaaucuuauaauuaugguggaaggcgaagugggagccaacacuucacauggcuagagcaggaggaagagagagggugugcgggggggugcuacacgcuacacuuuuaaacgacgagaucuugugagagcucaccaucaugaggacagcacugagaggauggugcuaaaccauucaugaaaaauccaccccaugauccagucaccucccaccaguauauauauauacacacacacacaguagauacucagaaauugacuaauugaaucaucuguuaauucaacaaguacuuacugagcaucuacuguguaccaaauguugaagacauaaugauacaugagacagauguccuuggaggguuuagucuaaugagggaacaaaaaauuaaauaacuacacauauauaaucauuauuuugauuuauuggauggacaccugaaaguuuuguaucucugaaaauacucagcacagcaguugcacaggauacaauuuuuugucuguugugugaaugcaugauuuaagaaugugcaggggagauaagaaagugacugcaccaaggccuuugcuggguuaugccaaugaguuauuacaauuuucuauucuguagggaauaaagaaagcaagugucagugaugaguguugcugggguugacuuucuguuuccuuccauacacagucucaaaagcagaacauagauauuaacagacaagccaaguuugcugcaaccccuucucuggccuuguuugugaaccucaaaaaugugguuuguaaaauaggagaagaugcugaaguccucaugucucuauaugacccuguggaguccaaauucaucaggugggugacauuucuuggcugccgucuuuccucuuugguuaguguuaggaacuugggaucagaaccacugaagcgucccauucaugcugagaggccuuggaugaauggcugcuggacacgagcaagcagccgagucaagagcugucuuagacagugugauggcagccagguugggcucugggucagggugaaccuucuugcguguagauugcuauuugcucguagaguuauagcaguugcagguacacucuggccguaucuuaagaguguagcugaagauugaaguaauacuuuguuuccuaaguugucuucguaagauuuuauauauccuggucccucaaauaucacuauuuccauuuuucaaaauuugguuucuaugaaugccauuucugugaguuuugucuuguuuuuucugcaagaugauuggcuggaauacaucauuuagaauggugccugccacauacagacugucaguuaauauuuguuaaaugaaaacacuguaagucuauuuuuuccugcuuagccuucaguauaacuuucucuuugcccagauggaaacaaugugguucaacuauguaugaauuaugugugugucuguguauauguuaaaacucuaguaucuucacuuguauuauucaaaauuugaaaacuuaguguaugaaugauacagaaaaauacgaguggauuuuauucucacuucugauaaagacuuuguuuccucuugacauaggaugcaguuuuuauuuuacaauguauuugguuugucauagguuuugaaauaaacaugcauugugcugaauuuuauaguauugucauucuaaaugaacaaauaggcucuuaaaaaaaaaaccaacuuagaaauaccauuugcaaguaguucuauuacagugacaacccaagacauugcacauuaaaacuuggcaagguuuuugugcuguggauguuaauugaugaguagcuguaugugauacuuuugauauuuauaaacucaauaguugucuguauagugcacguacaugguauuaauuaugaagcaauguggauguacauuugguacccuguuauuuggaaaauuaacuugcuuuuauuucuccauuuuucaagugagaacuaccugguucgcugguccaguucaggauuaccuaaagacauagacagauuacauaauuugcgagccguguuuacuguaagugcacccaaagaugcuuaguugaauuggcuaccauucuaaggacuacuuuuagccauuucugucugccuuccugcgacacuagaacaugggucccugggaugccuguauacagguuaauuuaguauuacuaaguagagcgcauuuccagaaaucaucugagucucuagccacccuuagaaucaccgugacaaagauuuaccccauuaacauggaaugugccucuuaaauguguaucguuuuuauuuuuuuccuugagacggagucuugcucugucacccaggcuggaaugcaauggcgugaucucggcucacugcaaccuacgccuccuggguucaagcaguucuccugccucagcucccgaguagcugggauuacaggcaugcaccaccacaccuugcuaauuuuuuguauuuuuaguagagaugggguuuccccauguuggccaggcugcucucaaacuccugaccucgugauccacccuccucggccuuccaaagugcugggauuacaggugugaggcacugccccuagcccuuaaauguguaucuuaagcucacuuaacaguaauugacuauuguuauuaaauuccuuuuugucauaugaauaacugauuaaaaugauaaaaacuggucugagaagagucucaauccauuuuuuuacuguccuuuucauuggagcuugcauugaauaaugggucuccaaaauaauuuauggaaacuaauauuucuaggaccucggaagcaaagaccugaaaagggagaaaaucaguuuugucugucagauuguucgcgugggucgcauggagcugagggacaacaacaccaggaaacugaccucgggguugcggcgaccuuuuggaguggcugguaaucuauuucucuguguuuccuugagaguuucagaucuucacagucacuuucaaaagaaucacuguugaauguugauuggacaaugcacagcugugauuuauaagcuuuucugcuggagagaaaaaauauauuuauuaguuauuuucauuguggcuucaaguugaccugcuaggcucaggaugcucuaguccucaaguuucagauauaaaucauauauuugguuuuaaaguggaucccaucuuucccugggagugauccugacccauauucucagucuguagggaagccagucaguggagguuuucaggucuuggugauggacauaagaauggauaugugcaggacggucaaagcaacgaagaagaggaagaaaggcaaacugugaagagaacgcgguuagcuucauguuggugcucuucauccgccauguuggugcuguuucuccgccauguugguguucuuccuccgccauguugguguucuuccuccgccauguuggugcuuuuccucugccauguuggugcucuuucuccgccauguuggugcucuuccuccgccauguuggugcucuuuaucugccauguuggugcucuuccuccaccgugcuggugcucuuccuccacccugcuguugcucuguuauuuuuggugacagcacgaggaaugugaaagaccaauuaucucuguugaggaaagauaaaggcauacccaggaaguucugauuauuugcccuaguucacugugacucucauuuuucauaguuuugggaagugguuuucucucuuuuaugguugcaguacaauuucauuaccuagcacugugauauuuauuuuaauuuuugugauuuuugggauucauauggauauuuaugagggaaaaguuccugauucuugacacauagcuggauuuuuuuguaugaacagcuauggaagacauucuuucccuuggcuaccaggaaacucugaacuuaguccauccccccugccuuuuaaauaaacauuauuuuuagaagaguuuuagguucaagcaaaauugaacagaaaauacagacaguuccuauauauuucuccuuccuucccccugccuccccauuaucaguauccaccauagauugguacauugauuacaguuggugaaccgcauugacacaucgucgcccugugaagucuguaguuuacauuagcguucauucuugauguugugccuucuguggguuucgacaaaugaauaauaccguauauucaccauuguagucucucacuggguagcuucaccauccuaaaaguccucugugcuccgccuggaauuuuuggaaaaauauuucaaaucauuuaaauaaaugacuuacuacaucauaaggaguaagcaauagcagcgauauagacauuaugagagcagcauauuaauucaauuuacuugaauucaauuuacccauagagcuaacuaacggaguguuccaaugauuuuaccauuugugagugaaaauggugagggugagguguucuuucugaaguccccacagccuugggcuggggaaauccuuuugcauuuucaucuuucugucuuuuuguuuuuaugagacagagucuaacucugucacccaggcugugugaugacagcucacugcugccccgaccuccugggcucaagugauccuccugccucagccuccugaguaacugggaccacaggcacaugccgugcuaacauuuucaugucaugacuugaauacauacuugaaaauugccccucuauuugucagagccuguagcaucuuuuacauguaaucuaguguuauauuuaaaaugccuuucauuuuccaggauuguuuuuuuucuuuuccaccuugaugguaguuuuaagaaaauauuuaauuuuugucucaggcauaauuggcuucauuugagcaaucagagacaucuuugacaacacacggaagucgcuccucuuuucaacagcagagcuacacauucucugguuauuagauuacaagauggauugugucauaaguuccuacgaaugcguaguuauauuucuuaaagaugaaauguagaccacaggcugacaguuuuuaccuucuuuugauuaaaauuuuuggaauuuaaaaauuuggaauauuuuucaguuuucauuggguugauauuccaggaaagucuagguacuaauggauggagagggugaugggcaugggcucagcugacaccacuguggccuuccacuguuucuuacaugcucacuuaugcuugcuugguggggucuagaguuagguugggccccccagcuccuggaguucuccaugaauuacagaagccuggguuauucacuggggcagggcgggcagccuggacauaguuccuuguuucuggagccccuaccuguguaguguuggcugagacacuacaucuggucccuggaguuuggaugccuggcuguguggccuccagggacuucuguccccugauaucugcugaucacauggacacccccuuuggucccugguuccuccugucuggacuggucucugguuccuucccuuccugucuugugucucugguacccacugauaucggggcuucugaaaacccaccuggggccaaguucuagccuugucgucuugcucgugaauuuuccagaguguggcuucuccucacugcucugcucugacuggcacaugggguguccccccucacuuagggguugcaaagaaccugugugaaccugcaugaaccugugugaaccucuauaaaccugugugaaccugcgugaaccuuuaugaaccugugugaaccugugugaacccacgugaaccuuuaugaaccucugaaccugcaugaaccugugugaaacugcgugaaccugugugaaccucuaagaacaugugugaaccugcaugaaccugcgugaaccugugugaaccuuuaugaaccugugugaacccacgugaaccuuuuugaaccuguaugaaccugcgugaaccugugugaaccugcgugaaccuguguaaccuuuaugaaccugugugaaccugugugaaccugcaugaaccugcgugaaccugugugaaccugugugaagugcuucagagauacccauaggcauuuguuuuccucugugggaagauuucaggccugcagcuguuaauguuggguugccggguccuuugaguucucugucccuucuggugucacaguugccuagcaguugcugguuugccuggcuccacuacaugcccuggguggggauguccuguucaucccuuggugccaagcacugagcacugagccuuuguggccucugugcucacuccagaggggccagccuuccuagcccugcucagcuggugugugucuguacauuauaaguaagaaacuggcugggcgcugccuguaaucccagcacugugggaaguugaggugggcagaucacaugaguuuggguguucgagaccagccuggccaacaugguaaaaccuccuaucuacgaaaaauaaaaaaauuagccaggcaugguggugcaugccuguagucccagcuauuuaggaggcugagggagaagaguugcuugaaccugggaggcggagguugcagugagcuaagauugugucacugcgcuccagcuuggggaacagggagagacucugucuccccucccccccaaaaaaaaggccagguacaguggcucacaccucuaaucccagaacuuuaggaggccgaggcaggcagauaaugaggucaggaguucgagaccagcguggccaguguggugaaacccugucucuacuaaagauacaaaaaauuaguugggcguggugcugugugccuguaaucccagcuacucaggagucugaggcaggagaauugcuugaacuggggagguggagguugcagugagccaagaucacgccagagugauggggcgagacuccaucucaaaaaaaaaaagaaaagaaaacaaaacaaaacaaaacaaaaguaaggaccugaucguucugcuuguggaguuuccaguuuccuacuagaaacucuucucugagacauuucauuaugugaucuggcuauguaaauuuuuggcacaaaaaguaaauaucuuaaugcagugguucucaauccuaacugaauaugagaaaaaucuugcgagcuaucaauaaaaauucuuggucaggugcugugguucaugccuguaauccuagcacuuugggaggcugaggaaggcagaucgcuugagcccaggcauucaagaccagccugacaacauggcaaaaccucgucucuacuaaaaaauacaaaaguuagcugggcgcuugguggcuugcaccuguggucccagcuacucaagaggcugagguggggggaucaccugagccuagggagguugagacugcaaaugagccaugaucgugccauuguacuccagccugggcuacagagucauccugucccccccaacggcccccugccccgccacccccccgccccaaaaaaaagaaaaaagucuugcacaagccccacuccuguccagguaaaccagaaucucuacuuuaaccaaaaucgcuuguuugucacuaugggccacucagugacuggcaguuugcugccaccagacuaccuugcccucccugcucugccccgcuuaucacaugguggcauucagcacaucuggggaauuuuuuuuaauaggacuugcuucuaacuuauucaguguguuguccaaccagauguucucuuuguuacuaagaaaggauacuuggucgggugcaguggcucacaccuguaaucccagcacuuugggaggccaaaguggguggauugcuugaguccagcaguucgagaccagccugggcaauauggugaaaccccaucccuacccaaaaaaacuaaaaaacaaaaauuagccggucgugguggcgcaugcuugggguggccaaggcaggagggauugccugagcuugggagguugagguugcugugaaccgugauuguaccacugcacuucagccuaggcaacagagugagacacucaaaaagaaaaaaaaaagggauagaagggaugcuucccacaucugagaagguugaucaacauuuugguaaucguauucuaucuguucauaggcuacuucaauuuccacaugcaaauuuaauuuugaggcuuucuuuagaaugacuucugcgugucuguguuaacagaguucaguuccuuaaaaugagaaaguguccauggaccuuuaagucuacaguucuuagucuucgguugaaaagaaugugucacauuucugucuuuuaaccuuuuuauaauguaaccuuuucuaucuuuuucuaaaagauagaaaauuguaaaaauaauggaaauuuuauggaaaaguguaguuaaauaaauuauccauaguuuuacauagccaggguaguaccucauguuuauucugauauguuuguuuccaaauuauuuuuucuguguguggcauaugauuuuuaaauacaauaucccguccuaccauguauuuguuuauuuaacugauugauuuuuuaaugucuuuuuagucccuuuuuugccaucuuaaccauuuuuaggcgugcaguucaguaguaaguauguuugcauugcacauacuuuuaucuuucuaacaaaccuagcauuaucuuaugaacauguccuuuuauuaagcauuauucaaaaauucggcuucucaauggcugcagccuguaguccugugauuccagcaguccuuugcuuugggcucugagguuaucucagccuugcgguguaguagcuacgcagugagcauccuggggcuugaagcaucccaccugugccuguuugcaggccagccccugcagcggaguugcugacucgcaggguguggggguccaucugccgugagcaagucauccugaugcagccccaccagugggacugagccaucagccccucucccugcgagacguuucucaccuccugccuucugcucuccugccugugcuggcccugggccucugucacucuugucccaacgccacugccuccuuccuucuccugcccucugucuuccagcaucacgcggugccgucugucuacccggccucucccucacacagcuguacugacuucagcuggacucugucuuuucaccauccucuucccugaauguagagacccugggcuggcuggcugggggaauuuuucccccaaguccuuuauuuccuccuuuggugucagggacaucuuguccaaacugcagggagcacucccucugcguggggcugugugcggaagagcagucaggggagucccugggaagcgcgaugagcggugaugacuggugacgucaaggccuucuccucgaggcucaggaugggugcgggacucgggguguuuuccaccugugggugcucaggcucugauugcguuucccgcuuguuugcugccuuccugcacaugguccuguguuccagggcugggcacuggggauguggcaagggagucccauggucagcuggugagaugagucccauggcagagcagagcucugcaggcacccagcaaggccacccaggaccagcuggcaugugagggugggccugcucgggucagacucccuugguucuggcucaucgugggcugcugccuaaaugaguuuauugaaggaugcugaacugguggucucgggcaucuuggaaaaagguaaaaaggugggugcugcagucagucgcgugugggucagucacccccaagagugcuggaagcugggaaacgcuucccccaggccaggugagggcccguguccagaccaugcauccucugagcagcugucauuugauguugcaaguuauuugggauucuuugaccuguaucugcaaacacagccgugggcuccuggcucuuugaggccccuugguugaguggagugagugugggugucgucucuuacgacacugcugaggccccuggggccccaccagaccaaacaggggaugaggaugcugcuuuuuugguucuauguaucccuccuccuuuuuggaggguggugauggugaugguagaaaggaaaauuuucaauauaugauuacuuacauguuggacaaaauauauuuagacugauccucuuaccugaacgcagagcugggcuacagagagacccuucuggggaaaggucuugugcgaagaaaauaaacaaggcaucuuccucucaaguccaguguggcgguggagcaguagcagacacagggaaagugacccgggccaucugggguuauucuuggacuuucuuguucugucaugaccaagggcaaaaggaauuguuugaaagguagacagugugucuggguuuaccccugaaugucaucagggaaugucuuuuaacacaagaagauggcaaaggauauuagccuuucuugugauguuagcaagccuggaucucccgggggguguguuugugaaggcaguuuaauaggauugaaagagcuugggucuuggagacuuucucgcuguagacuuugagcaugcuuguucaugccugucuuugagccucaguuucuugucaguaugguagguuacugaggauuugccuugaaguguccucuugaaagagcguccacagauaccagcauguggugggugcuugguaaaugguagcuacuuguuggcuuaauuguuugcgggaaagcaaaagugugaggcuucagaacagugcuggccagcgugguaaccacuugucacaugugacuaguuaaauuuaaauuaaaugaaugaaauaaaaguaaauuuucaguuccuccaucacgcuuucuacauuuucuuuuuuucuuuuguuuuguggcagggucucacucugucacucaggcuggagggcaguggugugaauucuguucacugcaaccuccaccuccugggcccaagcaagucucccaucucagcuuccugaguagcugggacuacaggugcacaccaccacgccuggauaauuuuuguauuucuuguagagaugggguuuugucauguuacccaggcuagucucgaacuccugggcucaagcacugugccugccuuggucucccaaagugcugggauuacaggugugagccacugcgccuggccuaugcuuucacauuuucguugcuuguuguuaauggaacauuuuccaucauuacagaaaguucuauuggacagggcagcucuagggugacaguuggguaauaggcaaaggaaauuauuaaauggaacucugccauuugagccccaauuccauuugggccagcauuuucugauaacuuaauuugucuuucaagcauggaaauaauuuagacuugacuaugagaaaacagcuuuugcuguuguuugccagaagauauucugauguuccuuuguuuguuuguguucugugauuauagcauuuaagccaaaacaaucucuguucucuuuuugucuccagugauggauguaacagauauaauaaauggaaaaguagaugaugaagauaagcagcauuucauucccuuucagccguaaguauggagcaauucaaguacuuagccagauauaauguggaaaacauaggcuuguaauaauuaucuuuauaauuaaauggauaaacauaacuaaggauugauuauuuuguaauuaugaaaaaccucuuuagucacugcuguaguacauggaauuuuuuguagccauaagaauccugggucaaaguuuguuuaugguccuggaaguaggagauuuuacuuguaaucacugaauugccuuauauagaaggcacagaguuacagcucugcucugagccugaauguuucuuuacauaauugauuuauucuaguagcuauuuguauuuucaaagcacaauacuuccaaauucaucauaggagguugcuguuuuuaaaauaaaaaaacaaacaauuaugaugaauuauuuuaaagcgagaaauaaugcuuuaaagcauauaaucacacugcugauuuuugugucucgguuuuugcuuagaguggagccuaucuguguucguuuuuaggcuuucucuaguucugaccugaagucuuuaaagaggcacggaagcugagaaaaagcucuuggaggagauucauuaaauugauuaucugauuuguggguagaacccagggaacuggugggaagaacuggcguuuauuucccucguguggaagcaagaguguacccagaugauggucguuggccacuuaagcacuccuacuccucacagaggaggagagaaaaaggaauccagaugguugagguuaauuguaagagacagcuuccuccugggcgugggguuggguggcgauguuaggggagaaggcaugguaagggcaguggaagccaccugccauagugcucugcaguuucacuuuucccucauuuuuauucuuaaucgacuucagacuugaaacacauuucagauuuuagaaauuuuacgguuuucagcuguuggcugaaggguuuaggaggcggguaguaauuggguggcugaaggagcccuguccuugggggcccggagaugugagguugacuucccucugccccacgcauccuuggugauggaccaccgcgcucaaccccacccgacuccucugggucuugagugccacuggcuaagacaggaagaguauggcuuucuuugcaggcgggcgauguggucacauagcacccuaaagcuuuuuguacagcucaguaggagauuuugcuaucuucuugacguaagaauaacagcaaacccugcguuauugagcugggagucaggguuaaguuauauguaucucagcaugcacaacuagaggcaaaggucucuuuguggcuuaaaugcuuuagguuuacucuccuguccaauaugguaaccauuagcuccauguggcuauuuaaaauacuuaaaaugagcugggcgcaguggcucaugccuguaaucccagcacuuugggaggccgaggcaggaggaucaccugaggucaggaguucgagaccagccuggccaacauggugaaaccccauaacuacuaaaaauacaaaaauuagccggguguggcggcaggugccuguaaucccagcuacuugggaggcugaggcaggagaaucgcuugaacccgggaggcagagguugcaaugagccaagaucacgccacugcacuccagccugggcgacagagggagauucugucucaaugauaauaguaauuagaaugaaguagcauuaaacauuuaguucuucagucacauugguccuguuucaaguguucagcagcaggggaggucaguggccccguccugggcagcacauacauagcacaucuccagcacugcagaaagcucugcuggauuauguuguuuuguagucccauccagugaggagaguuuauaaagggaacacagugcugcagaaucuggaaguuuccuuagcaaacaaggggaacaguaucauggaacaugggcagauauugaggucauaaauaaaauacaccuuuguaaaauuauaauauuaaauugccucauucucucaugagaaauaaugcagcccccugcuguuuugaaugcuguauuauauauuagaccucagagguucuugaugcccagauguaacacuaaguugaaauuaccuguugccugcuaguguccucugugaaaagucaaaaacaaaaacaaaaacaaaaacaaacccaaccugagggauuguuugaaagguuagggagguuauuaguuuuagauucacugauuuucacagaacauguuaugaguuguuugagauugccugugcuuugacgccaucuuuuucuaucuuguaguggaauguccacuugaaaaauauguuauuccauguguaacucuuauguaauuugugacuccaugcuccauuaaaggaagacuaauagacagaugaauauuugaaguguuggaaacaaaagaacagcaugauuuuuaauagcaaaauaagcagugaaaccaguucuuugggaaaugucgugcuaaugaaaccauuuuuugcuccauuaaaacugauuuauuaucucacaggguugguuuuagagaaggaagcacauugcacaucucccucccucccugucuuuuuuaacuuggugacguaaaugacaacagucuucaguucccucgagucauguggcucaagugauggauagcacuguccuuguucccaggauugauuuuaaacauuauggccaugcugucuauuuucuugcucauuucauagugcacuucgcugugcuacaugguauuucuauuugggcauaugccccccguuuguagccagucucucguacagcgcagcaucugucacaggcuccugguucaugggcccugaaaacguggguggucuguguucauaacagcgccacacgugggacuaggcagugguguucuccacacacgguaccauucuucucacauguagucacuugagggacuauuguguacguaguccaggaggguagaguagaaagccuuugcaagcaguuagguuccagggauuuuuuuuuuuuuaaaucuugauuuugcuuuucccuuuagaucaaccugccccuugaccuaugcuauguucagaauuaauugaaauuggaggaauggccauaaacauucuuugggauuaaaugccuuucaaccauguggcuuucagacaagcuccuuuuuuuaaacacaagagucugauggagaugcaguggaggccuggugcacguuuauuccuggggagaggguugcccucauuugcucuguucccucucgugguucagcauuuuccugaucaaugcuuuucccuguuucucuugucaccucucccauccuuugucgugcguugacucaugaugccucccucucgcacucggugacgaugaucucuuauguucccuuguuaccguggcccaugggucucugugccccuuugucuccuguggucuuggucgucccgugcccuccaggcucgcguuggacgacgccauucgacacaagccgcugaacaugucaucccguuuuucacccaggguggcaggggagaaugacuuccuucagacuguuauaaacaaagucaucgcugccaaagaagucaaccacaaggggcaggguacguauuuuccuauuuuguuucuaucagcguguauuugcaugcguuggggcagugcugucuggguugguuuuaguuugauguugaucaugaugguggugauaaugauggggaugacagugaucgugguggagaaugugugugacaguugccccuguguacagugcaugaugguuuucuugcccgucaccuuugugaacauugcugagagcccacuccuggauggagaguggggucagauuagaaguuuagaggaacaugcaggcgguaggcguaacucccucugcccguguugugugcuaaucuuugccuguucugggucuucccugcuggucucccuaagaaggugauuucauuugugcagacuugcuccccugaguucugucauuuaagugauuucuccgccccuacacuccgccucacacucacuguuuuuaauccugcacugacacguuucugagcagcugaccugcugcuggcagaaggaaugaaucagucaccucgggcuggugacaguuggcacuuggcuggccaggagggcugccaggaaacaacugugacugaggccccgccuccagcccaaggggaagucaccuucagaacuugaccgucucacucccugauccaugcagacugcccguaaacgcgguagagcuuaggugaacagaccugcuucaucguccagcuaccuuaugucacuagacuuuuaaaaaacaauuaucuugauucauuuccacuguucuaaaggagaaugugaauugagccugaagaauguuuuagagaaugagccuuccuagggaucugcagggaccuccagcuuucuucuggugugaacuaccccccuuucuggcaaacaguagcaggacaaaaaccccaacccagaacguuaaugagauguggccucugcagacagagcgauuuucagcugacccaggacccaucuucuccuaaauuaacagcccucccaauuuacacuuuaauugaaaaccacggggagguccaauuagggcuguuuagauuggagucacucucaggcugggagugccagugcaaagguugccagccgauccuucagugcuucgagcugggacugcccucggaucuccaguuucuuuugcagucaucggaguuuugauaaacuuuuauuagagucauucagggaaaguggaguuuggugucaggccagcaggaaaucacugggaaagaggaccagaagccugccucugccaggcucacugguguguggccaggaucuuugaagccggcgaaccuugggcucauguccggggguccaguuccuugaacuucugggaggagugggcauuuucaagucacagugaaaacugagggagaagaacagugauaguuuugucaaggggaucacaggugacuuccugaaucagaauggccuuaggcaacaugacuagugcuuguuuuccuugaaccugaauuuucuccagggcacaaugguggguggaauucaggucagaggugagugauguggccagugagggcagccacacagaucggccgccgggacugcagggcgcugcccaccggcgcucauuuuaucaccagcagcccaggcuuaaccugauccuugcuugucugucaagugacuguuagcggccccaggaguggaagggacauggaggagauacucaucuucagagagaaccacuggguuuuuucacaccucuguccacaugcgccuccugucucuugagcucaccacuuggccuuggccaguuuuugguuuaugccaacauguuuccucuucacaagagacaaaaauccugaauauuuaauccaaauuauucugaucccugaacccagaggugugggacauuuuauguggacagugaauucaugaagacuccagacaucugguucuguuguuugagauagaauguaugcuaauccucuuuguuuuuaguuauucugcuuaagcaaaugucaaccccaaaugcacuuuuuucuccugugagaaaagcauuuaaaacacagcauaaucaggaacauuuaauuuccauuuuuaaagcgugugguaauaaauuuaaugugucacuagugcauuaguuuauguauuaagauauuugcgcaggccggcguuucugagaaagguguuugaaacacaggauuucuaauauuaaguguuaaguguuccauccucaugucucaaccuuugaccucuguagauaaugaccucaccacauccugcaauccuucaaagagcaucuuucuguaagauauauuuuguggacauucauucuccagggaggcuuuuggacucaaacuccugagauuugagaaacucuuagcugcauccuggugucccagggaagaccagcucccugugagccacggugccaguuccucaggcucuucugucagggucugggcuuugguuugcucucccggaggccagggcuggggguuagggugaggaagugccuggcccuuugcccaucugucugcuuaccuauucugcaggucuggagcugcuguuagcucagggugcuuuugugugaauuagaaaaaggggccucaucaaccaggugaguagggagaugcagccagcgccaggaccuguggcucugugagcgaguagaggcaggguuuagcucccacuugccuuuuguggucacuugucuagugaaaugcacauucugggcagugguacaugugcuccugucugggugccauccccgauaccucuuuggggaccgcuuucuauuggugguucuuccuucuucaaacucucccucccaugaucuggaauuucauaucuuaaaaagaaaggaaaaagaaaaaaaauauuuaaaaaaaaaaaggaaagaaaagaaacaccaagaagcaguccuacccugaguaauacaucugucucugucuauguggccucucccucuggucuucgucucccauucaucuucacccuucugccucccagcaucggcccucucccugagcgcccccgcccccucugcccccgucucccaccaggagcccuguggcugcaugggcaccaucugucccaguuuuccauuuccccuguuaucucugaggucucuguccccuugugagcucucaaagugggccuuucuccugccucuucggggcucuucuuuccuuccccacucugggugcuugcccuucaggcagcucugccuggagcgagcgggucuuccuauuucaaggaacggugcccccgggacuugcuagugguugugccugcaaggggcaccgucucuguaagcugcgccuccuccuaccccaacuccccgugguucugcugacuugaccuucacgcuggucccucucccacccuccauaguggcauucacguccugccagccagcuaggaucaugcgguggccucccugcugcgauuccauccccacugugcucuguucuccugccuacccauucccuguagccacagggugucaggucagagccugacucuuguuccugagccccacucugggugccccccauccuucagauagaccacagucccugccaccccagccuccgcacugucuuaccacagcgucugggggcuccaccuccccugggugaggacaggccugcaguucccucacuuccugcaggucucagccccgaagucccuuccucugugacccuugagacuguggucccaggaugccuugcagugugcucaggacuucucccgugagaacuucgcaguugcauauuucucuaagagaccauggaguuaguguuugaccguuggcaauggaagcuaaacaccugucaggggaggucgugagggucugcccuaugucuccaguaggugcagugcccaguauuugccuggcacauaguaggugcucaguagcuacuuuugaauaaauuagagggacucacuagauagcaagaggaaaggggguuucaccagcuggcaaagaacaaaacaucaucagugacuuuugacuucucagcuccagcuaauggaaaucugagcaaaggagaaugccauuuccaggauagcggauauaggaaugggcagccagaggacagggcgugaggugcgggauugaaucaagcagggcugcucccgucagggacagccggaggugccggcaccgcugucgguuaccucccagugcugcucagaaggcaggcugcuggagaacaggccugugacugucucaguuccuuccacgcagggcagggcgcugagcugagggugauggagggcagguucugcucuggaggcaucugaagaggggacagcugcacacacacacacauacacacacacacaugcacacauacacacacacagauacaaauaccacaaacacagacauacgcacauacacacacacacaccacacacacacacacuaacacagauauaaacaccacaaacacagacacacgcgcacacacacagauacagacaccacaaacacacacacagauacacuacacauacacacacacagauaccauaaacacacacacagauacaccacaaacacacagaugcagacaccacaaacacagauacaccacacaccacacacacacacacaccacagacacacagagauauaccacaaauacauacacacgcacacacacacagauacagacaccacaaauaaacacagauaugcagauacagauaccacacacacacacacacacacacagaugcagacaccauaaacacagauacaccacaaacacauacacaccaacacaugauacaccauaaaaacagacauacacacacagauacagacaccacaaacacacacacacacacagauacaccacacauacacacgcacacacagaugcagacaccauuaaacacagacacacacagauacagacagccccuuccacucagauauacauauagacacacacagacacacacauggguauagacacagacacgcacacagacauauauauauacacucacacagauacagauauacacauaagcacagauacagacacagacauacauacagauacagacacagacauacauacagauacagaaagacacagauacagaaacacagacagacacagauuuagccacacgcauacagauacacagacacagauacacagagacacacacagacacacacguguacagacacacauggacacacagacacacacacacacaugcacagauacagauacacagacacacagugacucacacagacauacgcacagccacaggcaugcgcgcauacccaugcuaguagcagaaaugaggacagaggcuuugauguucugaggggcagaugaggcccuaccaagcugaguggggggaagcaagcaggcagcccccccugaggccucagggacagagcacccccaugugcuggcuuauagugccagccccuucccauggggggaaaagaugccgucgucguagaagacagcucaggccgagccccugccugccccgccuuugacuuguuggaauguguggcuuguuuccuuguacugucaccuccuauuugguugcuacucaguauuuauacaaaccacaguucuuugucagccuugcagggaggaagaucccgcgcacaucccgcacacacgcccuuacacauagaccccaccggguuuacugcccucuccccaggauaccccuggcaucuagguuuagaggcuuugaaagucuucauuucucucuuggagaaaagagccgagagcggcuggggcuuuguuuucuuuugcgguggcacugugguacagagggccugggcuccacaggcugcaccuguccuggcugcggagggcuguccugcugguggcccugcagacuggugcuccacugcucgcccagguugugugaugcugcuuagcuacuugaaacuuugauggguucucgaagcuacgaauucaccuccagaauccuccccugccuuugucuuuccugggagacuagaaaaugacagacuucucagccaccuccuagaaaaagguggccugcugauuuaucuuaaaugucuacccacucaaaagagacauugguccuuggcauuccucagcagcacagugggugcacagcagcugcugaugugcguucagcugucugugagucacccuagggcagggcuggcaucccagcucguuggaugcauggaguccccacgacaggcaccuuuugccuugccccucucuuucucauauacccaccuuuucucucaagauguugaauugugaauuaaaagucucucauucauugaaauugguuucgugaaaacuucuaaaaaugcauaggauaaaaugcgacuuaagagcauccauuguuuuuccagguuuguggguaacauugaaauuacuuccuggagauauccaucagauccgaaaagaguuuccgcauuuaguggacaggaccacagcuguggcucgaaaaacaggguuuccggagauaaucaugccugguaagaacuggcuuguucagggcuucucagcauggcauggggguagccggccacggaggaugacgugugggcagcaucauguaugagcucuggcaaggaaagggcucagcuccugguaggugacccuguaagccccagcaugguuauggaucauggggcugugaccggagugguagaauaugcucccuggcccccuguaccccuggauggaucagcucuccccagcugcaaggauugugugaggggggcgugggcacccagcaaaugucuggguagacaucaggucaaaagaagaaagaggucagaaagggagcugcccauugugaagcccacuuagggcaaauggcaggguuggauggucgcugaauggaaaugccugugccugcgcccgcucagcuaguguacguuauacuggcauuccuccaugaauucuaagucaugaauucuaaacugaccgauaacaggauuugcguguuaacauuaaucucauauuuacauaauacuuuucauuuuccaaauaacguuccuaauaaucugauuugaucaucaagagaucuuuggaagcauguuaauuuguauccuuuauauccgugugauacuuuuugguuugcaaguaaugcuuacguggcuuggcagggcguaguggcucaugccuguaauccuagcacuuugggaguucgaggcggggggaucacuugaacucggguucgagaccacccuggggaacauggcgaaaccccgucuugacaaaaaaauaaaaaaacuagcugggcgugguggcauaugccugucauucuaguuacuuuggggggcugagguggaggaaucacuugaaccugggaggcagagguugcugugagcacagaucacgccacugcacucuagccugggcgacagauugagacccugucucaaaacaaaacuaacuugaaccacgugaggcucuuggaagcccacaaauugguguugagugaauuccuauccagauuaaacuguagccuaaagucgcucagcuaaugagccguggaaacggggacaaacucccccauauucaacgcggccuccuuuuauaggccugugcuguauagccaggagagugguggcuauucagggugcaugcuguaggaguuacugcuuugcuuacuuuagugcaacuucaagacacauucuuucuacuccuuuugucuuucagggcuguugugggucauugaauagucggucugguaaauccauaugaaagacaucuaaauugguuaggcuaaauaauagcuaggcuuaccuguacagaaagaaaagcaugacguuuagucaauucugaagcuauugcuuguguguguccagucuauaugcaggaaauuaauuuagguuuauuaaugggaguggacuaauuuguauacuuauuauuuguauuugcauuugagauacagauuuauaaauuaggaugaagcaauuggcaauaugcauuuaucuuggcauccuuaggauguccucauguucaaagggaaacucagaagcuuccaguucaugccaauaguguuucccuuaugauggauagacuuaaaaacuaagucuaggcccggcgugguggugagugccagguaguagcugcuaguagcagguacuagggaggcugaggugggaggaucccuggagcacaggaggucaaagccguagugagccaugaucacaaccacugcacuccagcuugagugacagagagagaaccugucucaaaaaaaaaaaaaacuaagucuaaacuuguagaucaucucaugauagauucauagggaaaugauacaguugaccauuguucuggcagguuccaugugcugaguccucggguauauaucucacaggaagugauucuagcuugggugggucaucugcguucucuguuggccgaguaaucacuggccgcgcugugggcaccagagagagagagaguaugggcgguuaucagucugucucgcugucuuuagccugcagaaccuguguaucacccgguuuugucacugucugcagggaugcgcgucuucuuuggacagcgcagagccugucccaucacccagcggccugcucugcuacuuucucauagcucguuggacuccuggaauccuuaugaaggauccaggcaggcgaugccaaguuuuccuuugagcugggaagguagcaggaguccacuaugucugcuucuaguuccuucuuccccagaauguucuguaaccuggggaggcauuugaugagggucuauggugaaugcccauuugugggguuugcuuacuguaaaugaggucuuacuucugugcuggcccuggaguaacgcacuugagguguacuugggagugaggcugugggaguuucgcccugucacccgggcuggagugcaguagcacgaucucagcucaccgcaacgucugccucccaguuucaagcaguucuccugccugagccuccggaguagcugagauuacaggcacgcacuaccaugccuggcuaaucuuuuuauuuuaauagagacggggguucacuguguugcccaggcuggucucaaacucccgagcucaggcaauucacccaccugagccucgcaaagcgcugggauuacaggcgugagccacugcacccggccuugaaguucuuuuuugaugaugguguuugugccuugauagaauuuuuaggcugagagaucauggaguuuaugccuuccuuaucagugaggcuguuuaguggugcuggccuuggaggcuaagugacuuguccaaggucacacagcaaaugagcaacaagucuugguuggguggccuugcaccugccccucguccugugcuccacgguucuucucguggucaguaucagugggcggcagccgcgccuccuuccacacagcuacuguggcugugguggcaacccacugggauuaugaugauaaugacuuuuaaaugaaagcuuaauuuaauaguuggauacauuaaaagccaaaauagagcaguuuaaaagaaaaaaaaaagccaaaacaagaaagcaaggagcaaagagaguuauuuuccuuaagggauccuuggucuucagccagaaugggcauuugcugcucuugacggaaccgcucuuuggcuccuugggagagcggguggucagggcgugggagguggccaggcaggcagcagaggagcaguggcugggaacgaggcuuccucuaaaucauguuacuaaugaagcuugugaaguucucccaguugggccauuaccaggggcuuccuauguucucaguaggaagaagagucuugagcucauuucuugcguuuuuuuuacccccuacaauuaaaagcccaucucacuuuaaaacagacaggucuguuuuguucuucucucugugguccccauucgggauccugauagcugccugccagaagggaagagccaugcagaaaguuucucccuagacccguuuuuccucccugauucuaggcuggugauccucauucuuuuuuucuuuauuuuuauuuuauuuuauuauuuuaaguuuuaggguacaugugcacaacgugcagguuuguuacauauguaugcaugugccauguuggcgugcugcacccauuagcucgcuuuugagacggaguuuugcucuguugcugaggcuggagugcaguggcaggaucucgguuugcggcaacuucugccucccgaguagcugggauuacaggccugcaccaccacgcccaguagcuaauuuuuguauuuuuaguagagaugaggguucaccauguuggccaggcuggucuugaacuccugaccucaagugaucuacccaccucggcaucccaaagugaugggaucacaggggugagccaccucgccuggccgguccucauucuuaaucaacuuuuaguucaacucuuggagucaugcuuuuaagaagaaugcauaggaggcaaccuugccaguuaccugggagugccaguggauacugcgauaguccuuggcuacugaggacucagacagccguagccagccgucuaacaagggacaauggugugggcugccaugggucauggaugccaucaauaguauuggagccccucugguugucggcuacccugagagggguagaguguccucugcccagaugauaaccaagcagaucauuggaaacuuugagauuuuuccucuuucuagaaaacuuuaucaugaugaaaauugcucuugucauguauuuaaauggugagacuguuuuguagaaaauauuucauaaucaucuaauauguauuuguaauaaucuaugaggauagguagacagucuugcaaaauucacaauuacgcuauuaauaauggauuguuuuuuaaauguaugauuucuccccccucaggugauguucgaaaugauaucuauguaacauuaguucaaggagauuuugauaaaggaagcaaaacaacagcgaagaacguggaggucacggugucuguguacgaugaggaugggaaacgauuagagguauuuauuguggcgagggcucaucuguaguguuucaguuuuacuugccaagugcucaccuuggcucugcuacagcauagaugucgucaggguggggcuuuggagucccguuucuugggauuggcguugguucuuguuuccuuuucuccagcuugccaugcagggccugggguccucugguccuggcagcuggccuaucucaggaggucccuguggucuuuuuuuuuuuuuuuuuugagauggagucuagcucuguugcccaggcuggagugcugcaggugugugccaccgugccuggcuaauuuuuauauuuuuuaguagagaugggguuucaccauguugaccucaaauaauccgcccgccuuggccuaccaaggugcugggauuacaggcgugagccacagugcccgagcaggucccuguggucuugaccaccuuugcccaaccuuaucguggagucucauuugcugucacaagcccaaggccuaaaggucuagcagucacacuagaaguacagauaccauuguuacgauuugagagaugaagaaaaaugaaggcccuaagaaaucaauuaaauugcucagcguuagagagcucuagggguggaacugagcaccugcucaugacagccagagcucugaccucgugcucuaccuaccggcgaucaugaagaucugcuuccguggccacagcagccugcaggguccaccugggagguacuuagaagcuauugccuccucugaugaccagaggucaaaucagagcugcugucccugugaggugccucuuugcaccagugcuggaggacugggcuuuucugggcccaugggguugugccuaaggcucagugucgccaagagaagcauuaugucuuucucucugggugaacucuguccagcaucacugccugccucgucucccuggaaacauaggugcugcccuugccacuggucuuucugguuggagugaagcaaacaguguucauggcuggaggaaggggaggggaggguucccacuuuuuagucuacagucccucacccuagaccuaugggacggaucaggcaacuuccugcagauccuaauguuaaaguuauuaggguugagggucuggggaacuggaggucagugucauccccaugugucauaaccaucaagaucuucaaugugugagaacagggguuggagcuggccgcuggcuucagguggaucugugcuucccuugcugggaacguguucauuugugguggggguguguugguguucuuggagcguaccuguccccccacauauauagugggagauguauauggugucaagcucuaugaggucuuacgugagcucuuuaugucuucuuuuaaagcaugugauuuucccgggugcuggugaugaagcgauuucagaguacaaaucugugauuuacuaccaaguaaagcagccacgcugguuugagacuguuaagguauuauuuacauggucauuuuaucacauggcgcugauuaugaaaugcucauuuguaacccaaggaaacauccuaacauccuccucagcccgggagcugcuccaggcaggcagagugucucccaacaaagucauucaagguugcuaaggaaccacacugguguuucuuagaauacauuuacucucaucuccuuuuggacguaaaaauaggacguucauggagacaaaugacagagucuuuuuaagauagcuauugucuuucucuucccaguacuguuuuauguguggcaugcugucuuuacaccaaacaaaaaaaccgagcugccagccuguggaggucauugcuggggagugggauccuguucuguagcucugauauggugccuuuucauaaugcagcgugcucacaucuccacgauggaguaaacaccgucucaccgccaagagcuugaauauuugaaaaccaggccagggguuggcucuggaauacagauguuugaugugagaauuagggacaauuuuugcuuagaggcagcauguauuaggucuuuuuucuuugaguguaaugugacaacaggaaagcuuuuuuggcgcagcugugggcaggucaccacagcuguggaaggaauauagacccuuccagguuggggcuaagaagaaaaacggcaacuuuucuuuuuuugagacggagucucauucugucacccagacuggagugcaguggugcaaucucggcucacugcaaccuccacuuccuggguucaagcgauucucuugccucagcuuccugaguagcugggauuacaggcauguaccaugaugccuggcuaauguuuuugguauuuuuaguagaguugggguuuuaucauguuggccaggcuggucucgaacuccugaccucaagugauccacccuccucggccucccagacugcugggauuacaggcaugagccaccaugcccggcccaaaaacagcaacguuuaaaaguagaaucuuggccggaugugguggcucacacuuguaaucccagcacuuugggaggcugaggugggcagaucaucugaggucaggaguuugaggccagccuaacauggaaaaaccuucucuacuaaauacacaaaauuagcugggugugguggcgcaugccuguaaucccagcuacucgagaggcugaggcaggagaaucgcuugaacgcaggaggcggagguuguggugagccaagaucgagccauugcaccacucuagccugggcaacaagagcgaaacucuguaucaaaaaaaaaaaaagaaagaaaaaagaaucuuaacaguaauggucagagcauucagaaaaaaaaauucagcugugucacggagucaguuggcuuggcagcuguuacaauaugauacaaaauuuugcagaggcauuuugucuuuggaaaaaucauauaggggacuagguguacaguauuuucaccacugcaguuagaaauguuuacaguuguaccugauagcuccaguugaauaaagcuguuacgcuggaugauauugauaacagugcuuaaacuucuuuuucaauucuugaagguggccauucccaucgaggacguuaaccgcagucaccuucgguuuaccuuccgccacaggucaucacaggacugugaguagucaagcacuuucuucccccaaguauuuuuaagggagaacugggggaaagcgcgagaggccacucucaguuguucuggaacucgcuaucauaacacaauaaggcucauuucccaccggaaccuauuccuuggaaacauucuucucucuuuuccuugagcagaucucaggaggagaucuuaauuuccuucuccaguuccuccuacccaguguugcugguccccuucuuucuuuugcuuuccagucuuccguguugacuugccauccauccaugccauccaucagaaaaguuacugagcuguaacaaauaccucucaaacaugggcucuuaaggugccugucuuagaauuggaaaucuugaacccuuuuugucuuccuugguggcccuugcugucuggagcucagggauggcuuuucucauagacauuuuugugaauacugaccauggugccaagacuuuaggaggaaagaacugcuauuugaaucacucuccuucaaaaagaauuuauuauugaugacugaaauuuguuccaucacauuuuguuaaauuaauugucaacuaaagcuguagcccugugcuagacaguaagauaucacagaaggaaaacaugauucccgucuuucagggugugugucucuuuggcauugggaacugagacauauucauauuugggacaauaaaugacaaagagaguuggcuacaggcuugugugccgcaggcaguuaaaggaaaagagugguguggagggcagaccgcccuuugucacugaugaccccgugggggucacaccgugcagugggcaguuucagguucugugugcucuggauggagcuuaagcaugagccucuucuguaucuucauuugaggauaagaauaccuuucuggcuggugccguggcucacaccuguaaucccagaacuuugggaagccaagguggaagauugcuugagccccggaguuugagaccagcuugggcaacacagugagacccgaucuuuacuaaaacaguuauccuggugugaugguauaccuguagucucagcugcucaggaggcugaggcaggaggauugcuugaacccgggaggcagagguugcagugagcugugauugcaccacugcacuucagccuggggaacagagugagacccugucucaaaaacaaaaagcaaaacaaaaaaaacauuaaaccuuccuccuaggguauucuugaaggucaggcaagguggaggcuggccaccuucuggcacgcugccugguauggauaggggcuccauuguaguugcugcugcuggaauaauguguucauucaccugacuauuucuggggccuggccugcccugggcccuccauguggggugggugugccuggacaggggggcugcaggagagcagccuggagagcaaaugcacgagcacggucaugauguuauggugugcagaucaucgagaagcuugggccugcuguuguucaggggaguuggagaggccugguguguggucugcagagcuggggugccggcccaugacugucaauggcagaugugugugugguggggcccggccugggauguggcugacuggagggguuucaagcagcauggagugccuggugguggguggugcauggcgggggagugcggggggugggugguggcuggcagcugccgaaagcaucauugcauuccuguccugucccaacagugcaugcaggccagggguucaguuacaagggcaucagguuuaugucuaacgggagaagcaggggcaggaaggccgccagcuuggaaggcaguucccugccaucucauccuugccccaggaucagauccaggcuaccagaccccagaccaagucggaucugcuaauggugcacaacauccuugguggccgaagcuguaggauaauaacaacuaucagcagauguuggccaucguucacuaugcucuuaucaugugcccgacacaagaaguuuauuguguuauuuggauucguccucgcaagauucccaugugguaucaguauuauuacuucccacauuacagaugaggaaacuggggcuuggaaaccccaggucaggggcugaaaggcacccagguagucaguggaagagcuuugguucuaagccagguccuugugcccgagccuuaugcuccaaugccuugggggaguggcgaggccacuucuuuccuuuggcuuuuauugaguuccugcuguauacacaacaagcugcugggguuucuccucuugcagagcuuagguuugaguugagguuugagauuaguuugcaagaaccagcuagggcguggcagccugugaguaucacaugaauuaggcagagguaugaugugagcggagggugcugguggaauggggguggcugugggcacagguguguccucgaccaaggcauggagggcauggugggggccagccuagugggcugcagugugccccagacccucuagggcuccacgcauauaucaccuugaggcccacggaggaagcagguuaagaacgggguucuggaauccacagaggacucgucucaaaauuacgcucccgucuuuuaacaagcucauucucucuaauuaauaaauuacacuagggcagagcgauagcuccuguagcauuuuaauuuucaaaauccuuguuuuucuugucaguuuuaaguacucauuauagacaagaugcuaucacccaacauaccaggacacaucugcauaauaaaugaagucuccguggccacagcuugugggauuuuggaaacauguugagcaucgcaggugcgaugccgaugaaagccuggaugucggccgcugaccauggccuucggggccuccccagccagcccugcaugcagauaccuggggcagaaacagguagaaagagcugaggccacauugguccccacuugcuacccugaagaggaggcuagcaaagggaacaagugaugggauuucucaccugggaucugaccuugggauuggaaaguuuggugucgauggguuaacauaauaccuuuccagcaaccugucggcaacuccagcugcaccagaccgugugguccacggagccaggcagacuugcagcucucaggcccagcuggccaggagcugaguuuuccuugauuguagugggcuuguuggguagggcggccuagagaaugggcagcucuacccacacuccagaacacacaaccccuacugcuguuccuaagguucuguaaacuugucauauaaaccauccaucucaugauggcugcuagugagcaugcaguaaaaagcgguccauuccucggaugugaagaugcagaauguuaauaaaaggugcacuuacuguacuacuuacugguagggucaguagaagccuucugcugaccauuauugucacacauccuucugaacccuggcuguuuuccuggaggcaugucuuuuuuguugccguuguuuccaaguccacccaaacuuaggaggaacuguucuguucuuugccauuugaacauugaaauauuucaugugcucuggugcccuuuuacagaguuauuuuuuuagaauccuaggguacauauauuuuacuucuguuucuuccuguguuuuuuggcugguugauuauucauggaaccauuuaauuugccaggauguauugagcacaaccaggaaggcaaaggugauaagccauguugucuuggguagugggauccgacgguaaauauuuugagccguggacucaaggcggguggaugugucauucucccucucugaucucuguccuuucaucuauaaagagaaagcucggaaucuguaauuguagagauaguuuccagcucugguccucuguuucugugcucugcugggauugcaacuugaggaauuucuggcagauccauuucuucaguccauguuccucaucuguccuggcuuaucaguccuuccccgccuuuggcccucgcugucugucaccagccacacuggacuucuguccccagaugugccacacugguccucgugagggccucugcgcuaggucccccucuuccugcagcauugacaucuuggcuuaugugcuguccagcuucucagagagaugucuucugacuaauaaauuggauuguccccguugucacugugaccccuuaagaaaccacaauguuuuguuuucuauaucaucugaaagcucauuuguuuguugacugucucccaaaguggcacaaauauggauugaguaccuguugggcaccaggcucuauuucauguacuaggaaauggcaguaaaacaaaaggucacuuacauuccagggucuaguggaugaaaccaacaauaaauagcaacaagaucaacaagauucucuaucaaucuaucucuaucucugucucugucucugucucugucucuaucucuaucucugucucucugucacacacacacauaaacacaacaucugguagugauaagaauuaucacgaaaauaaaucaggugagaggaaagagggugauugggugacuaaugggcuauuuuagacaagauauggucacuuuggaggaggugacauuuuggcagaaacuugaaugaagcgagugagccccacaugcagauaccugggggaugaacuuucucgccaaaggcagcacaauuucacauuggggucguuaguccauugguaauucacaugauggauauugcaaggcaggaauugauuuuaguuuucuguauugacccgcaguuuccuugguggaauggucugccccuucccagccucugucguuuacuguggccucuuguuuccaggcccuguugauuuccgcuggucugggcgucuuagguugaaagcacacagucuuucucauugucauuuuacaguuacucucgcuuucuaguguugcgggcuuuccucugccuucuucaagaccaugcugcucuucuuggcccuuuauccuggaauccguuuucacguuccaggaaaaaucucuucuaugagauuuugauuagaauggcuuugaauuuauagauuaauuugagaacaacugaucccuuuaugcuaggagucuucuuacuuguaaacgugguccauuuuuccauauauuuauuagauuagcuuuaauaccuguuuguauaauuuuguaauuguuuucauaaagguagccuuuguagcuucuuauaauguuauuuugucaugauaauugaaagcaaucaucaauuuuuuuguuuuuuguuuuacagcuaaggauaaaucugagaaaauauuugcacuagcauuugucaagcugaugagauacgaugguaccacccugcgagacggagagcacgaucuuaucgucuauaagguaucugguugcauuggugcaauauugcugcuauagacaguuucagucuuuucugggcucccugaccuggaccaaccuuucccaucauugugaggaagcugcuaucuagcuacauuuaauuaugcaaaugaacauuuccaaugaccagcccuuuuguuguuccuaacgggaaaagaugauauacaauauaacaauaggugccaucuaaaaaugccgugaacaugaauuaugcugcaguaauaagggaaauuauuaaaauguguauuuaauaugauacaaagcaauuacgaugguuacaaggauuagggauaacaaaggguggcaaaaaugguguguugcuguuugugaauugccuuugacauacggcaugacuaaauccacaggccgaagcaaagaagcuggaagaugcugccacguacuugagucugcccuccacgaaggcagaguuggaagaaaagggccacucggccaccggcaagagcaugcagagccuugggagcugcaccauuagcaaggacuccuuccagaucuccacgcucgugugcuccaccaaacugacucagaacggugcguucgagaggagaaacacacucaccccaggagcucugccccaguccugucuuuuccaugcuccuuccuauguggaggugugcuccguaggugcaugaacgucacccauaaggcauucauugcaucgggcugugaugauuuaucaaugcauagaagguggcauuuguucauuuguuguaauuuaaaauucacacuucuacucuggucuaaggguuauucuuuuauuuuuauuuuuauuuuuuaagacaaggucucagucucgcucuguugcccaggcuggagugcaguggugugaucucaacucacuccagccuuguccuccuaggcucaggcgauccucccaccucagcuucccauguagcugggaccacaggugugcagcaucacgcuuggcuaauuuuauuuuuauuuuuuauagagaugaggucucacuuuauugcccaggcuauucccaaacuccuggguucaggcaaaccucccgccucggucucccagagugcugggauuacaggcacgagccacugugcccagcuguauuacucuuaaagggagauaaagcaauggauuuacuucuuaaaaugauuuuuggccaaaggaagguagcgugacauaaaggaaagugcacaagauuuggagucagacuaaaaaccuggaaucggaccauagcccuguguuaacccuggggaugcccuucaacaagucuucugcacauuucugggucuuaucuuccuugucugucgauacgggaauagugccugccucaaagggcuuagugaggguuacaugaacagugggcugggagcucaccucccucuuuaugucuuccccauucucagcuacucucugagauaauuacuaguuaucuuuauuuuuaaaagcugguuuggauguuacuuucuagcccuacucgugcugugggauaaggcacccccugcugacucccacaccccaaagcucagcccuaauguggcagaucacucauccaucagcuggugccgugcccuugugugggguuuggccgaugcuuugagugccugcaccaccacugcuugcagccucuccagugacauugcuguccagccagggguacuucuuauucagagcacacugauguuguugcugucacuccgucuggaagaggcagaaauccuacauuuaaaaauugaaucuuccaaaugcagccguaucacagcugugcagagugacuuuaugcucucuugaagcagagcuugaaaauccaauuuuuuccucuuaacugcccgauacagauuuugauuauuacugucuguugcuaucaugaguugugucucugggggauuguccguaaaucauggcaguaguuuuggauuugcccaagggacagucaucguuuggacuuuaauaggauaaacacaggacaaaaguaaagccauugucuggaagucaggacauuguaguggagcgugcacugagugugcugcauguuugggcaugcgagcccugggucaaaugcuuuuggaucuuuccguuucugcacuuugcacucuguuguucugggcuacacuuucccacugcuggucugcugaguaaacugcuuggugugggagcaguaagucucuuaagugccuuaagccuacuggggcacuuuuauauuccauuugcaugcauuucucgaaccauuuaugaaggguccuagcuugugguuguguaguggucuccaugagcauaugaaaagccuuaccugggugugggaucuaugcagccgugcaguggggaagggagagaaugcacagggagccugcuaguggcaugcccgaggcaugugcaguguauuugucccuguucaugcugcugauaaagacauaccugagacugggcaauuuacaaaagagagagguuuaauguacaguucugugugacuggggaugccucacaauugugguggaaggcaaggaggagcaagucacaucuuacguggauggccgcaggcagagagagagagaaagagagagagagagcuugugcaggggaacuucucuuuuuaaaaccaucagaucucaugagucuuaucacucucaugagaacagcacaggaaagaccugcccccaugauucaauuaccucccaccaggucccucccacaacacgugggaauucaagauaagaucuggguguggacauagccaaaccauaucauguggucagcagugcggggcucaacuugggacuugguuauggaaaggaugcuccccugugacauguuagucucuggauguggccuugauagcuccacucgccugacagaugacagcauccagagccuaauuuaacccaaaggugacaucuccaggugggccacacuuuagcauuucaguaggugccauguguugcagugcucauggugcaggaagccaucaucucauaauugggucauguuccgaaagcaugcucggaagucauuacuuaacuugcucaucuuuccccauucaaagcaaugcucugagcugcgguuaggugaugaggcccauccacagaauccuucuuaacccuuaugacccuggagaaaggggacuguggaccaggacauccccccgggggguggggucaguggcaaucccuccuuucacccucaagcuccuuaagucucaccagcugcagaguaauccccuccccagacugagggagagggcacccugcucucagcagcagcuguugccaggcaacaaggaaauuccgaugugaugccacucaccaggacugaugggaagucugccuuucauuucucaccagccacgguuccccuucuugggauuguggcaugucagguguguacaagauggagcugccccaaauggcgucuaagcaucaacucccacauucucauuugagggaaucauuuuucugaaaccaugauuuguuccugcgaaguuccauuacuuagggaaacgcaguggcugaauuauucauugagguugguauuaaacuucucuguccucagcauuaugcuagaugcugugggggauaugaaagaaguacaagaugugauuccucuucucaauuaacugacuauauaauuagaaaggagucaugaauaugggcugugagucccgguaauaagggccuggggugggacucaucugccuugggcagccucaugggggcuggacaagcccuguuuucuuccagcacucccuuugcuccaagguguuuuacuacucauuagcccaauuggacuuugucucaaacuuacaauacagcgugccaccaacuuugaaugaaggggauccagauuauuacugucuauuaaggaaauacugguaauucuugugagauggaaaucucccuuaacccuaggaccaagagugugucugggcaggauggagccuuuuccauuacuucacuuucacuuagaaaugaagacauguugcccaggugcaguggcucacaucuguaaucccagcacuuugggaggcugaggcgugagguucacaugagcccaggagguuaagaccagccugggcaacauggcgagucccugucucuacuaaaaauuagcugugcaugguggcgugcaccuguagccccagcaacuugggaggcuguggugggaggauugcuugagccugggaguuagaggcugcauugagcugugguugugcuccugcaccccagccuguaugacagagugagacccugucucaaaaauaaauaaauaaauaaauaaauaaauaaauaaauaaauaaaaaagaguagagugcucaauucgucauccucuccugggaugacugcugccauuugugcuuuggacuaggcauucugcuaagugcuuucuacacgucaugucaguuaauucuuacaaccaccuugugaaucaggcaacacuguacccaugguucagaugagaacacugaggugaaguuaccuccccaggccaagugguugcugcaugcuggugguuaggcccacacuugggcgucuuccacgggaucuuugggugcuccuuuuuugucucccuauuuuuaacucuucccuuugucagcuguacuuguuuuggagcuuauugccugcaugccuuuuguacaauuugaugcugaaguuauaauggaugucuguauuuccugauuuucuaccuauagucacaauuagaguuuguuuuuuuuuucuucuucaguauuaacuagaguuuuguuuuuugauucuuucuuuuauggagacaguuucuguagcugaaguugguucaugagcauaacgguaaauuagauguacuuuguuaaugguauuuuuucgaguaaugggauguuaauauaacuucaggugaaacuuggguaggcauauguacuuuccuagagagcuuuuggauccugacuucuuaccuuaaagaauaucuugggccaggcaugguggcucacacuuguaaucccagcacuuugggaggcugaggcagguggaucaccugcgaucaggaguucgagaucagccuggccaacauggugaaauccugucuccacuaaaacuacaaaaaaaauuagcugggugugguggcgggcgccuguaaucuuagcuacuucggaggcugaggcaggaaaaucucuugaacccaggaggcggagguugcagugagcugagauugcgccauugcacuccagccugggcagcaagagcgaaacgccaucucaaggaaaaaaaaaaaaaaaagaaaaagaauaucuugaugccuuaaacaaaaacauuucuggacacugucuucuuccacauugacucuuuaaaaaccaguauauucauuccuugcuuuuucuauauaaaaugcaacaaacaaaaacacaaccauaacaaccacaaacuucuguggaagcccagacauggugagggccggaagcucacucagugcaggcgugaaccucagugcaggcguggucucaguuguccagagcuacuguagcuguggggacucuuaaccuugcagucucaguacuuuaauuuguguuaguuauuuuauuuauauuaucuauaaaaaaauagcagcuuguucuugagcaggagaaacaaaccauuugguauccagugccugggcagcgcuuucugggugagcaggccucuucaggccuuguggugcucugaaacugccuuccuguagaauggaaagacaaguucuuuuuuaguuucccaaaugcacuuuuaaagcuucuacauggaaaucauuucaugguaaaugucguugggaauaaugaauucaaguguacuagguguuaaguauguugcuacaaaggaauggaauauuuagcaggugaaucuuuuaaaauaggguugauuucucuguucacaaaauuuuauagagaaccucacauaaugcaugauuaacagagacagaacagaguuucuugcuugugaagaucugauugucauuuucuguuuccaguggaccuucuggggcucuugaaauggcgcuccaacaccagccugcugcagcagaacuugaggcagcugaugaaagucgaugguggugaaguagugaagguaacauggagcccaaagggacuuuuugggucuuuuuuuuuuuuuuuuuuuaauguauguuaacagaaguaggcagugacuucaaagguaguauaggauugugguuauacucccuuuaaaaaauagugacauagggauugggugcgguggcuuacgccuguaaucucagcacuuugggaggccgagguggguggaucaccugaggucaggaguucaagaccacccugaccaacauggagaaaccccgucucuacuaaaaauacaaaauuagccgggugugguggcgcaugccuguaaucccagcuacucgggaggcugaggcaggagaauugcuugaacccaggaggcggagguugcagugaguugagaucgcaccauugcacuccagccugggcaacaagagcaaaacuccgucucaaaaaaacaaaacaaaaaaauagugacauacaccucuaggugcacagagugcuucuuggcuucugguuuggggggacucucuggguuagccgugaaggggacuggcuuugcaaucaaccucaucguggguucugcguccucuucccauagguccucacuacaggacucacaacaguucagugaccucuuuaagccucucuuuccccugccaugagaagugggguaacaguagugccuucugcagggucguuguggagccucaggucuuuuuacuguugucaugauccuuguuacugccaucagcauucguacuagacucccugagauccccuuuaagugaccaggagaggucuguggugugguagaaagaucacgacacugagaggcuugccugggccgucuucuucccacgggacgcucugcagcagugucggguauaauuauucauucagacccuuguggccucagcaucuuuaucugugagagagggcagucagauuacauggccggagguccugggagcacucagcuucuggaauucuuuacucuguaauuguuugugguucugauguuuucugcaguauuaggcucuucucugcucucagauaccccacaauuugcuggggcaacuuuuccuuguacgugaggaagcgaauuuccauuuuuagucgauucuguuuuuggcuaugggacgauaagggggucacuggcauguggcguucuauaagcauagacucuccagcaaggucuguguguugccgccucaguuccucacucucuaggagaggugauugcagaaagagacgaccuuaucucuguaaaaacuaauuacuuaaaauggccuuaauuaaccagcagugugcuucacuucaguaucaauuaauuuggucgcaccaguuuccugaaucguauaacucuucagacauauacucacuaaucuuaaaauuuuaaucaucuucucaguccugguguucucccaauggcuuggacaauguuaauugcauuuuaaacuucccuguguucuguaaauucccuaauucagguggaaacuaggugaaauacaugaacguaguugagaagaauccaguuaaugaaauuuuguccucuuucauuuugaagucccuguaucauauuaggaaugaguuguauuucuggcgaccaguuaccacaguuaccuggaagaauguagaaugaucuugucccgucauucucccccauuccccucaucucauagauucucacauuugauuauucaucccuagacauggccuuuacaccuuuccuuucuuccugugcgugcugguaccacgcaagccugggugaccuguccagcccuuaccuaccuugccuaacuuugugcuuuuucucugcuggcgugucugacaugcgccgugagccuagagaguggaacugacuugaggccacggggcuguuaauggccagccaggacuugaggaauuccugccugcacggggcuccuuuugcugauagggaugcugauagauuguggguuugguuccauuuauucaggaccucccuucugaguauugaugacugauagcagagagauggcauugcuugguagauugaggaagguauuuguguauuuagcaaaagauacgcugucccauuagauggaaaauggaaauggugacuuuggugcccuugaacauggucuuagagagaggguggggugccagaugaagcccuuucauggcuccgugugaaggcccuccuucaggugcucgccccugccccacugcagcuccgcagcccaauacgugcagcuccaucucccugugguucuguuucugugccacugaccaugucaugugucugggugggaccagguggucuacuucagggacuuugcaugaaccgugacaggccagguccugccaccugggagccuguuggcagggaaauauucggcuguuagcagauggcaucaaguuuugaccuucgcaaagaaucuacauucugaaaaugaugggaaauggugcaaaaguaacaaagugguacagauccacauaguuaggaguugauuaaucccuugacauccagaccagcaugccuuuuggucagguugguuuuguuucccacuguuugcaugugacauuuucugguauaaaguaagugguggcuggcacagccaagcauggagaggauuuuacuccuuaaagggucucugaucucaugcugggcaugcugggcguccucucucccaaaggaaacggaugaggcucaugcugggcaugcuggacauccucucucccgaaggaggcgggcgaggcuguugcugcugcugugguuccacagcacuccuuugcgagcaggaguuugugguuugcuucuuuaaucuuggggcuauagcaguuugagaucuuccaugccaucccaaaagcccccuggguguugggaagaggcugcacaguccaggaggaaucugaaccaaacaccugacccagccuuuccucugauguccuugcugugugaucaccucacccauuuauuuuuauuuuucuuuaaauuacaguuucauugagauauaauucacauaccaaaaaauucauccuuuuacucugaaguuuuuagugucuucauggaguuguacaacuauuaccacugucuaauuucagaacacuuucaucaucccaaaagaaaccacauagcuauuaguagucacuuucuccucuuccuguaaccacuaaucugcuuccugucucgauggauuuaccuguucuggauauuuuauguaaauugaaucauacgcccuguggccuuuugugucuggcuucucucacuuagccuugugucuucaagguuuauucaugccguagugacuaucagugcuucacaccuuuuuuuguuuugagaugaaguugugcucuuguuggccaggcuggagugcaaaggcgcaaucucaggaucuuggcucaccacaaccuccaccucccagguucaacugauucuccugccucagccucccaaguagcugggauuacaagcgugugccaccaugcccggcuaguuuuguauuuuuaguagagauggggguuucuccauguuggucaggcuggucucgaacucccgaccucaggugauccggccuccucagccucccaaagugcugagauuacagaugugagccacugcaccuggccugcuuuuaugccuuuuuauggccgauaacauuccaucacauggauagaccgcagauugucuuuccauucauuaguugacacacauuuguauugauucugcuuuuuuggagaugaugaauaauauuuguguacaaguuauuuugugaacauauguuuccuuucuuuuggagagauggccaggaaugaaacuguugacucauaugguaaaucuguguuuaaguuuuugaggaauugucaaacaguuuuucauagcaauugcacaauuguacauuucuaccagcagugugcaaggucuccaauuucucugcguucuugcccacuucuuauuagucaucuuaaauuguagcccagauagugggugugaagugauagcucaugaugguuucccuuuguaugucccuaaugaguaaucaugauagaucaguacuucaucauguuuauggccaguauuucguuguguggcguucugccucuucuugaccuucucuucuaauacgaaucaucacuuccaacaccgugaucuucaguccgucuuacauuuccugcaggggaggauggggugggacuugaagcugacuuguagugugacaugccuuugaagucucuuccuaauuacauguaugaugcuuuguccuucuuugcaguaguauuuauuugguaaauuuuagucaacuguaacuguaauuucgacauuguuguugaauaaaguaagcaccuucuggucucaaaacugggauacugcuguguauuccaguuucagaaucacgauccucuuccaugccugggcacccugguugguagaagguccuuccuuccacucagcuggguccugucccuguguggcuucugcccauucacuagcugaaguccuguacccaguguguagaaugagugagaugcaucuucccagaguugccauucagcgcuuugucaccagccuuaugaaaaccggaaagaggguuggaaaggcccccugggggaagcaguaggcccucuccuugcuuugacccucuccauuuaacacugguggcauuucuuuguucugaauucgcucauccaaaauuuuugucuuguguaucuaguggcugaaaaggaucccgaauggcuuuauagguagugcugggggcaaaguggguauuuggaguacugcagagaugauaguuauuccagugugugggggaaguccgguggguucacauugucacccgaccuucugugucuaugcaguuucuucaggacacguuggaugcccucuucaacaucaugauggagaacucagagagugagacuuuugacacguuagucuuugaugcucugguaagagagcuuuccuucucauaugcuuggauaacacagcguucuuccaugcugcagcgucugaggcuggagucgggggcuucgucacagugaccuugaacgcauuuucaguuguaaauccaaucagagaugaauugggguggcagauuuuuuuucucuuuuuuuuaaauguaaaacuguaguuaggcaaaugucauuucuaggguaagaaaagguaaacuagccaccaacuucuaucugaaaauguuaugguucauauccuaacacaggggugcagaugguucugaugaagauuauaaaauggcuuacauuauguugcuaaugaaaauauuauugauuaauuugacagguauuuaucauuggacugauugcugauagaaaauuucagcauuuuaauccuguuuuggaaacuuacauuaagaaacacuuuagugcaacguuagccuacacguaaguuccuacuuuguuuuaaaaccaauacuucuuuuuuugguauuuguguuauuuagagucuuuuucauguacuuuugucuaugacuguguauuuacuccugcucaaaacucugaguuuacuggaauaauuuuuaguauuguuucccucuuaacauaccuaaaaaccuuguugaaagagauaugugauaaaucaucguaauauucuggaauaaauucuuguucucccucacaccuuccauuuaucuuugaaaucuucacuuuauguucgaugaaacugagcuuuggaugcggagugucugacaccgcggcuuccucgcgagccuuugaugaauggauaaaugcauguguucccguguuaaggagauugguuguuuagugugaauuagaugcaguuuuguacuuugcaauguaucuccuugcucuuuaaagagcaccuucccuuuucuuugacaagcuucagcugucacugucuuggauuccuucuauccaccccucugcccgucugugccccagaggucuaggaagacaccagaggcuaugcauggugccugggccagcuuagcagugugccugguauugaagagcagagcccuggagucuggagucaggcugccugggcuugaugugcagcucugucccucacaagcucugugaucuugggcaaguugcuuaaccucucuguaccucagccuucuugucuguaaucagagcaugauuguaggcuuguguggaaauuuuaauaaguuauuacguguagagugcuuggacuaaucccuggcacuuagaaagcacuaagcaauuauuggguuucauuaucauuagauuuauuaugaugacuuaccggcucuuucuugguggaauuuauuggcauuuauucagacuuuuuauugugugaguuacagcaaaacauaaagauuuacauaauuucuuuaagaacaucccgcuuagaaucaguagaaaggauucuuuuuagugugaguaaauuuaguuaaaacucccuucugugucuucaacauacuuugcaaaauaccuguuuuuccucccugugugcagucaugaacucaggucagaggacucuggccuccugaagccagcuguuaauauacccugguccugcaccuggauucuuucauaucugccucgugugcguguuuacuguaaggugguggguggagcuccaggaaggcuaagagcugugagguccucaagccugcggaacaagcugugacuaguucuuugcacuugcuugcuaauaaacguuuguuuaaaacauuuuguucgcugaguggagaugcccagugugugggcaugucgaguaguuccuuacagaccguggggagggugcauugcagggcacuuuuccuggcucuugugaccaaaacaggagcuugugggguuugcggaaguggccuguggacugcagcaaacguagcacggccuccacgugugcucauuuucaaaauucugccuuuugauugaaauguggccaaagaacucuucucagauuaggcuccgugcuugaauuucagaagaugagaggcaugaaucagcuuaccacacugcagccacaucucuucauuggcgccagccuuuccaugcugugcuguuggggaaggagugaugcagccauucucauagguggagaaagaaaaaugggagauuuugaugaguuuccuaaugagacaaacaaaaaguaccauuuuuucuuuaugcugugaugggacugagauaagaauaguauccucauggccggguggaguggcucacaccuguaaucccagcacuuuggaaggccgagguggguggaucccaugaggccaggaguuggagaccagucuggccaacauggagaaacccccaucucuacuaaaaaugcaaaaauuagcugcgcgugguggcacgugccuguagucccagcuacuugggaggcugaggcaggagaaucacuugaacccgggaggcggagguugcagugagccgagaucgugccauugcacuccagccugggcuacagaucaagacucugucucaauaaaaaaaaaaaaaaaaaaaaaaaaaggauccugucauucaaucuauggaaucugcugaaaaagaaauuuuuauuguggaaaauaaguauuguuagcauguuuugguaaacuggcaaccucacgugguuccucagcagccugaauuugcaugucugcaccuugaaauuccaaaggagucaguggcgacugagauagcucugaccacaucauggaaggucgccuccgcauuggugauaugcuuacaguauucucugggccaggcgaaauuccaguaauauuaucccagaguguccuuguccucuucuccucuagaaggcuuugguagguacaggcuuacuuuagacucuuguccauguagccucucuccuuugguaaauguugagaucuuuagcccuucuucccaacaacaccaagagaaggaaugaaagauuuuggcaaugggcaguccucuuccgcaccucgagcugugucugcggcuccccugcguggguaguucauggaugcuggagccccacuggacugaccagcacugguacaagugagaaugaagggaggcaucggcuuugggggcugcucuuccauaaaaccagcaugacugggcuccuuuuuguccacccuauggagcugcugcaggcuccucacuggcaacugaugcuccaucugcuccgcccccucuagccagugccaagggguugcuuuuugugcagguauaagauggccuggcagauuuauuuuuauuuauuuucuuuuugcugucuaauuccagguuaagauucauuugcugguucuagguccuucuuuuauuuauuuucuuucuuuuugcugucuaauuccagguuaagauacauuuguugguucuaaguccuucucuuugcaaaucauuauuauuuuucuuuuuuuaauugguuugaagaauucccaaaauguguucuauggaauguuuauucccugggauauuaauauauguaauaagaggugcgugguccaguaaguuugggaaaauaaguaaaacugagugaagcaggcuucaugccaggguguugcaugcucucuugugcagugagcaccacccgcagaggccuauauggcaagguguguuuuccagccaauggagauggacaccguagcaggaggaucugcagacuucgccucuucagaacagcgagcaggagugugacucugagagcaucagggcucccuacuagagcucuggugccugaucgguguuagaaauggcuucacauccacucagucucccaaaaagcuuuucaggccaugcaugguggcucacaccuguaauccuugcacuuugggaggcugaggugggcggaucauuugaggucaggaguucaauaccagccuggccaacauggugaaaccccaucccuacuaaaaaauaaaacccaaaaaguuagccuugugugguggcaggugccuguaaucccagcuaaucagaaggcugagguaggagaaucgcuugaaccugggaggcagagguugcagugagcagagaucacagcacugcacuccagccugggcagagcgacacuacgucucaaaaaaaaaaaaaaaaaaaaaaagauuuucauugugauguauugguaaaauagguacucuuagcucauccauaauugcagugaagguugcucuucugagugucuuauuccauaaccugagugagcagucuggccuuuacuggcucacaacugaaccagacaugcugucaguaccccagcagauugcuuuuaugaacauaaaaaucuuucauguggcuuuuaaaaagccucagugaauuuuguuggaugcguaagauguuggugacuggagaaguuuggguggcggauauucuuccuggugucuuacuggcugcacgcauggugcuaguuuuuggagaguugcagugcagcucaguacauuaaaaaaugaccguguguuguuguuaauucaguuguucuuuuauuauguguaagcuauugcuugagggucauccuuaugaacaagauuauuauuugaugagucaguaaugguugaaaguguagaaguguggauagaauuaaaaauggcagauccucacuacugccucuaucauuuaaaaauaacacaugcucaacggauaaaaaauaguaaagaaaucucacauuacucaaauguuauagugcagacgauaaaaguucccuuguauauaaugcuacauauuggagauaucuacugugccagcauuuauuuucuauguuuauauuaacauuguuauuaagauuaugacuaauaugucugcauauuuuacaaaacagcauuguuauuuuugcuugcuuaaaauuuaaaaacuuaaaaauuguuauaauuugcauacaacaaaaugcucauuuuaauuuuguuuggacgguuuuuguauacccuuggaacuacugcccaaaacaagacauaagacauugccauuccccacaaacaucccucuuggccuaucugagcccaucccacucccagacaagcagccacucugugguuucuguuaggaauguguuuugccuguucuuaaacuuuacaccaguggggucaugcacucuuuuuguaucuggcuucuucccuuccacauaauucucuugagauucaugcauguugcuuugugcaucauuaaauauuugauuuugcuccucucuauuucugagcaguauuuuauuguaugaauauuucaugauuuguuuagccauuuucuuguugauggauacaugaaguguuucuaguuuuuggcuauuccgaauaaggcugcgaugaauauucuuguccaagucuuuggugaaguuuguuuuuguuucccuuggauaagcaccuagcgguagaauugccgggcuaaaggauacguguauaguuuucuuuguaagauauugcgagacaguucuccaaaaggguuguaccauauugcauucccaccagcaaucugugaauguucuuuugcucuguauccucaucaacauuuaguagugucugacuuuguagcuauuguacugggggcaaaauuauaucucuuggugauuuuaauuugcaguuacuggauaacugaugauacugaguaccuguuuauuuuauuuugauuugccauuugugaaaugucuguucaaaucucuuuuucauuuuauauuuuguugucuguuucuuauugauguuuaugguauguguguguauguguuuguguguuuauacacauaaauauauguauuuuuuuuugucagacaugauuuuugaacauuuucuuccugccucuguuuaucccuuuucuuaauggugucuuucgaugagcagaaaucuuuuauuuuguugaagccuaaaucaucauuuaaaaaaacagauagggauuuucauuuuguggcuaaacaaucuuugccuagccaaaggucuuaacaaugccugcacugucuaaugucacagcacuagccucguguggcuauuuaaauaaaauuaaacuaaacaauuacuuccgcaguugugccagguguguuucaagugcugagccagguuggacagcucagaaacagguuuccaucacuguagaaaguucuguugggcaucacuguuucagaagcuuuaugcuuuaugcuuuugacagaauucagcaucuguuuaugauaaaaccucuuggcaaacuaggaauagaugggaaguuccuugaucugauaaagcucaucuacgaaaagucauagcuaaccuuauacauaaugcuggaacauggaaagcuuuuccuguaaguucaggaacaaacguggcugucucuucuuacuauaucuguuuauuauugcgcuggaaguaguaaagcaagaagaaauaaaugcggguauaacaauuggaaagaaaaacuguauuuucacguugauuuuguauauaaaaagcccuccugaaucuauuuuauaauuuauuuuaaaacaaacauaaaaggaaacuucaauuguauauauacacauaauugagagggaauuaaaaguacaguagaauuacaguaugguacaguacaguacacuuuagggucuuaucaaaaagucauaggccgggcaugguggcucaugccuauaaucccaacacuuugggagggaggccuagguggguggaucaguugaguucaggaguuugagaccagccugaccaacauggugaaaccccaucucuacugaaaauacaaaaauucgccaagugugguggugggcaccuguaaucccagcuacuugggaggcugaggcaguagaaucucgugaacuugggagggagagguugcagugagccacgaucacgcuacugcacgccagccugagugacagagugagacucugucucaaaaauaaauaaauaaaauaaugagggauaaauuuacugguagaugacugaaaauugcaaaauuugcuaagagaaauauaaaaaguaaauaauuugauaauauauaccauguucauguauugaaaaauaaaauauugcuugaauguuuauuucaaauuauaguuugaacacagucucaaugaaaauucuguaugcuuuugugaaaaaaaaauggacuaauuugaauauuuauacuuucaaaaagucuaaaauaccgaaauaauauuuuagaagaucaaaauuucaagauuuauuauuaaacaucaguaaccaagauagcaugguauuggcauaaggacagacaaaaaguucagaaggagagaauauaaaauacagaacagauucacaauagaccuucgauuuuguaacugcuguuuucuuuuaacagcauaaugacaaaacuggccucuuuuuuuuuuuuuuuuuuuuuuuacuauagugaugagggagugcccaccuaguguauugaacugcugugcaguauuucauuguagggauguauuaccauuuauugaaccggcucucagagguugggcauuugcauuguuuauguauuuuuacuagucagaucaugcggcaguaaacaucauuugauucauuuguaauuguuucuguaggacaguuacuagaguuggaauuccuggugucaaaggauuugaauauccuuaauuauaauagauauuuccaauauaauagauauuuccaauauccuuaauuauaauagauauuuccaaauauaacagauauuuccuuaauuauaauagauauuucuuaauuauaauagauuuuccaacuauuauauauaauagauauuuccaauagauauuauaauacauauugccacuuuacccucuaaaaaauuuuuaugcccugcugggugcaguggcucacaccgguaaucccagcacuuggggaggcugagguggguggaucacgaggucaggaguucgagaccagccuggccaauauggugaaacccugucucuacuaaaaauacaaaacuuagcugggcgugguggugugcaucuguagcugugugggaggcugaggcaggagaaucgcuggaaccugggagguggagguuucagugagcugagaucgugccacugcacucccgccugggcaacagagcaagacucugucugaaaaaaaaaaaaaaaaguuuuaugcccauuuauccaacagcaguguuaugauaccccaaaguuugucuguacuaggcagaaauuuuauuuaauuuucauguguuuauuaaugaaguugauuaauauauuucuagauuuuaaaaaauuaagcuucucacauucccuaaaacuuugaguagaucuauuaucauuugaacuuucuuguuauuugaauuacaguaaaguaaaaauaauuuaauacauuucccuucaucuuuagcaaggaauuaaaaaaaccuaucuaugaauuaaacacugaaaauauuuaugaagccaugaauuaauauuaagcuccuaauauauaguuuauuuauaccaacugucuauaauuacuucuguaguaggaugaaaaauuuacaaauaauuuuacucaauuuuuguguauuccaaaguguguaaacuuuuuuaucauggaaaagauuuuaaauguuuucauauuaggauguuacuugauuuuagaucccaauuuauaaauaaacagacuaagaguauaguagucauuguguuuuuaaaacuaaauguuuuuggggaaucuuauuaggaaaugucaauauuuuaaaaucuucauguguccacugauaguauucuuacuauucuuauauauuguuuauagucuucucuauaaggauuuuuacaauauuauuaaaaauuuaagacugcuuccuauuugaaagaccauuuguaaauuuuaauuuucgguguaagaacucuaguuuuagaaaaucaacuaaaaugaauaaaagugucugagaugcuuuccaauaacaaauacuguuucaugccuuuaaaaaaauuguuguaaaauacacauaacauaaaauucaccgaaucauuuuauuuuauuuuaugauuuuuugagacaagguuucacucuugucguccaugcuggagugcaguagcgcgaucuuggcucacugcaaccucugcuuccuggacucaagugauucucuugccucagccucuugaguagcuaggacuacagccauaugccauccuacccggcuaauuuuuguauuuuuucuggaggcaggguuucauuuuguuguccaggcuggucucaaacuccugaguugaagugauucaccugccuuggccucccaaagugcugggauuccaggugugagcaagagcaccuggccccuaccuaauaguuuuaaagugcaauguugagaaaaucgucaccacuauccaucagagaguauuuuuggugucaugccuuuaugaaaaaaauuuuugugucucuguuuggcuguaaugaaaaucucuucgauuuuauuguuuaaccuuggggaagcuaguguuuuaccuguggaaguccugguuuccucauccauuaaauaggauaauacugccucauaguguugcugugaaggcuaaguuagauaaugcauuucaccugcuuagaacaacgucuacacuuagaaagggcuuauuaaaugcucagccuuugcucucagagguauuuuaucaggcacauuuacugauuagaaaacguuuuacaggccgugcaguggcuuacgccuaugauccuaacacuuugggaggccaagggggguggauugccugagcucaggaguuugagaccagcccgggcaaauggugagcuccugucucuacuaaaauacaaaaaauuagcugggcgaggcggcgugugccuauaauuccaacuacuugggaggcggaggcaggagaaucacuugagcccggaaggcagagguugcagugagccgagauugcaccauugcacuccauccugggugacagggugaaacugucucaaacaaaaaaaaaaaaaaagagaaaacguuuuacagauauucauauacugauagauggaaaccaaauaaaaguaaccuacuuguauauuuccuuagcaguuaagauuugagauauuuuccuuuccugagcuuauuugugcguguuugcauugugaauaggaaguugacaaaaguguugaagaacuacguggacggugcugagaagccgggaguaaaugagcagcuguacaaagccaugaaagcgcuagaauccaucuucaaguucaucgugcgcuccaggauccuguucaaucagugcguaccuauccccuccaugcccgggcucucagaggacuggcaggagauccuucacuucuuuccuuccccuucucucguccccuuauucuuuccuuucuucuucccccuuuuucccccuugcuuucuaggcugagagagcacuguugauccuggggugagcugcccacucuuuccuuacccgccugggucccugccggugcugaggcgggagcccuguuccuggucugagaugugugccugugagucgagccuuggcuccugaaagcauuggcgaugacgcaggugcaauccugggcgucuacugagggcucagaagcccuuuucaggauaucuuuauauggcaaaaagucccaaaagaaaaacaacaacaaaaauaggccgggcgcaguggcucacgccuguaaucccagcuacuugggaggcugaggcaggagaagggcgugaacccgggaggcggagcuugcagcgagcggagaucgcgccacugcacuccagccugggcgacagagcgagacuccaucucaaaaacaaaauaaauaaauaaaacaacaaugaaaaggcaaaaccaagugaaauugccucacuugggcagacucugggauuuccuccuccucuuuuccucaguagagugauguuucauuucgggagaacucuuccuacauaggguauuuccgugaggaaggauacucaggugcuuuagccuagugacaguuuucacacgcuguguggaugaacuuaugaaugauuuuugagcuuuaaaguaaaucgaaggguuaaaggggaacaaaaaauguauuuauuaccauugaacuguauacuuaaaaugguaaagauggugaauuauauauauguauauuuugccucaauaaaauacauaaauugggauauuuauggcuuauuuuauagagagccuuaauauuguauagauacagaugcagguuaagagcugcgcuaaaaugaggacuuucuaaguuggcccacgccucuucacuguaugauucaaaagaugugaaaaguaaguguguugagggugggguguggaauuucacucccucugcuuguuuuuuugggggauggcuauuuugugggugaccugccaugagugaugucaauggauguuggugguucuacguuguuauuguucuuguugugaguuccacacacagaugggauucaugaaccugugucccucugaauuagcgaauacauuugccuuugaaaagcauggugcccuuguaaccuauuaacgagaauaaggaauugaaagugugggcccacaucagugccuucccguuuccuccucacuguguuuucguuugucugaagcagucguguccagaagaaggacucaggagaagggggaagaauucaaaaucuaaccaugugucuaccaugauaguaauaaggacaaagcaacaaguuauugacuguguguugaccuaucagagucauaaacagggugguaaccacuagugauguguuacuggucagggacuggagugugcuucuguucacucuggcguguccauggucaaaaccacaguccucgugcugccauuuuugcauacaaauauggcauguuugagggcaucaugguuuuguccuugacuuagauauuacacucuuuuauuuugcuuauuauggauaugcaugaccuuugguguggauugaagcuuucccucaaggaucuaaguugugauuuauuuucucuuuguuagggugaaacacagcaugguaagcuagguuauguuuucuuguauuuuaauucuauuucaguaaaguuaauucuaugaaaaugaacuuccuggcccccccugccuugcuguuauauuuuccucacugauuuuaaaucucugauuaugcuaaacccaagucaguacuagggugggaggaugaacuugaaagauguuacagauuuuugucauguuuuauuugaaaaauguuaauuuugugcaguuugugaucaauaugacauugacucaggcauuugaugaucugcauauucucacccgauaacacuggacuuucccuuucauucagagguuuguacuuaaaacgaucgugcauugauaaugguguuucugcuauaguaguaaaugcuauagucuuuuauacaauaaugcugcuuuagaaaagauugaguuacccagguugaccaguagcaaauuauuucucugccucguucuuuaaucucuuucaauuucaaaauacaaauggcacaaaaucuuagauucaugguccauaauuuuuuuuuucguuugaucagucuaauagugcuuaggaauaugauuggcugcauguaauagaaaaacaccauuuaugugacuuaaccauaugggguucacuuuuuuuuuuuagucacauaaugugcagcccggaggaagaguuccgaguucaugcaccugcgugaggacucagcguccugauguccuuggcuccuuugaucucucugccccaccauccuuaguggggucucuuuaucuccuaauccuaagauggcuucugccccucccagcaucagcucugcauuccagguggaggagaggggaaggcaaaggagaaacagcugugccagcuauucuucuuugaaagagcuuuccucaucccuagaaagugucaugugcuuucaucuuauuggccagaaccaugucacaugaccacccuaccugcaaggaagcuggaaaggauuuuuagaugggcugguugaugcuuucuacaauaccagagugauuuuaguaaaggaguuagggagaaauagauaauggaugggcaguuaacauucucuuccucauaccuucaacccagauggucuguucccugagagcuucccuaacucauucuggguuacuaaauccuacuuaacuagguuuugcagagccuuucuucuccauuaguuugggagucaaucucugagacuucugucaccaguaucucuuuggcuuuaaguaucucuuuaggcccuaagugauccacuggcaugguuuaguccuaccagguuacauagaaauggacugaaguacucagcugcuccucguguuugggacaggaaguguuuagugcuaaaguccucugaaugccugcauucuggugcucaacagcauggcacagaacaugaucgcucuaccugccuuuguccugguauggacccagcaggagccaggcaugguccacaaacugaguuucuuugcugguauaacuuguuuguuagaagaguugagacuguugaggacacaaaguggucacaagacaaguuguagcaauuguuacaacuuagugaggcucccuaagccucugaggccauugucugggcauuccugacuuuagcuaaccgaguacugcagugauucuggagauccugaugcugcugcugcugcuccugaucaugaugaugaugaugaugauuugagacaggaccucccucugucacucaggauggaguacugugaugcagucauaggucacugcagccucaaaccccugggcucaagccauccuccugccuuagucucccaaguaacuaggacuacaggcaggugccagcaugccuggcuaauuuuuuguaggacauggucucgcuauguugcccaggcuggucucaaacuccuggccugaagccauccuccugcuguggccucccaaagugccaggauuccaggcaugagccccuguaccccacugauucuggggauguugauacucauguuccuucucucccucccucuuuuccucccuucuucccuagcuucuuccuucucuccucgcuucguucuuuccucucuccuucccuccuuuuuucucucuuuugucccuuccuuccuuccuuccaugaauacuuaaugaguguaugagccccaaguguaucccagacuuucacaguuugacuuuauuauuuuuucucugaacguuuccugaauguggauccuggcugccuacccucauuccugaggggagagaaggacauaacguucuuugagauguggagcaccuagccgcauugugcagagacaacaaauacuucaauuuaaaucuguguucuaaaauggcugagaagauauuucauagauuuuaugagaggaaaaaacccaugcccuuagaauauuggacgguagggcagaagucuucuaguaaucccuccccuucuguccuccccaucccaccccugcuccccaucaucccaccacagcaugucaguuguuacuucaucugugcuaucacaggucugaaauguagcugaaaucguuuuccuagcuuguauaggcuacuuaaaggaaaaagagccccacgucccacacagauaucuaggauguuugauccgugacaagcuccaaaugagucuccuguguggugcugucagagguggggaagaaaacaaacuaggacucucaucuucuuaccugcagcauguuuauuaccuugagagaaaaacaauugugcucacagcuggaauucaugaguguguuuuccuuuuugcagcugggauaaacuuuugagaucuuauuuuucuuuggcuuucaaaauggucuauuguguuuuccuauagugcaauagcuuuguuaaauuccaguauaauugacaguaauuauucuuccaaagaacaaagaggugaaacuuugaagaugaagauauugaagcuuauguuguuaacuuacuaucuuucuugcuaugcagucucauauuuuuuguuuuguuuagaaagcucauuuuguuuugaaaugagaacaacaguuuaaaagcuauggcccaaagacauuugguuccuggggaacccacugaaagauuccugacagccgggggcacuucucuacugguuuuuguuugucuguguuuucuguguggguggaucacauuaacuagaaagccagaaaacagauauucugcaucagaaucaaauuacuaaaucuaguuauugccugccuucucuucuggguuucuugugcuuuguagaguuuuugccugucaucugguguuagcuuuguaaauaauuaguuauugaucaugaauaaguuguacagaccuuuuugcuaucauucccugggucacaaaauagaauguaguuaauagacaaagauccugucauuccuuguuaaugaacacuuauuuaaguagagcaaggaaugagcaggucuuauucaucuguuuauuuaucgauaaguuucugaguuguuuuuucucaguuuuuuauccacuucaggguggaucaaaaaagugguucucccugguuuaucugggaaaaugaaaagggaagauucuagagacuuuaacagugaucuuuuguuacagaaagaugcuucaaaaggaucacggcaaaaugcuauguucuaaacauguugguuggcacaagagaaacuguuuuacauuuuuacucaugagagguucugguagaauuuaaaaaauauuaaagauucauuaaucaugccuuauagauuuugaagcuguguuauugggggcauacagauuuauaaucaugauaucuuuccuguuggucuauuccuuaaucaauaugaaaaguuucucuuaaucuuuuggcuaguauuugcauggaauaccuauuuccauccuuuuauuuucaugcuuucugugucuuuauacuuaaggugugccucuuauaauacaacauauaguuguauuuuucuuucauccagucugacaagcuucuuaauugagcauuucauccauuuauauauaguguaauuaaguaauguuagauuuauauauuauuuuugcauuaauuuucccuuccccaucuguauuauuuuccccuuuuccuccuuuuuugccuucuuuuauaccaguuacacuuuuuuuaagcaucucauuuucugauuuuuaaacauauuauuugaauauucuuuuacuauuauuuuuaacaauuauucuagagaugguaacauccauguuggacuuauuuuagaguauuucaaaugauuacucuuaccaauccacugauaaugcuagauauggccagaaaaauagcacgcuggaauugccauuuucuucuccucuguuuuauauuauuauuguauuucaauucuauguuuuauauuccauaagacauuacuguuauuuuauacaguuaguauucauuugauguguuuuauguuuguaauuguuuuucauccuucaauuucacuuuuccuuugggaucauuuucuuucuguccaaagaacucacuuguauuauuucuuuuaguguuggccaguuaugggacucuguuuguaugaaaaugauuuauuucaucuuuguguuugaaagauauuuucacucacuauagcauucuagguuggaaguuauuuucuucuuccauguauucuauucuauuuugauuuccuucauuuauaguaagucauuagcuuucagacuuacuguuacaucuuugaauuuaaaugguauuauuuucuuucuugcugcuuuuaguuugucuccuuuucugugguuauugacaaucuuacuauggguugcauaggauuguuuuugcuuuuuauuuauccugcauugaauuucugaauuuuuugauugauaucuuugaucaguuuuggaagauuuguggccauugucuguucuaauguuacuuuugucucauuaucuuccuccuuuucuccuggcacuucaauuacauguauguuagaucuccucaauaugccugcacauuccuagcccucuucuguauucucuuccucaguacuucuguuuaguuauuuucuguggauugucuuccauuuuacuaauucugccucuugcugugucuacucucuauuuuguuaauccaucuaauaaauuuuuaauuuuagagaguauauuuuguaguuuuagaauuuccaguugauuuuuucauagauucauuucucuacugaaauuuuucucuuaccuucuauuugucauuuuuuuaucuuauuuucccuguucucaaauaugauuauaguuguuuugauguucuaggaaauuguaauaucuagauuaucuguggggcuguuucugcucucuuuuuccucuuucacuuggacuguggucugguuuucugcugaguuuaauaauuuuuguuugaagucaagacuguuuguauguaaaacuguagaagcuucagaugaugugaucuucuuccagagauaauucauccugccuucuucuagacaaaguggggcugaccaucuuauuuuaaucagagacugugcucaguuuugaggcuacacuggaccuuuaguaugccucagucuccauuuacugugccucuggcuuucuaggauuuucaucugagagucggcucuguuaccuggggacucucucccuggcguuuuccaaacucgagucauuuucucugaugauuggugcaaauuccacuuugcuuuauagagguuuucguuuugguuuuuagucuucuaucccauacaggucuaggaauuacagauguccugaggggaaaaaugauugcagcuugauggcucccgaaggguugcaccagucuaccagguguucuucaugccacuugcaagcagaaguucaugauuccaucauuuuaauuguuugguacaucauuuaagcaaaccccauuugaaaacccuuauuuacaaaacagauccacuagguugcaauuucccauuuuacacagaauuuguugcuuuacaguggaauucauuuaaauaucagacuaccucuaggguaauuaauuaucacuuaguuuacaaaauuuuccauuguacacaaguuuucagguaucguauauuuuuaauuaggcagcaaacuaguauuaguaaacacuguauuaauaaaacaucugagucacaauauuuuaaaaugcaaauguguugcuuuuuaguaacacagcaacuugaaguaacugcuaauaaauaauuuacaaacgagacuuauuuucaauuaguaacauauauuagcauacauguaaccaaugcacaacuuccuuauuaccuauuuauugaauaugucccaccucuugaauacuuuucaguuaccacugauguugaaaugaaugcguuuguaaagcaccauuacucuggaauaaaaaagcaacucuugugauaucauuuuaaaggauuagaagaucaugguaaauuuaggcaauggaguguguuguugauuuucaauuugugacauaauggguuuaaaaacauugguaguggccgccuggcggcucacgccuguaaucccagcacuuugggaggccgaggcaaguggaucaccuuaggucaggaguucaagaccagccuggccaacaugguguaacuucuucccuacuaaaauauaaaaauuagcugggcauggugguggccaccuguaaucccaccuacuugggagguugaggcaggauaauugcuugaacccaggaagcggugguugcagugagccgagaucaugccauugcacuccagccugggugacaagagcaagacuccauuacaaaaauaaauaaauaaaauaaaaauaaaaacacugguagaaaacacaacugcaucuuaauaguguaauuuuugugggguagaaauaaagcugaauuuccccauccucuuucccuccuucucuuccucggcccuuuccacccucccuuucuguauauuuucuguguuuuucagauuuauaagauguaguauguuacaaugaaaaaugcagugagugguagcauuaagggucagccucuguauguggaggcacgcugccuuggcugaguggucugcaugagucucacugccaaguuaccuuccuugcuucauagauguugaggauguggucucucauucuaacuugucacccaagugauucccuucauggcuauagacauggauucaaaaaauguugagguguuucugccaggcccccacaguuuguguguuucuuugcagacuguaugaaaacaagggagaggcugacuucguggaaucuuugcugcagcucuucagguccaucaaugacaugaugagcagcaugucagaccagaccguccgggugaaggugagugccggccacugccaaggcagacuucuccuucuuuuuuucuuucauuaucucuuuuggagguagguauuuugauuacaguuaauuaacuugccccaaauaccauaguuguuaaugucagagaucucaauuugauuucaagagcugugcuuuuuuuuuuuuuuuuuuuuuuuuugagacagaauccugcucuguugcccaugcuggagugcaguggugugaucucagcucacugcaaccucugccucccggcuugaagcaauucuccugucucagccucccgaauugcugggacuacaggcgcaugccaccaugccuggcaaauuuuuuuguauuuuuaguagagaugggguuucaccauauuggucaggcuggucuccaauuccugaccucaggugacccacccaccucagccucccaaagugcugggauuauaggcgugagccacugugcccggccuuuuuuuaauuuuaauuuuauuuuuagaugacacauaaaaacuguacauauuuaugggacauacgcugauauuucaguacagguauacgaugugaucaaaucaggguaauuagcauagcaucaccuugaacauuuuucauuucuuuuugcugugaacauucagaauccuuucuacuugcuuuuugaacauauacacuaaauuauuguugaccgucuucacucugcauugcuacagaacacuggacuuuauucuucuuaucuagcuguagcuuuguaucaaaguggacuuguagaugaagggcuuccuguggcugagcuaaggggcugugggcccugccaagccugaacucgagggaaaggccccggagccucuuuuguagugaacauaaucaugcuccauguguagugaaaucccuucuuccuccucccuaggugcucuuaaauauuuucauugcuucucucuuugcuguuuggcaagacagauucugaauucacuuuauuuaaauuugggggaauugaugagaaucauguuuuacaccuaauuucucaggguguccaugcccuggaaaggguggugaaccuucaugcuucaguggaucuuugccugugcagaagagcgagccuuccagugccccuguccuucuguccuucuucccucuuuugaugaccuggucucacccuguuguccuuuggaagaaagaucccuuccacucacaugaggccugaguguucuuuaggaugcucacugguguggaagugccugggaggcccauggagcagccgcaggacccccacaaucuugguuauccuaguuauggcgguuuucacugggcugacuuauugcagaaggagcuguacaacuugcaauuugcugccugcacuaauuccuucaaagaacaagaaucuuccaaaugauuagcuuacaucuuucacucgacugaucaugguagacgccucuguucuuccucuuuuaauguuuguuuaacguauaauuuuagaaggcauucuuauggcuagugucuuaaaaauauuuuggucaagucgcuucccagccuuaaagcuuugccauaugcccuggaacaaagauguaugugugcugagacguggcugaugguugcugugaccaaggaaaccagcauaaguagacaugaaucaagucggagccuaccuuucaucucagagguggugcagcuguuugguggagccauuuggacucuucacuacgauuucuugauuuuuuuuuuacaugauuuacuauaaaaauuggugauuuauacagaaagaaauguagguggugcauacauuaaaauuuuagguuauuugggcaacuugauauugcccaaagcugucuuauugucccaagguuaaaauuagcaauguguuugguacauuuacuacugaauucaguggcauuuuagaaaaacagacguguguaguguaagaauagauaaaaauuacaggaaguuuugagcccagcaguaauuuuagauugcuaaauauauccuuacauuauuaaauuugauugggcuugauuugugucugccucccucccuugaagucagauuacuuagugacuagggaccgggaagaccaugcuucaguggguguuuuauuauaagacacaagugaauugagugacgugugugcauugaugcaaaccuuacaucugcaagacagacgcacggcguuuuauuaggcaugucaccucccuucugguaauugguaucguauuauuucacaauaggugcuuucucgaugacguuggaaauuuaaagauucccaucgugggagccugacuuuuguguuguuuuaacucuuucaguuuugcugugucuaaauggaaggaaauaccuugugaaccaucuuccauagacaaaguauauuuucagacugugacauuuaaagguuaaacauuguuuccccaaguguggcccucguugguaccaaacgguugguaccuucccgguucaagugauucuccugccucauccucccaguaguugggauuacaggcacccgccagcaugccuggcuaauuuuuuugaauuuuuagcagagaaaggcuccauccccuucuugguaccaaaccugccacuggcaucaacuuugcggauuagagucagccacgggguuuuacgccucauugaagagggagggcaggaggaacuucagaaguaauuuauugcaggauaagcauggucuccagcuagaauuuucaacaggacuguuuucauugauuuagugacaaaauuuuuccaaggucauuuaagugagaaaacacaaauggaggacgcgugggccaguuuuuauguuaagucaaauguccaggaaacuccacugaguguguggaugcugccugccuucacuccccuucccagcggccgucucccgucacccccgcuccccaggcgcccgccgugcccagauguuucaguaccgccucaccgucccucagugaauggcccucagcccuggggcugcagccaaauacuuuuugaaaacauacugccguggccaaauaacaugaaauuccccauuucuaagugucccguucaguggcauuaaguacagucacacuguugugcaaccaucaucaccaucccucuuuagaacuuuuacgucuuuccaaacugaauggaacuccagccccaucaaacaccaacucccugcagccccuggcagccaccgguccacuuucugggucuaagaauuuaauggcucugggaaccucauggaaguggacucauaccacauuuguccuuuugugucuggcuuuuuuucuuuuuuuugagacggagacucgcucagucucccaugcuggagggcaguggcacagucucggcucacagcaaccucugccuucccgguucaagugauucuccugccucauccucccagcagcugggauuacaggcaccugccaccaugcccggcuaauuuuuuugaauuuuuaguagagacgggguuucaccauguuagccaggcuggucucgaacaccugaccucaaauaauucacccgccucggccucccaaagugcugggauuacaggcaugagccacugugcccggccguguuuggcuucuuuuauauggcauaaugucugcaagguucuaccaggugguggcaugugucagaaucuucuuccuuuuuaagguugucauguugcugugugucucgugcacauuuugccuccgcaccugucccuggauagaggcucggccuguucccaccucauggugguugugguucaugcugcugggaacugggguguacagaugccucuugaagacccugcugccagugcuccagaaguggaauugcuguuucucgugguaauuaugcuugaauuuuuugaagaaucauccuguuuuucccagcaccccaccaugcuaccgaaaccucacuugaaauuccauauugacuuucccucagcagcccuuuccgcagcuccuccagcuccaggcauauccucugccgcacaucaccuaccuugagugaaugaugcggcuccgacugcugcauugaaaaggccuggggucagaggcggagguugcagugagccgagaucgcgccauugcacuccagccugggcaacaagagcaaaacuccaucucgaaaaaaaaaugauaaaagaaaagaccuggggucucucgguaucaccucuuccugucuguuuuccucugaagaggagaagcccaccugcugugcagugcugaccgucccccucccugagacccgcuccaccccuagcuguuuccucaccaucucagaucuucugucuucaccuugagcugccccuucacccggcccagauguucuggaaauucaacccgugccuucuggauucuucuuugcccucggcguuucucucuccuaccugacaagaggguccuuggccccauugccucugcccucgagucguguucuguguucugccccaagagauuguggcugcuguuccucccaggugcccccgccgcccccagcugcggugucuccagucagccucggaauucccuucugcugucuucucuucucugugcuacugugacugugguuucaugaaccacugggcuugcuagguccccaguucuucgucuugaaauuagggcagaaaagucuuggaaccguuuccugcaugcugaugcuggaccugccccuuuuuuccuuggcaucucuuuugguguuuuccugaaacucccaucuggugaugacuugcuguuucucagaaaacugugcuguucuucagcugccaggagaaaugggucagauuccagugugugacauccagacagcuucauaggcagcccaccuggcucuccaagccuuuuucccucguggagacccaaguagaaccagugcguuccccaggaaacaccaaacaucugggugugaggagccuccugaggguuagcucccccaaucagugguugauagaaauagcaugagcgccuagugccagaguaacuggagcugauacuuauugaucgccugcuguucaacgugcuuuguauuucucaacugauuuagucuuuacaauagcccuauuaaguagauacuuugauugcuuucugaugaagacacugaggccuagagaccuuaauuaaccuacccaaggccacaagagcugggaugggguaacgcgcugguuuaaacccugguuggcuaguuccagaaccacucucuuucccauuuggcuccuagagacaguguugcuaaguccuggcuaucccgugguguuuggaaacagggcccaugccugccauccacaucaauggagaacaggcuggaugcuuugggcuggaaagaugccgacauuaucccugguggagcuuuccaucgaaguggacaugcauaaagcaacuuaaaaacucuggugaaaugccacaagaauugggugagugugaaggggagggaggagaguuagaaggggcuggucacgaaggcuugugggaggagaccuuggcgauggccccacuguguuggcagcagguggcuguaucuuggccacucguggauugcagugcuggauugaggcguuuggggcuuugcagucaguucuuacaggcauugacaucauuucaaguccacaaauauuacuaccuucccuuaggaugacccugggaaaagacuacugcaugcaggaccuuggcauagucuguuccaucuggggcugagaaugccagaauuuucuauagaaggaaacuuugaccaugauccacaguaggaaauugaugcuuacuugguauaugugugugagugugucugugugcauuguauguguguguguguaugugugcguguguguugugcauaugaagcuggaaaaugcucaugaagaaguucuacacugauucccugugaugcauucuggcauuuucuagucuagucuccuuuagucuauucuagacuaauguauuucaguuaaaaaaaaauugcugguugacaggcacuaaauuuauuucaugagcacuaauggaucucaaccugcacuggaaaaacacuccucuuuauucaucucaggacucugccccucugucuccugcuuaguuuauuaugaaaauauugucagcuuucugcauuucuuccauugucguguagagccccaggccccugacgcucaggcaacuuuccugaccagcaugcggauugaacuggggugaagauuaauugaauuugaggccccccaagcugagguuggcacacagaugcagaagguuugucuuccuucuggggcacuguccccagggagcaggcuuccccaucucuuuccauucuaaccaucacauggcgccauuuccaucuggcuuucuuagagaggagcuguguugaaauaagcuauucuguaaucucaguaaauacagcugaugggugaguucugcccuccaagaggcacauuuuuugauucccuuaaaaauaauuuccugauuugaaaugaacuguauuuucuugccuuaaaucuuacccagaauucuuccuuaugaggaguuuuugcugcuuuuuguguauuuauuuccgggcuagcaucugggauccacacggcuacucacagauuuguacacauagaacuuuacuguccucagaacaaaugaucugaauguguuagggaugaugauaauuuaagaucagauggaauaggauuugcuggcaggugaggaagucacguuucacugaguaacuuugggccugucuggcaccucuccuacagcagcuccugccuucgccccuucgucuuuauauguguuccagauuuucauaaagguaucaaguccugguuugcauuaaacaaagcagccauuuauuguguccuugcccucaguuuaaaaguaauaugugaucugguuagaaaaaugccaaaaaguuaauuaagaaaaauaagaaucauuuaucacccuaccuuccagagauuacacuguuagcauuuuuguuuuuacagugaugagcucuuuuugcuuauuuagcauuauccuauauauauacacacacauauguauacacccacaccuauauauacacacauauaaauguaacauauguauaguauaaauucucauguguauacacacacacacacacuuuuacaguguugcauuuuucuguauauaucuaccuguguccuucaguauuuuucaagcacacauuuugaaagguuacacauugccucauggcuguaugauaacuuacuuaaccaguuuuccauuugagggcacauagcugguuucuaguuuucaguuuucaugaacagugcuuggcugaccucucugucuauggcaaaggccuugcuccaucugguuugcucugaggcauccagauuuucaaaugcucuaaaguccgaugaaagucaugaucaaggcgauuagggcuugauuccugggugaugacucugugcuucuuucauuggcgccgugugucugcccugccuugguuuccacuagagcucccgucuguuucuuuuccacuuccuucuaugcuucuugucauugggcuaugcagcugccaugguggaugagucgggagccacuucccucucucagaagccaccugcuucugugaccuuuguguuucuugguacaggauuguuggccaaguuagguaaggagacgagaacuccggugcguuccacucccucugaccugacgaaucagggccuggagcaaaccaaccaaugagauguuggcaccgucauagaccagcaagcagcuuaaagaaauuugggaguauuuugagucagaaggguuucccaagagcaaguaauaaaauauuuucaccuucuugauuuugaguggaggagggggugcacugaugguguuaauugaucugaggaugucaugggcaugagucaggaaucuauuugagagucucucaucauucguggggacacagaugcggugguuugaaugaggaccgucuaggucacauugucuguauggagacagacuuguugaauuagaauauugggcagcugaggcuggcaacucaggugaagccaaccaugacaggaaggacuacacuuguugagaaucagcaacaggccaggccuucuggagaguucuccugcaacaaagagaagagagggaggucccagagucgaggaggugaguaggccaaguuuggaaguugcucuaacaaaauacuacaaacuugguagcuuaaaacagugguuuuuuucuucucucagagccuuggagauuagaaacuugaaaucaggguggcggcagggcagguuccuuuuggcugcuccaagagaugauguguucugugccuuucucuagguuucuggugauccuugguauuuccugacuugcagaugccuugcuccagucucugcccccgucuucacgcagcacucucccugugugucugucuuugugucucuucucuucuuaugagguuguuaaauucagggccaacucuacuguggcguggccucaggucaacuugauuauaucugaaaaaagacuguuuccaaaacauucacaggucccaaggguuggaacuugaauuuagcccuuuuuuuuuuuuuuuuuuuuugagauggagucucgcccugucacccaggcuggagagcaguggugugaucucggcucacugcaaccuccaccucccggguucaaacgauucuccugccucagccucccgaguagcugggauuauaggcacccacuaccacgccaagcuaauuuuuguauuuuuaguagagacaggguuucaccacauuugccaggccggucucgaacuccugaccuugugaucugcccgccucggccucccaaagugcugggauuauaggugugacccacugcaccuggccugaacguaaccuuuugaaggacacaguuucacccacgguagacgucaucguggacgucaguguagaguucacuggcaggucaguggugaacaaaggacuggagaggaaguggguccuuagccaggcacccacagucaguuugacaugggagcugcaggacuggaaacuucuuagaaucuagugugcacaugagucaccuggaggucuuguuaaaaugugauuccgacucuguagggagggggccucaagauguuucauuauaaucaacucccagcugaugcuaagguugugggucccuggccauauauugagucagaaguggccacgccucgccuugcacagacagcugcugugugagcaguaguguuuguggguagggcaccuggucucaguucuugcagccuucaaggcuggcuucauucaggcugccugcccucagcugucugacguucuggacuauuuugauuugauaaguuugcccuacacacagaugaugacacacuugcaagugugucauguuaagaaagacucagcagaagaaggaacgagggaagugaagaaaauauuuuauggcuugcucuuagaggaccuguggguccaaaugcuccccauuucacuauacugcuugcuggucuguggcccugcagaggguuggguagucuggcugagaucugaacucaccaggugcugcagcauuccagucuucuugguugcuuccuaggauucuuccugcccgcucuggagggaacaauaccacucacauaggcaagaauuaaucaggagaggucuggauaaauacacuuguuuccuugagcaccucuccacccacauuuauacugugcacaguacuuugcaacaguagcagaaaugcagcaguagcacuaccuugcagaaaugcaacaguagcugaaaugaaaaucaucucucuuccaccguuucuucagcaaaccaaguauuucuauugguuuucuuccaauucuagugcaugcccaucaaaauguuuaugcuugcaaccugcguaguuuuugguuuacugauuuuuuuaucauuuuaucacaacaccuuuccauuauuaauguguaguuguaauuguaauggcuguaugccaguucagaacaugugccugaauugaugugcaaucauuugcuuaaucaaaugauuuuuccucaaauuaauuuuucuauuguugaauacuaccguguugcuuuuagcauuuuaagccugcaacaaauuauuucauugauaaguaguguguguuuauguuuucuuuaauuuuaugauccauuuuuccauguugauuccuucacauugccacuuguuagaggacaaugcuuuaauuugagauugcagaauucuaggcacuugcuugccaucccuccugccuuguccccaguaaugaugcucacugguggaaaaucucuccuuuggccaugguggcuucagugcucaggaaccugaacuuauuuucuucucccaccccugaucuuguucagagaucucucuuguuaggugcuccucccacaucugugcccucggucuuggauucugccugcugccaacaugcaaggugccagugagccccuuucuccuuccuccaucauggucaggauuuauucagcauuucucugaaagugagcaggucucagaguuaugcuuaguaccucauuguugaguuauguauucaccuguuuaaaaaauuccuucaaucauauguucauucuccugugugccaggcacugugcuaggcacugaggaguuacagcaccaaucacacagauacgcucuguauucucauggugguuccauuggagugagcaaggcaggcgugaacucaguaaccauccccuauguguauaguugcauaguugcaauaugugauuuuaagcaaaucacagacauaaaauuaucauuguggauuguagucacucauuuuaagaaaaaguaaaggucagggugacaagguauaucggggcauuggaaguaguuuagggguucaaagaaggugcugauacaaagguagucaccaugaggugcuuggauauguaauacagcagaggaaaaugccaaacccagacucucguaugguuuggagagaacugugcugccacuuuuguccagagggguuguggagcaugaaguaauccuaaucccuucuguucgugcaguacucucaggcaccaaagacuuugaugcguguuaucucuuaggauccucccagcacugccauggugguuguuaaaaauaaugagaaagcuuucuaaagggacgggcagagaacaucaucaugcaaagucugugcgucuuaauagcugacucauugauggaaacauuuauaucccacauccacuggcucuugucuggcuucuucaaaugcaccugucccuaggaccccuuccuagagauaccagcauuuagaacagaccagucuaaacaaggucuucucaagugaacugaagauacuaggccugcaaacgcucaucugcacuucacuuacgauguggcauuuauaaaugcauucaccguagguguuuguagauucuuuuuauguuuuaaguuuuaaguuugcagcauugaggccuauuuugauugcaaauugcauaaaccucaaauaagaucuaaaucaaaggaaagguauugcaugcuuauaggugacucaacauuaagaauucaguucuucccaacuugaucuacagauucacugcagucccaaucaaaaucccagcaaguuuuuuuguggcuauugaccaacugauuccgaaguucauguggaaaggcaaaagacccagaauaaucaacacaauauuuauggagaacaaagucagaggacuggcacuacucgacuucaagucugcuggaaagcuccaguagucuaauuacagaaacccaacuccaauucacauuagaaagaaggaaauuaauugauucauguaguuugggaguccaaguguuaagcaugagugaguuuaggauuuagaagguauccuccucuuggcuuaguauuuauuucucuccauuugagggaaaaguggcugccaguagccagaggcuugcaauuuucuuuuuugucuaauagucuucgaggacacagagugaccgucucccucuuuaaggcaauguuaaucuucagacagaaccaucguuaaccuucuuuuaagcaggaggcuaucccugaaaggaaaagacugugaaguugaaacagaaguagagcuucauaaugcagaaaauggagaaagagggaugagaggacucacaggaaggcugaagggacauuuguaaaugcagcugaagccagugcaaauuggcgacuuugugaaauggguuuugcagcuauucuuuggagcugucugcugaggugauggaaaggguaguuaaaagcuucauuuaggauugguguucugccagcaugccaaguagcccaaaccaaggccugggaggagagcagacuuuaaauaugucccaggaaacguuuuauugagaaacaugucaacuaccacuauagcauuaucaagagggaaaaaggaauauuucauaugugagcuuaaaaaaucauuagcucuguuauauugaauacuugcaaaauuucauuaaaauuguuuuugcagaauuuuaugauagaauaaauuacuuuuguguauguauugaugaaaucauggaguuauaugaguuuggauuucucaagcacccaaauagucaacaucaagaaucagggaauuaggagguuagaaagucacaucuuuaguuuuuuucaggaacuugcccaggaacagagggguccuaggugggaugaccagaccccaguucucuguucuucagcccagugcuuuuuucaugacaucacucaagucagauuuuaaauuugugcauuacacuggcuuuauuuagaauccugugccaggcaauauaguuuugauuagaagcugaacaguauuauucuccaugaacugugaaugugacacuuuuauaauucaaguagaauuauuuuucccuugggaaauccuauacauucaauaugguacauugaauuagcaaagagguagaagaaaaaaggggcuauaaaaaguguaucuuauuaaaacaaaguagguuuucuucuugccugugucaccuuuagauaguaauucuuagcaucacuauuuuuuaaaucacaaauugucuucuaucuagugaaaugauuaagaaagaacaguaguccucauuugauuaggugaaacgugacacaagucucguugauuuuugaaaaggacauuuucauauaauuccaagaaauacacauucugacauuaaacauuuuauaugaucccuauugaagauuaaaaggagagguguuuggccgggugcgguggcucacaccuguagucccagcacucugggaugcugaggcagguggaucaccugagguugggaguucgagacuagccugaccaacugaccaacaugaagaaauccugucucuacuaaaaauacggaauuagcugggcuugguggugcaugccuguagucccagcuacuugggaggcugaggcaggagaaucgccugaacacaggagguggagguuguggugagcugagauugcaccauugcacuccagccugggcaacaagagcgaaacucugucucaaaaaaaaaaaaaaaaaaaaaaaaaaaaaaggagaguuguuaugucugggaaauuagguggccaucaaguuuuuucaugguuuuucuuucauugauugauugauugauuugauugacguacugagaccgagucucacugucacuuaggcuguagugcaguggugcaaucuuggcucacuguagccuugaccuccugggcucaagugacccuuccgccucagcuuccaaaguagcugggacuauaggccagcaccaccacagauggcuaauuuuuguaauuuuuguagagauaugguuucgucauauauuagucuauuuucacacugcuauaaagaacuaccugagacuggguaauuuauaaagaaaagagguuuacuugacucacaguuccacagguuuaacggaagcaugauuaggagaccucaggaaacuuacagucauggaggaagacgaaggggaagcaaggaccuucuucacauggcggcaggagagagagcggagggggaagugacacacacuuuaaaccaucagaucucaugagaacucacugucaugagaacggcaagggggaggucugcccccgugauuuagucacuucccaccaugccgcucacccgacacguggggauuacaauuugagaugagauuuggguggggacacagaaccaaaccauaucacuccauguugcccaggcugagugcuagauuccuguguguuauuuuagggcacuuuauacuuuuauuauuuaccaguguuugagaaguuuaugaugguucacaaaacuuucucuuccuacgugggucuuauguguguuuuugagugagcugaugauacacucguggccagcacuguucugugcuguguuucuccacccaguguguggacaucuugcuaugugcacagguaauauguccuucuuacacagaggggugcaaagguugagucaaaucagcauccaaggaguugcugauaaauugagaacuuccugacagcaagugacaccaaaaccucaacuaaaaugaucagcaaagauccauuaagaaaauaucggccaggcacgguggcucgugccuguaaucccggcacuuugggaggccgaggugggcggaucacaaggucaguagaucaagaccauccuggcuaacacggugaaaccccgucucuacuaaaaauacaaaaaauuagcuaggcgugguggcuggcgccuguagucccugcuaaucaggagacugaggcaggagaaucgcuugaacccgggagguagagguugcagugagccaagaucacgccacugcacuccagccuggaugacagagcaagauucugucucaaaaaagaaaagaaaauaccaagaaccagaaaacgggucguggcguaaaccuuggugaggaccuuggaauucaaggugaaaggcagagugugccccagggaguggugaggguuccugcagcauaugcagcugcaucccccaccccagcacccugauuucuccucacugcucagcuccucuggaauccuugccuucccaccucauugguggagcugcuccauugaaacccaagacuccauuccaggccuggccucagccccaucucugcccagggcugacaggggggcuccgucaucuaccccagggccugugccuuccuucuuccuccugguggcauuuccauguugggggccccugcuugucccuggggugcaggaauucuuaagcaccucuggcauuuugcuccugccuucuugccuggaguuucacugcugucugcaggccuuugagaacagaggcagggaggugccagaagcccuugagaguguggugauuagggguuggaugcccugugcgaauggcaaggaggaugauucuugaaagaaaaugucaggguaacuuaaauuucucugaggucagcuugcuuguuguuaauuaaguucuuacuacgagggccgagcgcgguggcuuaugccuguaaucgcagcacuuugggaggcugagguggguggaucacuugaggucaggaguuugagaccaaccuggccaacauggugaagcuccauaucuacuaaauauacaaaaauuagcugggcgugguggugggcuccuguaauccuggcuacucaggagaccgaggugggagaaucacuugaacccaggaggcagagguugcagucagccgagauugcaccacugcacuccagccuaggugacagagcgagacugugucucaaaauaaaaauaaaaaaaguucuuaccaagaaagcagugcuaaguacuucuccagcacugcuucaugucgguuggcuucuccagacaugggccucuuuguggauguuauuggaaaggguaguguuuuaauauacgugcgcuuuucacauggauucaaggauggcaugggugggugggauuacucgacuuuauagcauauuaagugcuuauuuggugccaguuauggacucguacugggcagaugccaugaggaauguacaguggaagauguuggauucugacugcaggagaggaaaccagguauucgaccccccaaauagaugacagauugugugguacaucacugcaucauuggguguccagacgagagauugcaggcaagacaaggaccuaaagaaaguggcaagugcacugaaaccaccaguuaaggccuccucagagcagguuggacugcccugagcuuugaggggugggugugaguugagaugggggagcauuccauggaggggcaggaggguauggaugggagggagaaggacaguggaaggaggugguggggauggguuguucucuugggagcccaggggcaggaguggaggcaggcagccucguuccaccccugguauucagagccgagaaaaggaauuuggacgaggaggugcugugcuaaugagaggcaguauuagagauccugagcugacacacuggaaauugacauaugggcuuauuuauuuauuuauuuuauuuauguuuuaaauaaagguuaagaucuuccagagaagacauaggaggagaaaugggcauuauuuuuccaggggucucuuaguauguaaauaaccugaguucuuaaaaguuuuaucuuauagaauuuuuuuauuaguucuuuuauuuuugucaugggaaaaauucagaagcuuuccuggaaacuugcaugucugcuuucagaguuuuguggcucuuacaaggagccccuuuggggguguggggcaaccuugcaucccaggaagccgccugggagauucuagggcugguaccuccuuuccacucagcugccugggagauucugggguugguaccuccucugcauucaggcugccuccaucagcugaagaggcgagagugucauaacaugacauucuguguaugcgcaauguauuuguagaagauacugaucuuuggauccggcaaucccauuccuggguaucuacccagaggaaaagaagucauuauaugaaaaagauacuuguacaugcauguuuacagcagcacaauucacaauuacaaaaauuguggaaccagcccaaaugcccaucagucaacaaguagauaaagaacaugauggaguacuacuuagccauaaaaaggaaugaauuaagggcauuuacagcaaccuggauggaguuggagaccauuauucuaagcgaaguaacucaggaauggaaaaccaaacauggaaucuccucuucauccuuuuucugucugccuuuccuuguucucauacuuaaagacagcguguugggagcgguauauugcuguuguuuuugucuucuccaaucugaccaccuaugucuuuuauuuggaguauuuaaucccuugcuuuuuguuuguuuaauaaucccuuuauaaaacagcugaauuauaaauugauggauaaauuuauagauguugaaaggcacaaaucugaaguaugcagcuuaaucagguuugacaaaugcugacacucauguaacccacacuggcauguuugcaccagauuaaagaacaucuccaucaccagucucugaacauuggaugcauuuaccggugguguuggguauauuucuuccauacucccgucuggaaucugaaccucuugaucccauuugccucagcaacucugacuccuucagacugaaacuuucuaucccacaguauuuucuuguuuccaucaagaaaggaagagauuuaaacucuguucugcaauucugucugcauuuccucucuggaauccuucucucucuccaaacaaagugguuaccucuuuaaaauaggcagugaacaucaaggaaaaccuugcauaggcugaaaagggcaaagugcucaccuuugcuugcauugggaaguaauuucuuuuaagugugcauagagacagacuaauaaaaaaaucuguugagugugucauguggcagucagucuuuagaaguguuguuccuuugucuuuuaaucauucucagaauuagcacaccaguugugugauauguaaaagucuauuccuggcagggugagguggcucaugcuuauaaucccagcacuuugggaggccgaggagggcggaucaccugaggucaggaguucgagaucagccugaccaauguggugaaacccuuucucuucuaaaaauacaaaaauuagcugggcguguaggugcaugccuguaaucccagcuacucgggaggcugaggcaggagaauugcuugaagcugggaagcggagguugcagugagccaacauugcgccacugcacuccagccugggcgacaagaaugaaacucugucccaauaaaaaauaaauaaauaaaucuuuucccuagcucauuuuuuuuugacuguguuaaauucaguggagcaaggucucauuuauauccuccuuauucauaauuugggguaauuagcauagugguugggcugccauucaccucuuacagcuaggaaaaugaggcuuugcgagaggaaugcaaaaauauaaacaggauuaagucauugauggcaugcucauacuuccuaggagaauuaagucuuuucagguaccacaguauguaugaguccuucuuaacucucauuuccaccagaucuccaccaaggaguuuagaacugauggacuccaagucucccucuggaugagacauucugaguucuugccaauaucaugcuaagcuggguugauaauuuccuuugaaaaauuuccuuugaaaaugaguagcauuucaucuuuuggaaauuuaucauucuucagacuuuucacugaccuguccccucccauagccgacccccuccuguaccccaggguuugauugauauuugcuuuuguauuguaauuacuauuuaauauccagcccuccugagguuugcuucacugcagucacauuguauugcaagcagaaaaugucacgucgccuggagcuguugggguagugugguugugguccuuuggguauuuccuggcacaccuggcucaugacaucgugcagagcugaacaggcucuaggaggaggaaggaaaccuugccuggguacuuaaaauuaucuaucacaguggauccugagucugccucucagccugucuugaaugccaggcuauuauaaaucagcuuuauuuauuuuguguuugaauuuugacuuuccuguucaauaauuuaauauuuuaaaaugacaccuuuggucuuuuauuugucauaagcgagggccgaguuagccacccugcaauuugccucuguacucuccgccccccaguguguagucguuagcucauaauuguuuucuuaaccuccucagagccuggugugaucuugcucucaaccuucuugaccuuccaagguaguuaaaugagguuuugcuuucucuaugaauuaauuaugucaucucuauuugaaauguuccugaacccauggugcuguauuuuggcaaaauaaauacuauuuucagagacuguaagacccauccauuuuauuuccuuuuauuagaagauagaacgauuuucuuagaugagcaguuaucagcugauguucaccuucuuggaggaagggacugcuggcgguuuuacuucaaaugcagccauuugaaguaucugauuuggaacauuccauaccuggugcagaggccacuuguuucuacagguuuguccugguggucuguccucugugccauugaacucccagaguccucugcagaggacauguaauaauucuugccuauuaauuuguggacccuguauguggggcuuuuuuuuuuuuugccuguuugagacuuccugccuuuaggaguagacaaugaccuuucauacguuuaaugcuucuguuguucucaaguuugagaaugugguguguccccuggguccccuccuuacaugaaauccaacccaaagggucaguguguuucuuguguguuucugucuucacuccucuguccgcuuucaucucuuuccuggugagucucugcccugucauaagcaaauaaccuuaguuguuuccuccccaguaaugguggcuucaauugcuguggauuuccuggccugauuucaaggcuaggggaaaaugccuguguccugguucagaacaggcagucucuuuauuucuucugucuugccguggacaaauagaaucguggcccuuacgaguucuuucuaaaaaaaucaccuuuauugagguaaaauuuauaugaacaaaaaaauagaaccauuugaaguaucugauuuuggaucauuuugaaaaugucccaaauguccucucgucaccaccguaaucaagagcuggaacauuucgccaccccagugaucucccuuugcuggccccuggcgaugcucauacauguggugguucuucacgcgaaagcagcugaccucaaagagggugaacaugagcccugcuuuccuuuccucuuugacuuccucucugauccaucccuaaacuacaggauuuugucauguuaguuccuauuuucuauuaccaugaaugacuguuggcgccucaggcuggggaagguuaauuguaguaacaaagaagagguuuuccuggcaggaaccauuuccuuacucaggaaacaaacgcuuuccuuucucacagucaucuucuccuucuuauguaaguagaaauauuaagccauacucagucuguccagguccugagaauuggugucugcccgggucuggguuuguauuagucuauucucacgcugccaauaaagacacaccuuagacugggucauguauaaagaaaaagaggcuuaauuuaagggacucacaguuccacauggcuggggaggccucacaaucauggcggaaggugaaggaguagccaaggcaugucuuacauggcggcaggcaagagagcgugugcaggagaacugcccuuuauaaaaccgucagaucacaugagacuuauucacuaucauacugucaugagaacagcaugggaaaaacccauccccaugauucaguuaccucccaccgagucccucccacaauacauggggaugaugggagcuacaauuaaagaugcaauuuggguggggagacagcccaaaccauaucaggguugcagaggcuuaugugggaggaucaagagugacagcaacugucuggcuggaggggaaggagacagaaccugucccugggccuucgucuccuuuccccgugccccacaccuagcccuggggagcccgauucccuccucacacucccuuggcucccuucuugucucuguacacagccccaagcacaaaacgacugcucauuuuccuggccaugcugugcuuugcugucuccaugucuuugugagcagggaucuuucuccuuggaaggccuguucucuuccugucuuccaggacaucugccugucagcagucagccuucuauauccacugcagaggccauuuguuucugcagauuuguccugguggccuguccucugugccauuggacucccagaguccucugcaaaggacaccauguuuucauuaaacacauagaggaggcauguuggcaaaugucauuugcagaucugucuucucuagcagggcaaugcucuuggccauugaacauuuugccuggcaugccacagguuccaacacuuucuggacaaaugaauaagugaacuggagaucaguaaguuauuuugaaaaugcaccugcuguggcauuugaggagauguaaaauaccuggugcccucccuucccaggaccccuccaagcuggacgagcaguccuggcuccuugguggggcauugucuggugagccuugagggcgugcuugggugccagcgaucuccccacccuuugcuuuguuaguuuuugcuccugaccuacugcuuugauuugagaaacccuucggcuauuaaaauaugaguuaaucaucuaagaaacucacuaacugaacuucauagugaggaaguaugcuuccuguugauagauaauaaaacagaguggaauaauuugaauucuuuauaauggaugugauuauaaaugauuuccccauuuacucauauaaaaggcuaaauggaagaugauuagugaguucuguuuucuguuuuuccuaaggugauuuuuuaaucuucccaacaaauuccugcgauacagggaagaaaaagaaaaacccauuaaaauuugcuuaaaaucuuuaagaagccauuuaaagcuucagaacugaguaaucuuucugcccccuuaguauauuauggcacaggagagaaaacaaauuacaggcaaccacucuaccuugcuuuaacguaggguuaggauugcuugacaucuucugaucacauuauugugcugcugauacuugucauaaauguagugaugagauucuggauguaaaaauauuuauaauuucccaucucuuguuaucccuaaaaaauuaauauuuguaaugggucuaaauccuucuaaaucccauuauuuaauauuguucugcaauuugaugauuaaagaauuguuauuuuuuuaccuccuuuauccuuaaauccuucacccauaaucuccuguuuauaauugcaggugucuaaugauucauaauuaguuaauucuugguuggugagugauuguuucauauugcaauuaggaagaucaugcauaaagccauuucuaguuaaauguguguauguucuuuaccaggcuuguguucaagaguucuguaguuaccacguuauaguaaucucugaccuuauuuuuguuaagcaaagacaucugguucaaagacccucucucaccagcaagcgguucucauucaaucuaagcauguugaaaaaggcccuuucccuaaaugggcuugggagcaauacuggggucguggcuguccucagggugucugagcgcuucuuugguagucugcaggggaaaauaccaacacugguaaugccccauucagaugcaguauucuguccaacaaggcacaauugccugccugggaauaggaggcugagauaccauugauuguuuccuaugucacuugucaaguggaacacaacacaagugaaugucugcacaaaauguacuuugcuauaccuuucuaacggguuuacaugagggaauggagcucaaacuucacaggauauucuaugcagaguaggucuuacccuagggaugcuccugcugcucucacuccaccuguccuccacccaccaaggcacagagacuccagcaaaugugaggaagaggguggggauugguugaugggcagagcuggcucugugaaaggggguuaaucugaggcaucuuaccuccugaagacuugggugaugggagggagauguuucuggagcccagggcagcuacuguggcauugagaccaccuuagccuggguuggcauggaagacuggaaaucuugccuuuauuccugucuuguucguuguccucugauugaaucucugcguuuuagcccauugucuucccaaagcuugauucucaccucuuccucucaacuccuggccucuguaauaauggagaagccuugggccuggaauuuggaggggaagaaagggagguuaagaauccuuaucuuuuugcuuucuucauuauguggcuuccucgaucuuuuuguacaacaguaagcaggcuuuuaugaacuaguagauauuaaaaaccacaucagugccaacuaaacaaauuauauccaccagauacuuuugagcccucugguaugugccaggcaauauucuaggcauggagcucuaucagugggcaggggguacagguggcaguaauauacagcugaccuuauguucucaucauggcaaagagacaguagagaauugcauuauccaucaguuagggauaaaacaacaaauacccacugcuguuuauuaucucuguccucuuauuuaagaaaggaacucuuggccgggcgcgguggcucaugccuguaaucccagcacuuugggaggccgaggcaggcggaucacgaggucaggagauugagaccauccuggcuaacauagugaaaccccaucucugcugaaaauacagaaauuaccagggcaugguggugggugccuguagucucagcuacuggggcggcugaggcaggagaauugcuugaacccaggaggcggagguugcagugagccgagauugcgccacugcacuccagccuggcaacagagugagaccccaucuaaaaaaaaagaaaaagaaaggaacucuuugccuucuuagagcaggagggaacugaguucuucauagagaacagaucuaaauuauagaagccauuauuauuauuuuucaccauuuuucuuauuguaucacaguccaguugugggacauuguggaucacugcaggcugcacacaggcauuugggaggcaugacuucuuucuggguacugugccuuuuuaaagccuuuggugauuuuauucauacuugcuuucauucaacaaauguuuuccagcaccaacugaaggccagaugcuaugggaggugcuggaaagguauuagagccucaucucuucaggaguucgugacucggugcggggaugcaagagggauucagugagggagacacaccccccgccccuuacaguccuguucugugcugcuguuggaugaaacugcucugcaggucuuaggaaccagcccuggaaaccccaccucccauccccccacccccggugcaggaagggaacuuagucuucauuaugugaccacccacuuauguagacuucccacauuuccccccaaauuaguccccaggagcugaguaaccuucucuuugaguccuuauaacauuuuuaucugaaaugcaaaaacacauuugcuugaaaccuccaugcuaguuuggcaugauuuuagaaguuaccuggcagaaugaauacaaaagaagcaaagaaauuuaacaugaacuuggcauuuucuugcuggcaugaacauaauuauuggaugucauuauaaauaaaccuuuuaaaagucacuuuaaaaauagaauaauuggcuacauugcagagaucaugaaagaucaugaauauguauauaacaguuaauuaaaaaaaacugcuaauauuauuuaaaugggugauuguggcuugggaaaaauuuuucugugguucuuaaaaagucccgugucuuaagcacuucagauugacguaaaaugaugacgaaaaugggucuuggugaugauggagacacucacgucaaagggacauguaaaaaguuaguguaaaauaguuuuaugaaauggagaguggacgaaacuacuuuaauauuccuauacaugaauauuagauaggcaugcauaauuaaauuaauaacguguuuuaguaggcacuuggcuuuuaucuguaucuauaaaaguguaaauacuugagguggccaaaacuugacauuuucucauuguaaugcaauucuuauuuaauccagagucaccucacucauagggacagaaagcauuucuauagagcgggauugguagaagagggguucauggacuacauaagccuccagaaggccaggggauguggucaggcugguggaaggaaaagcacucugcagcuuguucuuagagcaccagguuuauuaaauaucuaagugggcauuuuucuaaacgagugacuuucuucaugauaugugugugcugaauucaaacuauacuuggcaaaguaaugugaguuuucaggagaugggcuuauaauuuuucaugcagcagagggagcaucagcuucucaaguggaugcugagaaguucugugauguuuagagaauccaguuagauggcucacuguuuuaugacauugaaccuaguuuugacugagucacagaaauucaugccgggcucagacgcugaugcuaacaggggcaggggaguggaguagaggggugcugcuuuguggaccuaucuuggggagaauauuggguagaguguugguccccggagccuuuaggguagauugugguccugcgggcacuuccagaaaacagucagcggcuaaccuggggugggcgagggagacuccuuaaaguuagaccacaguccccauucucaagaaacaucccccacucuugcugaagugucccugugcaguuuaggguaguagccaagccuugaugagguuacucugaugaaauguaaguagcauuguagaacuaggaauuggcaucauuuaggaccauuuacccgaaguagaaccaaaauaauuugguauuaauuggucauuaaauagauaaggaaacuuuggcuacaaauacacaucuuggaauuacauggggacucucacccuggacuuccuuugucauagcuuuauuuuuauacacaauuguauugaucaaauucuagaccuuacaagcuccacagcugaauuauuuaauucucucugaugaucgucucaauucauuuuccaauaaauguaauuauuuucuugccagcguucguauuuaauugcuaaguuuucucugauuugcucuaaaucaucuuuuacaaaugcguagugaaaggcagcagguuuucucuucugaugguggcaauuauaaauguaauuuuauuuaacuugauaaccaguucgcugccaccaagggccucauauuuuucuuuaucauauguuugggcacacugugaaaucaucaaacaccaaaccuuuuauaaauuggaugugcaugcuuuuguccuuuucgcuuauuauuguacuguuuaccgucgucuucugugacauuuucucuugccuucagucaauuuuggaagcaggcacauucuucugcaacaaaacaccauuuuuuucuugauuguaagcagagaugucauucccgugcuuguguuagauauacccuuagaaauuauuaaaagcuguccagcugccuagugguuaugugcaugguagauaccucaacuguguuuguuucguuuguccuggauauaugucucugaacucuugcuuuuauugaaauuaaucucuuguuucuguuacugucucugaaaauaacaaugauuauggugcuuuuuaaguaacucacaauguguuuaaacuaugugggaaagagaaugugaaagguauguuauauuuauuuuaauguugccccucaaaaugaacuggaagccggguuuugggaggauuccauuuaaaugcauuuaugcugaccuuuucaugauucucauguuuaauuguauugcacuucagagucacccagccugaaagggacuuagaaucccaugguugccaguugguguaugacugcgccucccucaguggucaaaacugagauuaaaaagaaagggaaagcccuguauuuggaagguuauauccagaggaguucagcaccccucagagucuaaggggcuuccuggugauacggccccaccgcugcagagaaaugcccccagccucccuacuuagugcaccaggggucuggaacccucucucccuaacacccaagaccauccauagcucggucacuccccacagacuucacccgcagccaugccgcagccaccagcaccuaaccuccagacuccugaggaagcuaggcggcuccccugugucaccucggcucugccauccuuuucccugcccauacacauggagcccuggacacgguggcccgcacugcccuugauggagugccuugucccuggaccccucccgugacucagcucugcuccuguuggccuucuugucuucugucucuggucagccucuuuuggucucuccuguggacuuugcuucuugccccuguucucuguguguuucuugaugcucuuucccauggccacucccuggaggcccccacaucuggauucagacccccuaccccucgggccucuugcgccuccuccaccuagccccuuccuucuuuuuuuccuuggcuucuccugugcacccacuuuguuuccuuccauucugcuguucacuccagccucaaucuccacucucagugacuuacugcuuccuucuccuggggaccucaggaaaacggaggauucugacccccacaccuaagauaauaggaaagagccucccucccccaggagagggggcugccccugcccacugccccuggccaaguccaggcuucaggcuggcucugccuuuccaggccauggaugauguuugaaugaggcccugggcagggcguggagauggagugagcccucgaguccugggugguggaugcucuugucuccaggagagaugcugcccagugcuggcguguggacaccgugccauuuagucuuccccaacuagcuuuuccuuuggaggagaaaagauugucugacuuguggcaauacuuuuaguuccauaacuguaaacuuuucuuucucuuuuuugguggcauuuauaaaaauucccuguccuacauaucugaccacauuuuuaaaacauuuauuaguuuggauguucauguuuaaaucacaugauguaaaauguuuguugagacacagcugaaggauuguugaaaagcaacuguagagaagcagcaggagcuuguuuaaggggugggaggugugggcggcaguucuggacagugauugcuguucgggacacugggaugcuucuccuuucuggcuuccugggauuuuuuuuccugggcagguucuauuaaaccuugcuuaaugaaggcacuggcacugauaguggcuugcauuuggcaagacauggcuguuccuggguaccaggcaguggcaccggaacucauuaagaaggugacuaauuucagggccguguuaacauagacugaggcuccaucaugguucccagguguuugucggucgccgcuggagaccauuguguggaucagucacauggucugcugcagugugagugacagacggugacuugcuaucaguaugcaaaggucacccggugacuauuccaagaagugucauuuuccaguggagaaugggacuuuuuuuuuuuccuguuaauaauuuauuucuuaauugcgguaaaauacauauaacauaaaguuaauccuuuuaaccaucuuaacacgaacaauucaguggcaugggguacauuuacaguacaucaccacuagguaguucuagaucauuuccgucaccccagaaggaaaccccacagccguuacagucacucuguuucccccuucacacugccuggcaaccacgaauuuguuuucugucucuacgauuagcuucuucugcguauuucauauaaauggcacuauagaauauguggcuuuuuuugguauauggcuucuuuuacuuaguauauucucaggguucauccauguguuggcaccccauuacuguucauggcucgguaguauuccauuguauggacagaccacagguguuuauccauuuaucucuggaugcacaccuggcuuacuucaccuuuuggcuguagcguauagagcugcuaugagcauuccuguacaggcuucuguuugaacgucuauuugguuuuuuuuuuuuuuuugagacggagucucauucuguugcccaggcuggagugcaguagugugaucucggcucacugcaagcucugccuccuggguucacaccauucuccugccucagccucccgaguagcugggacuacaggugcccgccaccgcaccuggcuaauuuuuuuugcauuuuuaguagagacgggguuucaccauguuagccaggauggucucgaucuccugaccucgcgauccgcccgacuuggccucccaaagugcugggauuacaggcgugagccacugcgcccagccugaacgucuauuuuuaauucuuuuggguauacaucgaggagugaaacugcugggucuguuucuguugaguugacugaagaaaggauauucguuuuauugcucuaucuacauggaccucuccugcauuacuucagugaguugugaagguuggucuggaucgcuuucccucuuuccuuuuugaauugugccuuuagcuguagguugaacacaggugcuaucuuucacguuuucagaucucugagaucuucacuggggaucaagguccaaggaaucaaagcucaugcuguguuugcuccugagcaggagagagcguuguuuagagggagggagaaggggaaugcuugaggucagaaucacaggacagcaaauccgucuugagauuucagaaaucaccauaaaucugugucccuucccagagaagagcgugucaaaaugcagcauucguaauugaagaaagcaaaaucagcugacuaagucguaagaccuaggauggugaagagucucagagugaccaaaaacacacagacccuguucucagggaagcuccugugcaccgacugcaugcucuauagaccccugcccugugggggcccauucaugcuuacaggguacauccucugggagaaagcaugacaaguugguaccggggaaccugagggccgggaugaauuucaggauaaaaagagcagacuuagggaugcugccauaguauaucgucuagauuuguacugcccuauugaaauucaaauaaaauacagcuaaauguuccauuucucagucacccuaccuguauuucaagugccugauggacaccugugcccaguggugacuguacuggccagagcugcuguagaauagucccaucacugcggaaaguucugcuggucaggucuggcuggaccguagacacaggaguggccauagcaguagugcugggagcugagaaggugcccagugcacagaggaggaugagcuggaucggggaggagaggucaggauuugauccuggaaaggugucauuguaguccuggcucugucaucgcucagcaaggcaucgcucccgccacagggccccagccucccugugugcccaccacgggccuggcacuggccgcccucugugccacucagggcaggagagugaggguugugccacacauggguccgauugcuucuccauggcgagaagaggacagacacugggaggaaaaguugaggaaccuugacaucccaugcugcucugucauccaaguggcuuuuugguuuucuaggcauucuuuuuuuuuugagacugaggaucgagcaguucuccuaccucagccucccaaguagcugggacuugguacccaccaccacgccuggauaauuuuuuuguauuuuuaauagagacaggguuucaccauguugccaggcuagucuugaacuccugacuucaagugauccgccugccucagucucccaaggugcugggauuacaggcgugagccaccgcgcccggcagacauucauuuuuauuacaauuuacaaagguauuggucagaaacagaaugaaaauggaaggaaauccuagucuuuccccaggucaugggagaauccuugcuuuaagugucucaugggguggggugauguauucgucccucagggcugcugucacaauacaaacgaggggcuucaaacaacaucaguguguucucucauuguucuggaggccagaaguccaagagcaaggcaucaccagggccgugcccucucugaaggcucuagaaggcuguagggcagaauccuuccuggucucuuccagcguccagggcugcuggcaguccucgaugugcugugguuuguggcuacaucaugcucgugucugccucugccuuccuguggugugugcagcuuugcaucugaaucucccucuccuuuuucuuucuuucuuucuuucuuuucuuucuuucuuucuuucuucuuuuuuuuuuuuuuuuuuuuggagacagggucucgcucugucaucccggcuaaagugcaguggcgugaucucggcucacugcaacuuccaccuuccaggcucaaguaauccuccuaccucagccucccgaguagcugggaccacaggcauccaggcuggagugcaguggcaugaucucagcuuacugcaaaccuccaccuuccagggucaaguaaucguccuaccucagccucccaaguagcugggaucacagacgcgugccauugcgcccaccuaauauuuuguauuuuugguagagacuggguuucgcuauguugccuuggcuggucuugaacuccugagcucaagcgauccuccugccucagccuuccaaagugcugggauuacaggugugagccaucgcacccauggccuuuuuuuuuuucuuauaaagauagucaucauuggauuuagggcccacuguaauucuaauuggaguuuaucugcaaagauucuguuucuaaguucauuuguauucacaggcaccagaauguccuaguccauuuugugcugcuauaacaaaauaccugagacucgguaaaauaccugaguaauuuauaaugaacagcaguuuacuggcuugcaguucuggaggcuggcaaguccaaggucaaggugcuagcauuaagggccuucuugccuggucaucccauggcagaaggugagagugugagagaggaugagagggugccaaacucucccuuuuacaaugacccaguccucccuauguggcugaguccucauggccuaaucacauuauuccuaaaguuccuaccucuuugccugccuguagucccagcuacaugggaggcugaggugggaguaucacuuguccccaggagguagaggcugcagugaguugugaucauuccgcagcacuccagccugggcgacggagugagaaccugucucaaaaacagaaaaacaaacaaaaaaucccacaucuuaauaacuguuacaaugucaaugucgauuaaauuucaacuugaauuuuggaggggacagauauuuaaaugauauuacacagguuaggucuugaaauuuuuuuggcagggucacaauuccaugcacugcauaugggaguggaagggguaugccugcggguggggagccaggggcuugagcuccacucugcauucacuuuuugcucuaccccaaagccuucccuuccccuguccugcucccucuaccugugagugucuguguacccuggccauccucgauggcagugagucugaguauugguagggugggcuagagccugggacagcgaggcagcuggagggugguugaggguggacgggugcacgcuggacaggcagaauauucugcgccauuuugccucguuccugcaucuuucuuccucugcuguccugcacacacuuaucuucuacccacuucuguucccgaagggcuccauuuugucagauuauucagaccaugaauaaaacacaagugugaugugcuucauuccccacucacuguuugcaaaacuauuuuccugcaguucagacccuuaagauacuguggaacuggaccguuuuccugucugucgacuucugaauuuuaaguguuuuucagaaagucuccaucauuuggaagucacgcuuugccuccuggaagcugucuagacaggugaccaguuuucaccaauuugggggcuauggaggccucuuccaaggcucucugcccucuccaugagccacuuuagcuagaugacugugcugguaucaagugaaaaaacaaaaagaauacuucaguaauuuaauucaaauuuguucuugccuagauuacgguaaugcuccuauuuagaaugacuuaauuccuggcaaguggauugugggagguuaaggagagcacccuggcuccagagcagagagcagaagaggguguucuugcugucugugcugagguuggcuaagucuuucucuuuuucacgccucgugcuuuuugcuacgugguuucugcugccuagcuagucaucugcaaggcaucacuguagcccuauccugaugcccugaguccugguggcuucuacucugacccuuccuguucuuuuauagauuauuccauccuugaccacauuuucuucuguucuccugugugccuagcuuuggggaaauaaggaugagucaggugcaggcuucgguugcucauuugaacagugauucugacuacuguuagagaagggauaugggagagaagugcaggggauuuacuuagccaaggcugaaggcagagaaaacggucauugcugcauggcacagcuaccuguggccagagaggagccauggcccagcucuugcugggcugacccaaaggccgaggaauuuugugugccaggcacccaucugugacacaaccacgugggccaggaagcugugugugugugugugugugugugugugugagcaauuaauggacaggauccagagaugcugagagcaguccugcacagugaagacaguaucaauaucccucucccugagaaacccaggagacccguuccucaucaucgauaugcuucaaggaaggcauaacaaauugauuuguguaggaacuugaacuggauucacugaagaaucucaggaaguuuguacuuuuuucaguuugggcuuugugauacagaaacacgcagauacuugugggaacaacgucccucaggcguuaaauugacauuugggauugagugaaccgaagcauuggugguagagauggggaaugcuaucugaaaaaccagaaucagcuuuaaggaagcugauuacaaagagaauugauuacaaaaaguauuuuuggauuuaaaauacauaagauguaggcaguccuaauuuaauaagauauaagggauugaagcaauuguugccaucgucuuucuuuuuguucuggacugcugucacacacaccauagagaugccuccuugagugucuucaaagugcuguggauuuccuuucuucagccgccuccgaccaucacguccagccaucuguccuguuugaucaaguccgcagagugggucgaggggcaccaauuggcagaacuggucuuggugcauuuuccccuaucaaguuuaucuguuuuuccggaggcuguuuggcucuuccccaaaucuuccaaagacagaacacuuaagucuaaaaggaggauuuguggaccauauauauuuuagcucaaaaccuccaaguggaaucauuuuaaugugcguuuucuugagaaauauguaaauuaauaauugcuucauacauuauucaagaaaaacuuauuuuguaucacccauaacucuucuaaucuuauauaaagauaugcuaauggauuuaauuaaaauaauuauacugaauaauguagccugaacuuuauucuaaaauagcaucuauuaaucaucaucaucaguaauauuuuuagccagagagacacuuacaaccuuaagcugauacuagauggaaagugcauuuauuguuuuauuuuucaguuuggauuaaguuggcauucucaugagaucugggacaauuacauuugcuuagagacgaguauaaaauuuauuucugggccgggcaugguggcucaccccuguaaucucagcacuuugggaggccaagacagguggaucacgaggucaggaguucaacaccagccuggccaacauggugaaaccccgucucuacuaaaaauacaaaaauuagcugggcaugguggcacacaccuguaauucuagcuacucaggaggcugagacaggagaauugcuugaaccugggagguggagguugcagugagccaagauuacaccauuacacuccagccugggcaacagagugagacucuaucucagaaaggagaaaaaaaaaauuauuuuauuucuuuaaccugaaguauuucagcaauuagaaaacuuuuagccucuucugcccuuuccuguuucuucuuuucccucuaaagcuuugguuucaguguguucuuguccuuuugguucaguuuugaccucaguuucccucccaagaguugugauugcugaauacgaugaguuccugauugccuggauauuaagaggugaaccaaaucuuaagagggacacucagcagccugccugucuuaauauaaauagaaauaguuuuaccacuggcugugauucucucugauuuuguuuguguuaucuuucuguggcuugcuggcuuuccaucagugcucaaugaaugguugggagcccuuaugcauuuggugguaauuucaguuucuccuuaggccucucucaugccugagugugcaugggacccagguauguguucuuggugugucaguggguccugcacacguguugauugguccgaggacuaaaugcagguagaaucagaccguccccccacugguggacagacgaaagcuuuaccaaguugauagaauaacauaagccaggacuuaaacugccauuaaguuauuuuaccuaaguuuaaaauaaaaucugaagaaauuacuugcuuaaauagcaaacauuuauuugguaaguucacuuauaacuuaaugaacaggcgaagaguaaagaaagcuaaaaucagugacuuccucuaaauuguguauagaguacucuucucuguucuuggcugggccaggccauaaugguguauucguacaguuucaugguccaugguucauaccucugggguuggggagcauaagugggccucacuccaaacucagcucugucuuuuggggacaucccacggacuuuguccuccuucccacuuucgucccucacccccagugaacugauuagugauuaucccgcucugcugcagggaaccuugccagugccugggaggcaccguggagcagauaccugcugagggacuggcauccuggccucucacccacaauucaaaacagcuuugcacauucugagcacaguuuuauuuaaauaaagaucuucacugauuuacaaaaauaacaaaaggcaaacaaaaacaggaaaaaucuucaauguccucaauuucuaucacccugaucuuuuuugugauuugggaacugauucuacucaguauuugccacaaugaagauggcacuuuacaaauggaaguuugcaccgaaugaagauucagguuugagagaugugcacgcugaggagguuuuccaugucaacacgugcauggguccacacgcuguccugccgccacugcugcugguagcuguggccaacgucuguugagcaggagcaaugagucgagcuuaucacaugcacaacacgucauuccauucucccacagccccuugaggcaggcccuguugaucaccacuguuuugcccaugagaagcccgauaggaaaugcuaccuucccaaauucacauagcgagugauggaggagcccggacagcaccccagagcccugaccuugucuaccauggugcugccuuccuuugauggugcugguuagggucccccacaugcauucauagauuuuuauuuuuggaggugucuuucggcagauaagauuccacgcagcaccaucuauccacagggcagauguccccugcuucgucuguugggugcucugugucuugacaagcuauugaggcaggagcuguuuccacucgaaagagaccugaauuuagugaagcagccagacuccacagaggaaacugaagguuuuuccugcaagcacaagcagaauccaaaacacuugaaacucugacaaauaaccaauauuagaaaugaaucaagcuagguguggcucuuacaauaguggguaauggaacccuccugccaaggaaagccagagccugugguaggaaggaaucugaguucccuuugcaucuuguccuugucuggcuaaucaaacuggauggggaagacaacuuuuucccuuaguuaaggaggugauuucuguggcugaaugcagagagaggaaugcuucuugaaaauaaagaggucacgacuauauaugaaguuugcagucaguuugggagucauggagggucgacuucccaauguccucugugaggacagaaggagacaaagcagacugaaauagucucuguccuuaccugugaggagcuuauugucuauggggaauacggacaaauugaccuuccauugcaguccaaauaggaaugucucuagaugcuguauucaucucuuuugcguugcuauaaaggauacccaagccuggguaacuuauagagaaaagagguuuauuuuggccccgguucugcagggugcacaggaagcauagugcagucaucugcuucuggugagggcuuccagaagcuucugcucaugacagaaggugaagggggagcaggcgugucacauggcaagagagggaacaagagagagcgcagggaggugccauugucuuaaaccgccagcucucacgugaacuaauagagcgggaacucacugguuacugcgaggaagguaucaagccauucaucugaaacccuccccuaugacccagacaccucccacuguccccaccuccaacacuggggaucacguuucagcaugagagauggagaggacacacauccaaaccauaucugauuccuaaccuggcaccuguguguccuggacgaaaugaugucuaagcuaaggacugagggguaccagagucuaacuguguguuugggguggacuuggguggggcggcagagcagugacuccagaagagggaauagcaugugcucaagccucugagcuggcagaggggccuggcccaccugggaaacuggaagaggcucggcuuggugggagagaguccugcagguaccaagggugagucuggggugguggggccagagcccauggcccuccaugggugugggauagguucccugugucccaugagcaggggacguugccacaguaucuaaauuccauuugcauuuucagaaggcugcucuggcugcccagugaggaguguccuugaggggucagcguggaggcagggagggcggguaggaggcuguggcagcaaagccaaugggaggcaguagccgugcggcccaggugcuguuuguuccggggggaguuaacagccugaaccgagggcucugucgcugccuagaagggggcugugaggaagagagaacacccggugugaugcccaggccuguggcaugcagcuggggcuuggcggugcagcgccuggcacuggaaucccuagggaaggcgaggcagcgguggcuuccaccaaggcagggggaguuugcaaugucuagggucagccaggguggaccccggugggugugggguguggguguugggcucaggaggaaggggagcccuggagauggaucagaauugggagucauuggcauggcaggaggugaggucccuugugggauauguggagggaccccgaggaacccacaggcaaggggcugggggagcagggcccugcgcagggagcuggaaggaggguggagaggcagguggccacccugggagugagggccacgcgugccccagaggugagguggccaaagugucaucagaaaggccacuugagaacagccugaagucaucguggccuuggcaggaacagagcuguggugcgggccggagucaggcugcagugggagugaggaggggucgugugggaaguggacgcaggccuugcccacacugugggguauuguccgauggagcagaggcucgcagggccuggggcugcuuuuccgggugagaggcuggugugggcuucaugauagaaagcaggaggcagaggggugagaacugaaggcucugaggagagagagaggacaaagggcaggagggccuugagcagacagcaggggaagagguuggagccccacagggcaggcaggugccccgaaaacccaaggcaggggcagagguugggagcuggagucuuguguuugguuugggugguuggaagcuuagcgaguuccuuucuugugguggcuuuuguuuuucucugaaggagguggugacaugagaugggaggggugggggucaggcuugagaagagcaaagaaagacugagucagccacaggggagaguggagaaggagaggaaacccggcccuucaggagaacagguggacccacaguguaagacgugccucuccucauguuucuucugaauuccguucucucuguccugucuuuguucugucacccaggacugauagcagaugcggguuccucccaguucuugcuaaaccucauuuaccgaaagacacaaaaucaucuuggucgguuaagcagaauucugguuuaaucagcauuuugggaucacuggcauuccauguccccgccucagggggcacaaccccuucucugagggugucaucaugacauuuuugaugcuaggagcucgggaagaccacggcagggaagacuuugggagcccucgccccgcuuggcggucugucggucccgauucacacaguguccggcagcccaaggggagccagcagcaggugggccauaaaggccugucuuguuuguggccgauucacccuggugaaaugguauuuaugaacuugcuacaggcgguugaugcuuugcugggcacaguauaaaaugcaugaagccaguucgugccucacccucugggcguucgcaagcgaaacgagagaccgggagacugagcaaucagccugugugaacgcuggcuauuaaaugucacaauaaauguuuucuguuuuuuuucaaagcaacacugagguuguggaagcagaacauuugaaaucagaaugaaauuauuacgauuuagugcucuuuugaaaaguugcaucccaaagcagacgguugggaucuggugggccuugaaggacagggcaaacacugaggugaacaacagcauggaucguucuggaguggagauuuauggggcuaaaguugcuuuauccucuacucuauuuuuggugaaguugaaguguggcgguuuugcaaaauuagcuuuggggcugcacagaccaaccccaaaucccagcagugcugaccugggccaaagacuucacuuucacaugucuccacugucuccuccgugaaaggggauaguaauaggccuccuucaucagguugccauggggauguaauguguccauagagcccagcaccuagaaacuugucugacaggugcagaauacuuacgucauagaugaggcaacaugaacucacuugaaaugacuugaccugugcaccagaguugagacaccagccugccauucuuucagucauuucccaucccagauagcuauggaaauauucccagguaauauauucuuagucacuuaaaaaauuaagguauaggcuggacacaguggcucacaccuguaaucccagcacuuugggaggccgagguggguggaucacuugaggucaggaguuugguuuggguguugaccagccuggccaacauggcgaaaccucgucucuacuaaaaauacaaaaauuagccgggugugguggcgggcaccuguacucccagcuauucaggagacugaggcagaagaaucacgugaacccgggggguggaaguuguagugagccaagauugugccacugcacuccagcccaggcggaagagugaaacucagucucaaaaaaaaagguacaauuuacauacaguaaaauuuauucuuuuuuaauguacagcucugccaguuuugacaaaggcauaaugcauucaucccacgggagggccccugagcccccuguauuccccugcccgcuuccccaccagccacugacaugcucuccauuucuguaguuuugccuuuuccagaauguuaugaaaauugagucacaugggaugcagccucuugcauaugucuuguuuuauuuaucacugugucguucacgugcaucuguguucuagguaacagugguuggugcuucuuguuacugcgucgaguuccauuguaugaauuccccucuugaagggacauuuggguuguuucuaguguuuggagauuacaaauaaagcugcuagagacguccacauaaggguuuuguaaccgucauagguuuccugucccauguacgugccaagucaaugugcugcgacucuggguugcagcagagaaagaguuuuaaucguaggaccgccaaaacaggagaaggaggaaaccucauauugucugcugcaggaguuuggggcuagguauuguuaagguuuucggagcaggccuaaguggguugaagagcguggggugaagggacagggagaugaagaaacugcauugcauugcugauuccuuuccucugucggggguuuucaaaccaguuggcagcagcaguuucccuggaauucaggaucugagaaacaccuuaagcaauucuuaaacaaaagacuuaugauucuaaugucagaaauccuaucugcaggaacguuggggaugcagaugaccaguaucuagugcugcgugacuuuggauuacgaguaagugggcugaagugcagccuguuccgugcuuaauuaucacuguauugcuguccagaguucuuguuaaccuuaugaggaugccuucaguuuuugugaauguagguuuucacuucauuugaggagguggccaggaguacaauggcugggugcuacggauuaugaauguuuaccuaugagaaacugcugaacucucuucuaaaguugcugaacuauuuuugcauucagacuagcaguguuauacaaagagcauguuguaggaauucuguuuuguuuucaugauucuuauagauguugcuuguaucuuauugucauuuuaauuugcauuucccugaugaguaauggugcugagugucuuuucaaguacuuauuugccauccaucuaucuucuauggagaauugccucuucaucucuuuugcccauuuugcagggaggggaagauuguuuucucauuauugaguuuuaaggguucuuuguguauucuguguacuaaucuuuagcagauauaugaucuccagucauuuucucccuguguaguucaucuucuguuaucucaguaguaccuuucaaagagcagaaauucuuuauuuugaugaaguccaauuuaucaauuuuuucuuuuacacauugugcuauuuguaucauaucuaagaaaucuuugcuuagcccaaacucacacguauuuucuuccaaaaguuuuacaguuuuugaaguucuacauuuaagaucggugaucuauuuaaaguugaguuuuguacagugugagagaggagggcaugaaguuuauuuauuugcucaugguacuguguaccuuuguuacaaauccaucaaccgucuguauauguucaggggaauacuuuugaagugaguuucugccuacuugcuuuuggagaacaauuguaaaaauuguuucuguaauugcguaguauuuuccaguguucaaaguguuacccuauucauuuuccaauuugauuuugagcuuuauugcaauuccuugaaguaucuggcgugaauguuauuuucccucuuacuuaaagacacagguagaagguggcagagccagagucagaucacuuaaaaucuggcaacuuuucccaacagaagagagcaaagggacucagggucugacuuucccccgacugaauuuaauucuagcuuaguucaguacuagcuuugugaacagggacaaaguaauuaaugucuccauuguugguuuuuuccuccuuccuacucagcuaccuucuaauaggaggugauaugguuuggcuguguccccacccaaaucucaucuugaauuguagcucugauaauccccaugugcugugggaggggaccugugggagguaauugaaucaugagcagcagguuuuuccugugccguucucaugauggugaauaagccuccugagaucugaugguuuuauaaggcgcaauucccuugcacaaacuuuguugccugcugccauguaagaugugcuuuugcuccuccuucaccuuccaccaugauuaugaggccuucccagccauguggaacugugagcccauuaaaccucuuuccuuuauaaauuacccagucucagguauuucuucauaguaggaugaaaauggacuaauacaggaggucuguaagaauuaaagaucaaauauacaaggguccuagcacagugugcagcaugacaggaucuaucauuaauaucauuacucuguuuuuugaggguguuuguuuucuagaagauacauuacuaaagaacaaaaugauucauaauuaaaauauaugcagauauacaggaaaacauuuuuggaauggaacaaagacaguugacuuuaaucauugaauguagaagaguugaagugaauuuaauggaagaggauuauucugagggggacaggucuucauuuugcuuuauccucacagagcucugcagggguaaaaggagaaaaucacaugcaugcuuagcacacaguauaggcacuuaggccacaggugauaaguguuggcuucuguuaauaauaauuuuauuaugugucaggacaaccugugagaaguuagcauuguuugagcauucuuuguagguuagagauucauuuucuuuuuugagacaggaucuugcuuuguugccggggcuggauugccaugcugugaacacggcucacugcaaccucuacuuccugggcucaggugauucuccugccucagccuccugaauagcugggacuacaggugcaagccaccaaugccuggcuaauuuuuuuuguauauuuuuguaaagguggaauuucgccauguuacccaggcuggucucgaacuccugagcugaagcgaucugccugccucagccucccaaagugcugggauuacaggugugagccacugcgccugaugacuuuuguucuuugcucuauuuucaucguguuagccgucagccccucaucuggaagugaucuuucucuucucaguauuucugcgguucuucucauaaggauuacaaauugguaugaacacucccuaaccugcaugcugcucagccuucuuguuucuugauuugcagggggcagcacugaaauacuuaccaacgaucgucaacgaugugaaauugguguuugaucccaaagagcucagguaaguaugcagcccaggcgaaugcuugucacgugccgugugugaccuccuucucagugugcuuaguuuaugggaugcucaggguucugccucaugucuccauaugucagugcccuggaucauucuggaacauguguugcugguggugucugugacucuuugauaaucaugacauuauguggaaaagguaucaccagucaacuaugacaacauuuuuuaagaagauuguuuacagucuaauugguauauaauguccauuuggcauuuugcauacuuugagguuugaauuucaguaugugguuguugguuuugcucuuguuuucagcaccuaaaaauccugacauaggagcuuuaauauuccugcgccggcuucugcuucuguaauagaggcaacuccucuuugggaggggcccugagccucaagcagaagacucagaaguuacuaagaaaauaauuuuuagaaaaccccacaaacaaacuuugagaaagcuggucacugggcuuucagaccaaggagugagauuggacaccaaauccuuccuuuucucucccuaacuugccgccucucaguggccaggugugcuguuuguuuccuaaucuguugguaucacugcauucugaaagugccauugugagcaaaugggauacacagccuuuuuaauuuauuuuuuaagagauaggggucucacucuguugcccaggcuguagugcaguggcgcgaucauagcucacugcagcuucaaacuccuggccucaagcaccccucccgccucugccuucaaagcacuggaauuaccgacgugcgccaccgcucccaccccagggaugcacagucguuuaaaccccagacauucaauagcacaguccucaacuacuuuuuguuuugguuuugauuugacacaauaaacuaccugugggugaagacaccauuuuuuaccggccaaugaagcccuccuaaauauuaguaaagggccaucuguccacugagcggugaaacggaauaaaaaaugauuauccuuccuguacuuuaugucuaccauaggucacucgugcccuggaauugaagggcgaggggcucucugggaggcgcugucccccacgaaucauugugaaucugauguucccuaggauuuaguguccugcagggaaacauuuauuuucugcucccagggcaccaacagugcuggucauaagcuuagcagguccuacaugagaaaaggagaaacacacaggcucacgggcggugucugcccaccuggcgcgcuguagaguccucuccuuggcacaugcuucuccaagagcgggccccaaaauggcagcuccgguagcccuugggaacuuguuagagaaagccaaacuuuggcuuccuccccagaccuucugaauuagaaacugcacaguggggccuggucauuugauuuuaacaaccucccuccccgugcaggugcuuccagggcucucucauauuuuaguagcucaggucuugaaaaacugagaggaagcagagaaagcugcaacuggugugggcuguggccauacucuaggccugucucauggugcacacagaucagcuccgcacccgcggagggguaucgucgauacucucaguuugcgcuugagccgggccuguccucacuguacgcacaaauuagccccucaccgauggaggguaucauugacgcucacaguuugugguugagccgugugcuuggagguccuaggaagaccugcuuggccagggccgaugcaggcugcugcuggccucucucagauuugugcaucccuguguuccuccucaaugccuguuacacugauuuuuaaaaaugacauugaaaaucacauacauauuuguuucuauuuagaaaauugguucauguuuuaauaaacagaagagaugacagaagaggguaacucaaacuuaaguccacuacccaaaagaaucagaaagugcuggaucccuuacacacauacguacacacacacuuaaaaaagucaccauuuuuugguuaggcauggugacucacgccuguaaucccagcacuuugggaggccgagggggacagaucaugaggucaggaauucgagaccaaccuggccagcauggugaaacuccaucuccacuaaagauacaaaaaauuagcugggcaugauggcgggugccuguaaucccagcuacucaggaggcugaggcaggagaauuguuugaacccagaggcagaaauugcagugagccuggaucgcggcauuguacuccagccugggugacagggcaagacucugucucaaaaauaaaaaaaagaaaagucaccauucuuugugaucagcuccugcacuuaagacaucuuccucucccaugccacgagggcaucuucugcaucaucauuguuaguaacuuucaugccgauccaucccaugcuggccuaucuuuaagcagcaacaauagacgcagcaucuauuaugugcuuucaccauguaaaauagguuuugcacaaagcacuuguauuaguccauuaaucuuuacaacaaugguaugacauagguucuauuguuagccgaauuuuauccucaauaacuuguccaugauaauucagcugguaaauggcagugguucaaggccaacccgggcuuuuugaauacaaagaacaggccucuagcuacugugcuaccugauggcuguugaguuguauucaaguuuuuuuaaaaaaaauauauuauaaaaugcuaggauaaaauuuccuguagcuuaauuguaguuucugcuccuauuuuauaucauuaggauaaaaagagaaauggcauuacuugguuuugcauuuucuuaaaggauuuucaguagauuuuaucuacucgucccccuccagaagguaaaaccaacauucuaccaguauacguuggugucuguuuucccaaaauauugcugguacugggaauuaccauuuuauagaaccuugccaguaugacuggugaaaccguaucugcccauuuuaauuuguguuuauguaguuacuaacaagagcucuucuaaaauuucuucauaggucuguuagccuuuuguaaaaguguauuuuuaaaaaauugcuuuauugugguauuauuuacaaacgauaaagucaccuauuguagacgguucaauucagugguuuuuaguauauuuacgaagaugugcagugaucaccagaguccaauuuuagaacauuuuuauaaccccagcaagaucccaguguccauuucuggucauuuuuccuuccuagcccagguaaccccgaaucucuuuucucucucuacacauuuguguuuucugggcauuuuacagagcuggaaucauacaacguguggccucuguacuggcuucuucuacuuagcauaaaguuuucaagguuucuccauguuuuagcaucagugccuccuuguuuuuggaaaugaauuguguggcuauacugcauuuuguucauccauucauuaacugauggacuucguguuuuuuuuacuuuuucaguauaaugaacaaugccacuuggauucauggacaaauuguuguguggauauauguuuucauuuuuucucggggaggugguauaugccuggaaguggauggugacuauguuugacauuuugaggaaaugccuaacuguuuuccaaaguggcugugcuguguuaccuucccaccagcuuggugugacuguucucauuucauuauaucuuuaccaacacuuguuauugucugucuuuuggauuauaggcacguuagugauugugaagugaaaacgaacacuuucaaaacaucauuucuuggaaugaguuauugaccccauagugcaugagaggcuguguugaacauacuggugacauuaaugaccaugugaugaccuauaucucaguauuguaacaacauuggauccuuuugcuaugugucucaaaauuauuucccuuguguuuuuccucacagcaaaauguuuacugaauucauccucaauguucccaugggcuugcugaccauccagaaacucuacugcuugaucgaaaucguccacagugaccucuucacacagcauggugaguggaaccccaagaauuauucacuuguccuguuauuuauuuucugaagacauugacccucugaauugccucuucuugacaaaaggaguagaggcugcaaccaauuaaaacugcuguauuacaagacaggaagauuuagcccuuacaagagaaggguaauugacauguaaugcagguaauagaucauugagaaaugaaggcaaaagcucguaguuuguaauuuagguauacaccaaaguccuaggguaaucagcauacauuguagccuuuaagauaugugguugucuguccuggggaggcaaucacuucgcuccauugugaugauugcaaggaaaagaauucgaguuuucuuuaaaucugaaaguaaugguuuuaucuuauucugaacuuugcauucuuugacagcauuucuucaaauccuacucaaaguaauaagaauuucaaugauucuucaacucauuuauccugcagaacacuuuauauuucccuauguuaucucccugcccuuuuuaguaaucauuuuuuuucuauuuggacagauuaaauuaauauuuuacccuugucaagcaguuuuauugaaagcuuaaaaccucugcauaauuccacaaacuuccucauuuauuggaggcaaaugugaagucuguugagugacauucugacugagaagcauggauuuauucgauuccauuugugccuggacauuuggcugcuccauucauuuucuguuguccucauucuugguguuguucucaguuccccugugcuuucacggaucccagacuugggaugucccuguuaaguuacgggcuggguuuggaacacacucugugcuuggcuugguccuuugugccuucugggaugcgaauuuuaaucuucuuucuuggcuuaaccuuauaaaaugcaccagaguguacacguguugcuaaggcuaauauugaaagaaaauguugacuucauuuaggugagaguguucuucucuagaaaaaaacacaucaaaccaagaagugggugacuuucugcagccccuccauguagaccucucucuuuagucagaaaccacuucuuacuuucauaaaagaaagucaguucucaccauggucugggacucaaagcacaugacgcuccauugagcuauuauuccugacuguccauauuucaguuucucacuggaaacugaauugcccacucaccagguguuuuccaagacuuggguacucuagggggcuuaaggaaaggcugaugauagaggugauggccaggcacccugcuucaggguuuccuccuacagugaauaagcuuuguaccacagcaaguaaaauccuccgaaaauuuuauaucugggucuuauuagguggguuacugaugcuccuaaccauucaaugccaagacacacacagcgacauacugcaucaccagcacuaccgucaucaguaucuucaucaaauuaacagcugucaaugagugucaaccguccaugaauaacaauuguuguaaauugucgaugaauugugcuugauuuuucuuaaguguugauuuaacgaagaucuucuucaggauauauuuacauauauuuuuaaauuucuguugcaaaacuuuguucuguaugucauuuaguuucuuugaauaaggauguaagccaugaaagauucaauuagauuuuuuuuuuuuuuucgagacauaguccugcgcuguugccgaggcuggagugcaauggcacaaucucagcucccugcaaccuccgccuccuggguucaaaugauucuccugccucagccuccugaguagcugggauuauaggcacccaccaccaugccuagcuaauuucuguauuuuuaguagagaugggguuucaccauguuggucaggcuggucucaaacuaccgaccucaaaugauccacccgccucggccucccagagugcugggauuacaggcgugagccaccgagccugaccccagauauuuuuuccucuauuaaaacuugcucauuucuuuaggucguagaaagcuugaaggaaacuuacuguuuauauucgaugauuuuguuagcuuagguguuuguaauuguguucugucccucuuuccuaugccccauuucuguuucauucuuguucucuaagccuuuuaucuuagacagccugaaguccuguuuuggaaguaugcaggaugugaauaacugcuuagcuuuguuuaauauggaauuaccaggucauguaauauuuugaaauaauuaaccugcugucaucuuuuuaaguacggaauuaggauuuugaucuuaguauaagcaaguuguacccaauguaguaaaugagguuguaugaaauauaugaaucccaaauuauugugggcuaaaugaaccaaaauuagcccgaagcuucgugucuuacaagcagccccagaauugccccaucaguagaaguugucuaagcuguaacuggcagcucaaauguacuucuaaaugcuuagugguugccuagaagcauuucggaaugcuuuggccaacgugaaaauggucccauuuacugucuuugaguuuuaagcguuuuucuuaaaacaaccuguuuuucucaucugcaagcucucugcuuguucaaagcagccaacagacaucuuaccuccuggucaggagagauuuaucaccagaaaucuuccaguugguccauucuuacaaaagaugucauuacuuuugcaaaauauucugugccaccuuugguauaacaauuuaaagccaaacuguuuucugaugagacauguugaaucugauuuucaugcuuuuuuccuguuucuuguuaauuuguacaaaugugguuguuuuuguccuguuuccugaucccaguggaaucagucaaaugaacucucuuuguguucagauuucuagaacuugguauaacuggauuuagcugcaugugccacugaaugcacuugcccuuaguaaacauccucuggaggauguguucagaaugugucacuguauguguccuccaggcuccuucgugggggcucccugggugaagugagauucccaagucuuugcuucucagcuuguguguugccuuacucacugaaagagacccacugguugcuuugcacuaaaacauuucuuuuuaucuccgccugauauaaugacaaguagaucuguuugcaagaggcuggcagugaauucugaaacugguguuguuccucugcagaaaagccuuucguugccaggucugggucccaguaggccaggccuuacagugccuugguuguuucuggccuuguuuuccccauuucucucucuuggagaacauggaaaccguaggugcauccugaguuuguugggcuucauaggaggcacgucuuugggcuugucaaagcaagacagcucugugugguccaguccaugugggacuggccugaaugaggacaccaggccugcgucacugcggccauuugcucacagagcauucagccuuccucugcccuucuguucuauccaggcccucaaggauuagaugauggccacccacacucugcaggauggacaugcuugacucagucccccaaucccaaugcuaaucucugcuggaaacauccuuacagacacacucagaaauaauguucagccagcucucugggcauccguggugcagucauuuggcauuuaaaauuaaccaucacagaguauuucuuccaagaggccugugauugcccugcuuaaaaagcccccuacaugccaccucauggcuccucauggcacgccccccauguggaaucauuguauuucuuacuugcuuauuuguaggccuuccauaggaugagaacuuuccaagcugggccuuguucaucuagauuuugcucuucugcugguaccuagcgcaugccuggcuucagcaugccuguaauggauauuuauugaaugaaugaaaugcuuauggguauuccuaaccaggaggcaguacagagaaagaagcaggaccagcuacacacauguguaguugacuugauugaagggagguaaagguuuggauucacauggggaaauuggcaaucuuuccuugucuuagcauugaaugaauugaucauaggggagaaaggagaggucuuagaggaggaguaacaucaggagcaaagggagagggagaagagugagagacuugaggugugaagagucuucucugagcaguuuuauaaaaucaagaugcucuucuauuugcaucugaucuaaucauuccuguuuucuggaaauaggaggggggugcaguucagaucugugcauucaagauaccuuuuggcuauaccuuuggcuaaaacuauggaaaauuucaaauauacaggagggcagagagaagagaguaaugcaugccaguguacucaucacucagcuccacaaauuaucaacucaugauccuuuuuuuucuuucuuuuuuuuuuuuuuuugagauggagucuugcuuuguugucaggcuggagugcaguggcacgaacuuggcucacugcaaccugugccucccggguucaaucgauucuccugccucagccuccugaguagcugguacuacaggcgcaugccacuacacucagcuaauuuuuguauuuucaguagagacgcgguuucaccguguuggcugggauggucuugaucucuugaccucgugauccacccuccucagccucccauagugcugggguuacaggcaugagccaccgcgcccggccaguccaucuuuucuuaucuauaugcccgucccccagauauuuugaggcaaaucucugccaucacagcauuccauuuuuugucauuuuaaauguauggugguaauacagagggcaaacaguguuccuaagaagagguugugcagaggagcugauccccaugcugauaaggcauccaccuuggauguucccaccccuggcccuuugcugagguagagggccugugaugcauuagcauacugugugugagucagugaaugggcagugugugugagagucaauaggcugugauggcuuuaagcuuugucucgccaugugacuugacuacuugaaagcugguugauagauuacaugcuucaccaaaagaugacucuugcauauaaucugugguguggagugagcagauuuucaaagcaagauagauacaaagagaaggaaaagucaaagcuucaucauuugugcauuuguagcuuuguuuccaugugauuauauuguugcccacauagcugacaaaagcugugaaaauuaaagcuuaaaucuuauagaaaugaaaaguuuuaguguaauuaaacacuagaacacugacguuuaggauuuaagcucacaaaauuguguaacauuaauguuauagaaauuggaauaaaaugaaucaagcugagcuaacauugacuuuuaaguuaguaaagagcauuggcuauacuuguaagaagccuuugaguggaggugagaguccuccuggaacauguucucucacccacuggccccuuucugaaucugacagcuuugggaagcuuguuucaaugaacacugggucacuuauuugcuuugcaagguauaauuuuuccauauucccauuucuauaguggccaaagcaguggacagguuuucuuuggagcuuacuguguacuuaucauuuuguccucacuuaguuuguuuuggaugggaguaugagacuuugagaguaaauuuuagugguaaggcuaccccuuuuuggucuugcaaauaguuggauacucuagauagauugcuuuucuguaagccugcucuguguaguuuucuguuugucuguuuguuguuuuucuggugguuggacucuggcagugaguaggaaugggaaagaggccauucccucauacccuggcucuccuggggcuccucccuucacuauagcaaacaggcuccuuguagacaguguucaugagucuuuucaaacuucauuugcuuucauuuuugagcuucuugaaaguguaagccugguaaguuuaaauuauuuuccuuauucuuauuuucaaggugaaugauucuucuaguuaucaagcagaguaaaacucuccuuuuuaaugguggaaacauuaguuacagcagcccuuugaaaucugagggcaaaaucccagacacuuacugggacuagcuauuaggaaauauugaagucagauuucuacacuauuaucauugugauuugauccaugauagaaauuuauaucucaaaaauuacccuauuaauaaacuuauuaugccuuaaauuauagaaaaguugcguguuuaaaacaaacccauaauauaccuucuuaauguuuugauaaaagcauuuuugauuaaaaaaaccaaaauaaaaucucuugagcuuuacuguuguggaaaauagaaauauaucgaaagggaucuuaaaccuggagcuacucugcaguaguuuuguuaacuugauagauguugugcagaaggaaaaauugggguuggggucaauuuugccacauucacuuaauguaccacucauauagcauucugcaguacuuuaauuagauaguugugcugaugacuucugaugaacgguaccagcugugaacccugaagacugauucuuuuaaauaaugguggaauguaaacaucauuuucucuucuguuucuuucaugccuugagaaaacuuuuuaucuguaauacugcaccuuuuucaucccucauucuguauaucauucucugucuuucauuauauauguuuuugaaaagaccauuuguuauaacacugcaggauuuuagaaaugacuuauugaauguaggagggugaacucaauuucagguuuuuaauuguuucuguuucaauuccaucauaauucauugaauaucuuccgugugcucagaaccauugauuagcgaguuugcuuccuuugagagucuucagagucaucuacuuaaaaauguagaauuggaaaagagugauuaucucaaugcucagauaaggacaccagaguucagccagaagccuggcagggagcuguccaccgccguggugcugauugaggagguggcuucuuacaaaucuaucagcccacucuuuucuuaaacuguuucacacccaccauaugaguaaugcauucugaaaacugaauuuacuucaaaugccauauggagcaagacaaaauacaaauaagugaauaaauaaacauacaaauaaauuaaauguauaaaguauacaguguugugcuuauauguucauggaguuuuaauaguuuuucucuucuuucugugugggaccuuuaucugugaucaaauugguggugccaacaguuuaugguauaguugguguaaacuuuaucaucgucuguugaguucugcugucacuucugggugggcuucuguuccuguugcuggauguugaaugcaagaagaacgaucugagaagagacuguguugguugugcuguauuuagucaugugcacacugggcaccaggaaagcaagucccugagucucuuuaguacaugauuucuucuagcuccugguagcugauuucuguaacugcaugauguguugucuacaguaacuagccugggacaguggaaagagccccaggucagcaugcagucuccuagguucugcuuuaggaccucugucuuuucuugggcauaaacuccucccugggugcacaguccuuccgcuaagaugaacugcaacacaauauaggguuuugacauauguauuuuauugucagagcaaccaggaggggaguuugugcaggaccacaugggccaagaccuauguuuuuuugcuaccuuuauucuccugguuuaaaaaauacccaccauuccacagcccuguauauucucucucaguuuucucauccuccauguggugagauccugccugcagacugacagcccuguaaauucuuucugaacuuaacacaagccacauccuugauguacccccuuccaccuagaaaacagacuuccugccugaccaauucuucucacacaguguuuucugcauuuuucuugcaucuugccaauuuuuucaucuacugauaaaugggacucauuugcaauuuuucuccauuggcucuucuuuaauuucuucccucugacaacuuguuacuaacagaguaauggaaguuuaauccuuaguuuuccagaguaaaagauacaaaauaucugcucccccacugccuuccuuuaaaggauggcucgcuuuuuuacaaagccuugugccgauguccagaaaacauauauuugacaaacuucuuuuuccuguuguucaauaguccacgugcuacugugcccccuccuuccaauuuccaacacccuuuuacuugcucugucaccuuuucauuucaaauuccaugauacugaauaccucaagagugaagugcagauuaccgcauuucuaacaauuucagcccucugcccaguggcccuguuccagucagaacacguaaaagguacugucgggcagcuuggaacagaaacacuguacaggccauuuguguuuacuccauuuuacagacuaggaaacuaaggugcagaaaggaaaagugaccuaccaaggguaacuugauguugauuuauucucugguacugcuaacuuucaugacuuguuagguuagaaugauucuugaaaaauuugcuuugcgucuguuauguaaaaaugccugaaucauacagguuuacacacacguguaccugcauggguccuuuacucugggggcuccagcugaggaaucaggcuuuuuuuuuuuugagacggagucucgcucugucacccaggcuggagugcaguggcgcaaucucggcuuacugcaagcuccgucucccagguucacgccauucuucugccucagccuccugaguagcugggacuacaggcgccugccaccguggccgacuaauuuuguuuuuguauuuuuaguagagaugggguuucacugugucagccaggauggucucuaucuccugaccucaugguccuccugacucagccucccaagugcugggauuacaggcgugagccaccgcgcccggccggaauagacaucuaauaauucugacuccgauggugcguagaggugcaguccugaaggucccuucacucagcucccagcucccacaucugugaaguguggggcuaaggagauggcucugcgauuccuuccagugucggcaccgucuucuguauuucuguuguuugaagacuugaauggagggaggaaagcacgugaacauguugaaaccuguggguccaggauucuuagaugguuggaaaauaagacaauugacuauacaagaugaauagcaaacaccccccauguauaugauucuuacuguuuaauucuuaggaaaaguguuauucuggaucucaguucuauguaacacagaguuauuaaaugcacuuuauggaucauuuauuuaaugugaccaaacuaaaaauuaagaaguacauuacucuguucauaaaaaugaauguuuucaauggacaaauucauucuuguauuugcaucuugcuuuaauguagagcuguaaugggguuauggucagauauucugcuugggcauuuauaagcugauaaugcuuauugaauaccuuuuauaaagauuaauauuuuuuacucuguccucauuaccagagcauuaaucauccuggcuucggcccuugcagcugaggaugaacagauguugaauuauugcugucuguaaucauuguggaucacacuggggaagggccgugaaaggguggcuggugugauccucacagcugauuugcauggagccuggcuaccuuuauagcucugugcauggcagaggaaaccaggauagcugugccagcugauucuagcuuccucguaggucaccguagccuaagucagcacugacaagcacuggcgguccuggagucacguacgugugacagggugucugauaagagagagcuguggccaugacucugcuuacaauaaaugccaguucauaaaaaugagaagucacauacaaggucuuuaacaucggcuuucuagcauucucugagacugugcuguccagcagaaauagaaugugagccguguauguaauuaaaaauauucuaguugccacauuuuaaaaaaugaggcaauugaugaaaugaauuuuagcaauguauuuugucuaaaacaucacugcaacgugaauucucucuaaauauuacuaaugauacauauuuuacauucuuuuuaugauaugaagucucugaaguccaguauuuuacacuuacagcacaucucuguuuggaugugaaauuuucaccagacacuugaucuuuauuuucaucauugaauauaauuuaccuuugaaaaaugagauucacauaccccaauuguuccaaacauugguuucuaacaaguaaaucaaguagcacuuuuuacauuugaguuuauauuaauuacaauuaaauaacauuaaaaauuccuuuccuccauggcacuaauuagauuucacaugcucagaaguuuccauguuggguaucacagcucugagguauuaguuuucuuuuguguccuuuuaguugaacagcugacuuuguauaauacuauaccuucuguuaaccaccauuuguuguaggcucauauuugcuaaauacacacaucguaucauuuaguucucagucaaccugggagacgaccaacagcauccccauuuugcacauuagaaaaauuaagaccuagagaguuuaaguaacucuuaaacgcucuagauacaaagcaaagagccagcaggggggauugcauuauuucuuuauacguguggguaaacugauuaaaaggcuuuccccaaaucccauaaagugacccagguuccuggacuucuggucaaguguuuguuccagaguauucaaaagaugauguguuuuucuuuaaaauauaagaccccuccuccuuuuuuuuuuuuuuucuccugguggauuauuuguuggcuucccaggccaucuguuuuggaacuaaugggacuaucagugccaaaccuguagaaaugacauuuuguccaugggaaaaguauucaggacauuuagguguguuguccauaggaagauaggagauuccucuuccuuggcugccagagacagcuguucaugcuuuaagauaggucauuguaggguauauguauaugugugugugugugugugugucuaucuguccgucugucuguccaucugucuguuuuuguaguauacguuccucagugcucuugauuugcuaucuuaagacaaaauucaagagucuuacuguuacuuaaaacguguacucccaccacuucuugaaaaaaccuaucuguagacagaaauauagaguaagagaagucccuuaaaaaaugagguuuuaagaaauuuauguuuuugcuuuuggggaaggcagcugaguggcuacuguacuggauagugcagcuguaaggcuuuaguuuucuuuguauauuuuuaguugaaaaggcugacuuuguauacugauauuuguauuauuguuauuaacagcuaccauuucuugaggguugagaguggcagaccugcuuuuaacugcagacuuuaguuugauaccacaugugcguaauugcaaguuaauccaagacacacacacucauaccaccacuaucaucaggccuugguuuaugugcuuggauaugccauuuaagaaaaauaggaaggcuucugcucuuauggagauugcauaucagcaaggaggaacagauaauuaaagcaaucaguauuucaguguuccgauaacggggcauuggaggccuuccuguaccuggguccagugggggcugugcugaggccagcagaucacaggucaccagggaggugcacuccuuggcuuugcugccuucagcuucgguccucccacccucuccuaguggcucuggggaauugccuuucuuugggggccugggauggguugcuguggaccaggugacggacgguacuguaaggugccauagccugugugacccucugccuggaggcaugguugaaaucccuggcaugggcagacugaccuuuggccuuuagggaaagagccucguugccagccugguccuccucagugaccugguucuguuuuggggucgggguggaguuuccugaugcugauggugccgggggagaccucucacugaggcauguuggauggcuuuuuacacaguccuuccucaagcagcaucucauuuugucucgacaguuaaaguagacaucgccccaccuccccacuugaucuugacuggccauggauggcugggucaugaaggcugaggugcaguuggauucuggucuaucaggaugguuauaacaauuuuuuuuuuuuuuuuacaucuucuugggggcuuagugaaugaaaugucuguauugggacaaaaugacagugacauuucuaaaaguuuuguuguuucucaucaggagaggcuggauagcaaacaggugaagguagcgcaguccuccaggugggguggauggugaacguuaccaccagguaaccaaagaugguugauagcauccuccagccaaagaugaacagacagacaccucuuucuucucaccagaguaauucuaacaaaugagaccagcacacucaauuagcucugagaauagcacagaucacaacugccuacccagcaugacagauaaauggugcggugagggaugaauuuaggccaggacaucuggguaccagagccuacagggccagcucugcuguuucugagcccagugcuauguuccucugauuuucuggaaucacuuauggacacacccuccuuccagccuguacuggcugguccguuagaccuuuucccucucuuggguccguccuaagcuugcuucagaagacggcuucuaagcuuauguagucauuuuuuuccuuagucacauugucaggggcugucauuaccugcucaggucuuagugguucuaacugcugccucugagguuucuuggaaauucagcuuguuuuccagaaugguggcagugcuagggaugaccaagugacaggguugggccagggcucuccccauguugagguuggcacagugugugauguguuuccagccaaagggcaagaggacucauuugggagauauuauggugggcaccacgaggaagagugcuggcagggcggggcucagauaagggugugcugaggaagcauuccagccagcugggcuagagcauuuggaguuaaacccuacgucggaugcuguguugugguuaaggucagcagcucaagagucacuaaaguuggauguaguuuguaaacaucgagguucuauaggaaaggcauugagauuuggggguauuuguggaaauagugugucccauguguuagcguuuccaggcuggauucacucccaugaggucauuuucuuguucauuucucuuagacuggcuuuguucucggguggcucuaacacuagggcagucuccuacacgggcagcccaucuuggcacugugcucucccucacugacauccugugggauuccagacaccacagccuucgaggcugaccuggccucuuuccagaagaugugcagcucuuagcacgucauacauuucuucugccuaaguguugacuacuggcauugugaaauuaacagguacauucuuauuuuccuauauuaauuggacaaaacuucuuguaaaaauggaguugcucucacuccuuucuuggcgaaucaacaaaaaauggaauuggggaaggccuuggccaugagccgcccacaugugauccgcuggagacaggggaguagagggguuuguguuucuucucagucuuuguuucucucugccugcuccccaguccuucauuacaguguaguucuugggaaaguucuaagugugcucuguguacuuagaggaaccauuccaauguugcaugcuuauaguuuucuuauauaaaagaaacauuaaugcaaaacauguuuuaauguaucuuuaauguuguaagucuuaaaauauaaaauccugaaaaccggcuaagucuguuuaagguuuuagagcacugcugucuccucuugugcucugcguuuaaaggaaacaagaauggcugggcuagugucaaaacacagaacugguguuguaaauagauaguccaugcuggagaguggaugaugcuccagcuaagcuggauuucccaacuggaagagacaauuagggauugcauuucaccuuucauuguauuuguaucuguuucccuguugcucuguuauuuucugaacauccuuccucugcucuuauugaaagaacaaauggaaacccaaaccugcuuugccucugauccuuacaccauggcaucccuucauuuuauagccaugcgucccagaguggggccucugcaccugcuuuucauuuccuguuccuccucagcccacuccaggaagcugucuugagaaggauucugugugccuuaaauugccacauuccaagauuggcaucuucuaccuaggagaaggaaaucauacuuuggcucaccuuggcauagaugagaaaagcugcaauucaaauaauuuguguuguaggaaguauuucuuuuaauguugcaaauuagugaauuuguaguuagagaaaauucauuaaaaaacccguguguggcuaacauggugaaaccccaugucuacuaaaaauaaaaaaaaaaaauuagcugggcgugguggcaggcaccuguagucccagcuacucaggaggcugaggcgggagaauggcgugaaccugggaggcggagcuugcagugagccgagaucacaccacggcacuccagccugggcgacagagcaagacuccgucucaaaaacaaaacaacaacaaaaaacaaaaaacccauguguguuugugucugcauuuaugugcacacagugggauauaaguguguguguguuuauauauaucauguaugcuugcaaauuauuaucuguuuaccugggauacacacauagaugcauggaaguguguuuguaugugaauuauuuacaauaacagcagacacgguguucucacagucaaguaauugaccccccuccagaugucaguuccacguguugcacaacgugaaugcaaacugcuugaaagggcagacaagcuuauagcaaacacgaguugcgucuugguggguuucacacugacuggcaaugcuguguccuguguagacugcagagagauccugcuucccaugaugaccgaucagcucaaguaccaucuggagagacaggaggaccuggaggccugcugucagcugcucagccacauccuggaggugcuguacaggaaggacguggugaguguuggcucugugcgugacguccugccauuugccugaaccugccauuugccuugcaguacaacuuuauucaguuaaaaaugaaaggucuugauuuuaaggucuagccucucuuuuugucucgguagaguugcacccuuaaauuauuuuuauuuauguauauauggugauuauuacaacauuuauccuuuugcauugaaaauuguucuuuauuuccugugucuucucgacgaaaugucucucaggaccuaaauuuucauccuuaaggucagacaaaaaggcuuugaugcuuaaaguuggcuaauuaucugcauucuuucuucuuauuuuuauuaaaguaauacaugcacaaaguuaaaaauaaauaaauaaauaaagccaggcaugcugagggagucguaaggagaagagcagcucuuuuccuccccucaggcucucuuccccuaggucagugcuuugcuuuuguagcucuacccuauuccuuuuuuuuuuuuuucuuuuuucuuuugagacagagucuuacacugucgcccaggcuagagugcaguggcacaaucucagcucauggcaaccucugccucccggguucaagugauucuccugccucagcuucccaaguagcugggauuauaggugccugccaccaugcccagcuaauuuuuuuguauuuuuaguacagacgggguuucacuauguuggccaggcuggucucaaacuccugacuucgugauccaccugccucggccucccagugagccacugcaccuggccuacccuauuccuuuugcauuucuaaauuguaugcuucuuucagggacuuuuuuaaaaaucagaaguuggugccagcccagcgaaguagcucacgccuguaaucccagcgguuugggaagccaaggcaggaggaucgcuugagcccaggaguuuaagaccagccugggcaacauagugagagccugucucuagaaaaugaaagaaaaaauaaaaagcaaguuugugccagcacauauggaaaagucugacccugugccuuucacucccaacauaccauuccuguuggagcacacacaugaugcuauugaucuuccaggugugccuggaaaggugaaagcagggcuuugucuguccuugccccuagcccuggacagaguggccaggauuucuaaguagauaaggcuugucccuggccguuuccugcaugaccuugaaaaucccuccuagucaccacgcccauauaccuggccacccacuccgcuguagcccuggcucauucucucagagccugauuagugaucuggaagaaaaagaucggauuaaaucuguucuuggugaugcuggaaaccucaccucuuacaggggcauugccuuuggagaggucuuggaggccuucacccaaaggccagccuccaguggucccacuucaggcucuucccuguuuuuauuggagaaaagcuugggguaagagcuuguauggccaaagcucacagaggagguggugaugcugggaagggccuagagcauguguuuaagcagauucauaguucacgaagaagaaucaacaaucgcaucccacacuaauaaaagaguuaauuuuuacugaaugccacagcagugugaauuuuagauaguuugcuaaaugcuguuuaaacauucuauccugugugacuguuuaaguuauuugcauuugacgugcagaaccaucuaggacuguuaucugccugccuuccauuuacagauggccaaauaucuuuagaaaacuaauuggugggcuaaucagggaucauaaacauuauauuguuuaaacagauuuucuuuuauuuuuaagguuugcuuaaauuaaauuacuaugauuauauauguaacaaauuaucauuaauggacuauaauuaauaaaaaccccugaguuuuuuugugagagcuuuugccuuugacaagggccauuuuucaucucauuaaggguuauaauugauuuacucuuuacaggguaaauggauucaaugacaaccacuggggcuugcauguuaauguuucucugguguugguguucauugguguguccuuccccaggggccaacccagaggcacguccagauuaucauggagaaacuucuccggaccgugaaccgaaccgucauuuccaugggacgagauucugaacucauuguaagugcuuggugacauauguuuggauauuuaacuggggcugacagcauccuucuccaacugcuguuugaacauagcuuauuauacugcaauguagugagcaguugagauacagcuugguauauaaaauguccucauuuuccaaaugaaugucaaaguugaaggguaagcaaaccaacuuuaaagauggaaacauuuggcucuuguuuucucauuacuuacuuauagcaaaagacauguauuuucugcugagucgucauucuucuggcaguuucuccauaguguuuacacuuaaggugccauuaauaaaauuuuaugaaggacccuaaaaaguaauugagauucuucaccuuaguuauuuuauugucuacucuaauguauuguagguguuuuucuuaaacaguaauuaggcaggagccuauucauuuuuuucaagaauauuuuacuaauuuagacaguccaucaaguuucugaucauggugccuuuucccaggguucacugcuguccucugcacccccuuaccuuaagucuguuuccuucagcaaaaaaugcaugaguagaucucguuuaauuuuuuuuuuuuuugagguucaagggguuauaauuucuuuccuuuuuuuuuuuuucuuuaauuucugggauacaugugcagaacauacagguuuguuacguagguaugcgugugccaugguggucugcugcaccuaucaacccaucaucuagguuuuaagcccugcaugcauucgguauuuguccuaaugcucucccuccauuugccccccacuccccagcaggccccggugugugugguucuccucccugugugcauguauucucauuguucaccucccacuuaugagugagaacaugugguguuugguguucugguccuguguuaguuugcugagaaugauggcuuccagcuucauccaugucccugcaaaggacaugaacucauucuuuuuuauggcugcauacuauuccaugguguauaggugccacauuuucuuuauucagacacauguacacguauguuuauugcagcacuguuuacaauagcaaagacuuggaaccaaccugaaugcccaucaaagauagacuggauaauguuuaaaauauuuagcacauguuaucauuuaagucaucuugguggauccuuuccaaaaaaugacuugaaaggagaaaacguccuuuuggaguuuucccuugacaucagagaaggcacccugguccuuccuggugcgugaccguuguucuuguugcauaucuggggugugaacagggaggugaugugcgucuucuuggacagcauagucagaacggagcacugggguccuuugcguuuuuaugucuggugucaccacagaggacuccgugucgugugcgucacagacaggucgcacagauggacaaaugcugccuuaguguguuuccauccagugaaacaguucaugucuuagagcuucagcacaugugagguucagauuuuccuuuuuaaaguguuuaaacuuaaaguuuaaacuuaaacucacauuuuccuuuuuaaaguguuuaaacuuaaaguuuaaacuuaaacacuuuuaaguuuggauuacaacauguaugaaucaggaaauaaaauguuuccauguaaauuggcuuuauuuacaguagacuuuuccauuauuacauaaacauaaauuugccugccuuuucuuauucuccaugauaauuauucauagucuugaaacacauuuggaacacauuaauauggaaugggcacugagcccauggagaaggauuugcagugacuccacgagccaccuguugaccccugaggucuggcguugaccccugauguccagcguugaccccugacgucugacguuccugucuucuuggagucgugccgcaggugcacucugcacagucucaggaguggaacuggaaagggccuuauguagagcaaagagcauguggcuugaacuugaaccaagugugguucugccaagacccucuugggaugggcggacuuagagaggcuggggaugacaugauggcaugcaggggugguggcagaugagggagaggguagaaguggaggcagguggucucaugagacuguuuugucucuguuuaggggagcaugguucugccugugcuuagggaaacaugguucugucucugguuagugggucuugguccucucucuccgauuaggagguccugucucuggucaggggggcacaguccagucucugguuagggggugugguccugucucuaguuggggcacaauccugccuccaguuagggucuucuuuuuuuuuuuuuuuuuuuuuuuuuuuuuuuccccugagauagagucuugcucugucgcccaggcuggagugcaguggugcaaucuugacucacugcaaccucugucuccuggguucaagugauucuugugccucggacucccgagaagcugggauuacaggugcacaucaccacacucaagauaauuuuuguauuuuuuaguacaguugggguuucaccauguuggcuaggcuggucucaaauuccugaccucaggugauccauccgcuucggccucccaaagugcugggauuacaggcaugagccaccaugcccagccuuauuuagggucuuuaugcuagguguguguucacuugacuuguagcccacuggucaacaguuaaacuggagggaagagggcacagaaaaagcucauaaaguuuggaugggaagcugggaauguggagagauuauaagaugugcucacagcuucaucaaaggguagaauagacccugcagggaaugauaucuccucucagaccaugugguccaggaugucuuugagaaauuucuccuaucucaggcaugauaauaagugugguaguaauaauggcaccucuucacugagcaugcauuuacgugcuaugcacucuauaaugaacaggaagauucucauuuaauucucacagugcccugcagacagacaagaaacaguucaagaucccacagcuagcauggcagcacuuguuuccagccuggauuugguucccauguaugcugucagucccuucuauaagacacaggcacacgaugcugauggccgugguccacuucagaagucaucgaaaggacugagcugcuccuagaucccuguccugcuuagggagacagcuguucagggaaauaagcaccuuucuauuuucuaucaugucguauccaugguccaacucuaggaucuccuugcuagaagggccagaccacaagcuaggugcccauuuccugaagggcuugggaugcuccagcuuggaagaaccccuguguucuaaggaacccugaggaguuccucaggaagaagccuugcauguucuaagaagggggugugacagcgaggacccaugcuuggucuuauccagagccacauugauaucaagcauuuggcauaggggucuaagcacuguccgggaauggaagagguagaacaaacuucccaccuccagaaccauccuccacagcccugaucuucccaaacagaagccucaaagugggaagaggagagaggucuuaaacggacuccucccaauuccaccaucucuaagaucuguaaagaaguaaaaaaaauccuuggaguuucuuuuauaaaaugcagcugucuugaaaggacucucaaaaaaauucugaauaagcuauaaucauuuaaugagugaugacaacaucaagauguuuucaagaaggguguuugccacugaaaauucgaguuguuuagugggaccuuguaauccccaaccagccacgagcccccucucuggagucaacagagcagugugagugaaaugcuacccuguuuaggaugccugcccuugcucuuccaauuugcaucaaauguagauuugugcauuaacuuuuuaaagucguugcucugugaauuuagauuagaggaagaucaaggcaaaaaguaucccugacaagguggacaaaaaccuuaaucaguagaccuucuagaguggaaaaagaguagaaaauaguucauaggucuguuuuggguaggcuguuccauuccauuauaucuuagagauuucagccuuuauguguuacucauuuuugcuaaauauaguggaaauuauguaacuaugaaucagcuuaaaaauucuaaguaaucacugaaaaugaguuuuuaaaaauuaaagugauuaaaaagaacucugaaauuaauauacuuuacuuaaugauuuauuccaugauguugucaacaacaguacuagaaauguggccucuuuccaucggaauaaggcauuaacugggaaugugauuaugcccugacagcuucccccuauuaauguaaggaauagaaaacuggggaacuucacacuuaauuagauaaauugggauaugcaauauaaggcuuuucuuuaucugugggauuuuacaaaaacucgacuuugcagucaguuguauauuguuugcuuuaguugauuauauuugaaaugggugauuggaaugcgucucgugccuaggauaauaaugugcuaugauccgaaguauuacauccuuaagaaaaaaccaaaacaacucuauuuggcaguugcagaauuguagaccaugugaauaccuagcacaugcccagagacagaagcguugcaauaaccuugccacagaacaaaaaggucauuuuaucuuuacucugauguagucugaugcuguagaagcauggagugaaauacuuauuuuuauauuaagucagacuucaggauuuauuucagccuuccuuuuugagaagcuuucuaagcccucagcauuaagcagcauuuuuccucaucacacacggaucugagcaggugaccgcggcugggauaggugcuguuguguugugugcaggugggcuggccagccauuggguguguguuuuuccuagaguaagaagcacuccaggcugagaugagagcuguugaaaugaguaacauuuccgucuccugugauacgcgcugcuguugcuucuuucaaaugaucagauuuacauucuuuuaauggguccuuuaaaaauguaaucgagugagaaggacuucuaaacauuuuucuuuggccuggauacacacgaggggauuggaaauuacuaauucaugaaaaugaaaaugugggcuucuuuuaaggaaaaauucccuuugaacauugacagaagugggcauagggaaggggaagauuuugccuggauucuccacuuaacucuugucaccacuggagcauccugacucccuagacacaagugauggaaguuauuuuguuuccacucuaaacacugucucagggggacauugaugggaugguggaggguguguuucauugugacaacagcaucuuugguggggaauuugcuguuggugaaaacccagugcuuucucugagcaugggugauugauaagggccugacaugcuccuucauuuggaaaaugguauuaauagaauugguuucccagugaauagugccuuuuacccaagacucauaaccaaauauuuucacaaagauguuauauccccaugcaugagcauucauuuugagauguucauuauaauagaguuuaaguaugaauguguuuuaaaaaugauuuuaaaaucaucugcaaaaaaauguuguguuucaaauggacagugucuggguuuuguauagucaucauaaaaaugucuauaauuguacuguuugcuaauaaaccugccugcuuucagaaaaucauccuaacgugugugugugcaccaaugguuuuauaaguucauuuuucuuuggggcagcuacagcaauuuuagguuuguuuucauauuccugugacccugguauuuuuucaagguugguuacuagcuauggguuuacugcagaagaaguaaaaaccacauuguugaaugggcacaauaugcucugcaauccuuacauauucauaccaaacagcaaagauauuugcaaaaccagacugccuuaaguuaauuuuugcgcaacuuaaaaugaccuugucauugaccaaaauguauaggauccacuguagcaugaugacuuuaugccaguucaugaaauggauguucuuucugaucuuuguaccacagaguuguuuacuuucaguaaauaaaguggcugcacaugcagugccugcaaauaugcuagugauagaguuucuguaggucaaagaagacgugcuggugugggaagcagcugcugugaucuuuaggugacacugcugcagccaaacugcccugauucauaaugaaaucaacuuucacuugcugauaaaaaugcuaaggaaugaguccaccagugacagguuuucuaaacaggccaugguguuacuaacaccaugacauagaaaaguucaugccucuuucuuguuuccuuuucuugcugucuucuaggaaaggccaguauuugauggucugucuucacaguuuuaauuaagaguuguguaucuugguucugauaugcccaugugguuuccaaggaaaacaguguugcaggccauccuccuugugacuguuuauagguuggaguuggucugccugaggcugggccaugacugugacaccauuuacacccaguaguccagccacaucucagaucucuguggcuguagauaacuaacugccucucaggguacaugggaaaugcugccaacugccuaaguuguuuccaagguagcaagguuuucccauacuuugagccccuccccauuuaucuucugcuggagggucagagauugaaggagcagaugcaggacuacaggacuucugcuucuuggaagugaguugcacacuuguagagugacuggugggcacccuucauuguaucugggugucuguagaacaggaccuuugaggcagcaccaauaguuggcucagaaaugauuauagaaugagacagaacccucccucugucugcucugggcugugcauugggccuuccuucccuuucugcaugugucagaagaggaauccccuucuucucccugaagaacaugcgaugguagcaggagccuugagugucggucugcagugcccucucccuugcacauggacucugugguugcagauacugggaaaaagcauuguggccucuccucuccuaggccguccaggugaggcaaacaccagcccacgugugcagauggguuaguauuaggcuagugucagcaggagagguaggcgcucagccuaucucccacuagggaggggaagaagaaaggaaggaggcggcugaucccuugaggcuggggaugugcucaauggaagaucuagagagaagcuaccuccccugggccauggaggcaagauuuacaugccacaguguacuguggcaacacucaauguauuuagccauuucuucugagguuaagaauuaaaccucauauaccuccugcuaugagccugugugcauccuaaaaugccaccauguguuccgguggugaaacuccaugccagggugcauaggugggcaagcgucagucccuucccuccccaagccaggccagcucuggcuggugggucaggcccaggccuuacgaugcucuugucuucugcagaccggaugaaaugccuaucggcccaaacauucuuccuuuauuauuauuuucuuagauuacuuuuauguuccccaauuuuugaggccaugaaauaaguuuaauagccacauaaaacaucuuugauuuuuuuauuuaaaaauuaauaaagaacuuaacgacaaguauaauaauuuaaucucuauaugcaaugccauguguacaucuacauaagggaacccugugcguuuuaccuugcuuuuguaucagcguuuuuacuugaaucuuuccaagagaagaaucaccaucuguuagugacguguugcaauuaaacuaugaaaugauuuugacaauaguuuuucuauuuugaacacacuuuaauuuuuagggaugaauuaauuuaucuucagaaguuccuuuuugacucugaacauuuuaauuuuauuuuuuuuuggucuagacuggugugaaacagugacauuauuuuguguacuaggauguccucuuguuuagacagauuuguguuacuaauuagaaaacugcuaauacccuuauuucaauuuacugagauaguugggauucuuaaaacauaaggagagagaacuuguuggaaacauuuuuauaacuuuaguuaaaaacaguauaaaaaacaugaaacccauuuuuaaauauuuagucuacgugaaacaguuacacuuccuucauguuacaggaucaacuuccucauuguucuugcaccaaaauauuucucaguuccuuuuauugauauucagggauucgaacuucauauaguguuuccgcagaggaugugugugugcacauguguguuuuaaauuaaagcauacaacugcaguguuguuuggcccccgaagaauguuuacacgacauacucuucauuuuuuuuucaaggcccgaucugguuacugaucacuagguccuuguagaaucaaaacacuuagaacuaaaacagauuugcuguugagucaggaggaaaauacauggcaagaagcagcuccaaucugacaaaagcaggugagauccuuuuaccaagguuagccacuguguguuuggcaucuagucaaugaggugugcaugucagcacuccacuagaugugaaacugcuggacagaaacuucaagacuagguuuuccuguaugcucacaaacuauucaaaauuuaaguuguacaaaaaaaaaaaaaaaggcaaaguaagaucccuacuuccuauugugaaaaucaaaaaauugauagacaaagucauuaauagacuaggggauuugauuucuauaaaaagauacuugcaaaggugcaaagaaaugagugaaaaaauaaaggaacuaagauuuacauugcaauguguaaucaagagagaacucuaaguguuacuguugauuuaaaaaauaccuaaaaacauuugauucacagcuuuccccuaaguauguuguuuaguacaacuuacuaauagguuaaauguaggcgacauugucccuugguagcagcuaaacuaaacgcacuguuucucuuugagauggucagggcuuccaccauuaauacaaagcauaacgaauuguacauaacgucuggcugcacuuaccauggcuaacagugucucggaggaucgauccacaaaaacacugucugccauggcacagaaugccugugauuuauugguggguggauuauccaucguguaucucuauguauguucucagauucuugccagaauguauuauuuggccuuuggguaccaaaagauuaaaaaugagaucuaagaaaacuuaguguccaauagcucugacccugucuacuugcagugauuaaaggcauauccugacuuugggggacuccuggcugcuggccauuuggaaaaugagcaguaaacaugucguaagucuggagaugaagaggaugcuaaauuugaggugucguugugacacugagauguggucacuuggcuuagcgcuauagcacaugaaggcaaauauacauauagucacauuuuagagauuauucauggucuccgaccacuugaaaaaauugugcuuucuccggaauuugaugugcugaaaauugcacucgcccccugcuuauuugcaaaaugaaacauaaaaaugaaguccuucgcaaacauaaggcuugcuuuuucuucucauuauuuaaaaaaaaaaucaaggcuugaaaauaauuaugaguuauagcuguguacagggugacagccugccaucucgcagguugauaauguauuacuugcagaucgggggugggggaaaauuuuuacuuaucaucuuugacuacguaaguuucauuucagauuuuacaucccacaucagugaacugcaaagaacagcuggcaaggagugacacagaauaccuugcuucuguuaauuaucuauugguacaaaggccuuuuugguacgcagggcgagaagugggaggugccugaaugggcaccacaguucccucgauccuauucauuuuggaaaaguauugacuuaaacuccaguggguucuaaagacggccucgagacuccagacaccgugaguguuaaaggaaccagaguuuccaucuuccgugcuuuuuagauucaguuuuggauuuuugcuugggaguugaggaguaagucuccugagaguaaggcgaagguaugaccugaguuuccucaauaggguggaguuuucuuagaaccggcuggaguuugucuucuugcugcuuaaaauccagcuccacacuagaaaagagagagagugaagacuuuagcauuugaucuuuuccauaugaagaucccucuuagugucagcaagauuugggcaugaucaguguguguuuguaauguaauuuuaugguuuaauaauagcaauucgauauacuauguuuuagcucugugcucccgugaaauaguucaaggaggcucacuuccuuuggaaaauaacuuacuugcuucuguaggugaaucuuuaauauuguguuaaugugcacaguugguguauguauuuguggaaaugaaaaaugugaaauaugaauaaccccauuguuuguccacagucuguucacaugggccucauggaguaaaacagaaaaccaaaaguaugagugggcaggggucaccuuaguacaucuauaccaagugcacgcaagguccguuccugugcaauguaucacaagaucagagaaaucuauuucucugaucucccaccuaaaacaauucuggaaggaaaugaccuuggcugacauucuccuuguaaaagcuuaucugucugaaaaucugauaagggccauagugcccaacgcuggggaaaauaguguguucauggagucaacaccauugaacgguacuccgccauuacuaaccacaguuucuuugggagaagcguggggaguguucaguaaagacaacacagaaguaaaauuccaucacucaagccauggcgugcaagcacagagccaauguggaagcacauuugccaagcagugauaauguuugcauuagaagaugguguuaaagaugauuuuugaacuauguuauuucuuacagcauuucuccgaaaauugcugucaacuugucuagagcccucucgucuccaugucuuugaaaaggaccacauuugaucuucuaacuuggaguccuaacaggucugcuuggcagcugggauaggacccccgguccaugcaucguuuuucugugaugaucucugcauugaggaguucugcuucccuucccacucacccugucccuccuugggaccucugcguucugggccaggccuugggaggauuccgcucuguccuccuuccaugucuggucuggaugccagacuaaaugucaguagauuucaguaaaggcucagcguugaugauaaugcaugagcucauaacauuuuauaaccaguggaaccguaaaccauuuauaaacaugaaauccuauugauuuagagaaccauuaauccuagacaaauuuugacauuuuggaaagacagaaacagccaagcuauauuaucuggaguuuuaaaacaaguucaggacccaucuaaugggccauuucauguuuuaaauccacuguuccauuuuucucauugucagugacucuaauauuacucaaaaaauuaaaaaaaaaaauugccagagaaguuuauggcuagugaccuccugcucccaaaacaaguuauccuuuucccuuuuuucgaagagccucuuugaguuaugcucuaauuuauaggaaguagaauaaaaucucaugaauuuaagucuugcuaauccagacuacgugaugauggaggcauagucucuucuaaggacaguugugaaaagugcagucuaaggcugugcugcauuaaugaaauccgggccucaguuccgugauguggugcacuagaaggacaugggguuuccacccugccucuuccaccugaugcugguuugggagucgggggcuccuuaaacuucaauucuuucacuucaagggggagaaaauaguuccuucccaggcugucguaauuacugaauuguggugacaaucucuccccacugaaaaaugcccaugaacgagccuccuaaacuguaagaugcaauuuaaauauuauuguaccauuauuaucuauugaucacuaaucuuauaauggaaacaagagcuaaguaauaaagauaucuauuagggaucucuucaacuuggacauuuaacaaggaaaacaagagccugucaaucgagucugugaauauacgguauguuagguauagaagcguaauucuaccaaggugcuuugguaauauugaagguguguucuccagaucguaaccguuucaacagccccagauugguuuuggguuauuagaacagagagaaggcgcuagcaucuccuaggcuaacaguacaauuucggcuaccuguaauuauugaauucccauuaagcaacuacacugggaauccuguuauuaaccaauuuaucacaccaaggaaccauguaaucacagaguaaucuaaucugaguucuuguuaacaaaaugacucgacuuuaucugucgaguugauuccuguuugcacuccccauuaugcugcccugggaaucugcaaccagaggcagguuccuugguagagggcacuuaugagucugugagugcccacuuggaaacgccugccagcaaguugacccugagguccgccccccagcccaucuccccaucugucacaugugaguugcaguggaucugcgugugggaugacgcccgugcaccagccaggcaacgugugcagaggugugaaggaauaaugugcauuguucuggacacugcuuccugcucaaggacuuuucuuggggaagcacaccaagucucucgguugaguuugacacaccaagucucuggguugaguuugacacaccgagucucuggguugagucugaagcagaaaccugacuggaggaggcagcaucagaagguuaacggucuggccaacucuggcugacaucgaacaaaggucccuuuagucuuaauagcuaaauggaucaaaaggcagcaacaccugcucuucugguuagaguaguggacuuggagaaaagcugccgguagauguuccagggcacugggacugcccugcacacagaccucccucuguauuugagacagcggcuuguucagauagugccugggggccugccugguggagggcccauggcucuugcuucagcuuccccuuccugcugcccggcagaccuguggugggaguguugguugcccuaccuggggccacaucuuuguccggugcugccagcuucaugauuaucacuuucuccccaccugaaacgccuuucugggcucauggcauggcuggcauuccuuggcccacuguuucucagguccacauaaccuccuuguugucugaccaccuucccaaauguugcccaauccauccugucuuauuuguuuuugcacuaaccacagauaauuauucguucccauauuacuugccuucaucuuccuaaaugcaucuucucgaaugcaggcaccauaaucagagaugccaugcggucauccucuuucuguuuccagcaacuauagcaggggcuggguccuagcaguugccuacguaauauugcuagaauuaaugaaugagaacagagucuuaaaaggcaaauucuggccaggcacgguggcucaugccuguaauccuagcacuuugggaggccgaggugggcggaucacuugagaucaggaguucaagaccagucuggccaacauggugaaaccccaucuguacuaaaaauauaaaguuuagcugggugugauggugcaugucuguaaucccagcuacucgggagguggagguugcagugaguugagaucgugccacugcacuccacccugggugacagagugagacuuugucuuuaaaacaaaaaaaaaaaaaaagcaaauucuaccucacuuuuagucccaguugcccuggacugcuuuguuuuggccaaaaauuauguuguguccuccccuguguccucccacaaugagaccccuuccuugccacagacaaauagggcucugccuggaggcauugucagaaccacuccagauggagucuguggccugguucuauucuaucagaacuuaucgaagauccugaaacauuuucugcaagacauacuccaggaucuuuuuggagccuggcucccaugccacgguccccuccuuuccgucuucuaggauucuacaguaagaucuuggauagaauggguggggccagcagggucugcuugugagugaccagcuaccacagucgcugugcuaaggggagcgugagaguuacuuuguccccuuuucacuugccuguggacagcagguggaggucuagcuggauguuuucugggugauguuuguucugagcaccaucacggucccaggccaccagacgugcugugugcaccugcuuucccagggcggcuccagugcaggggcucauucuacagccacacgggcacgugggaagccggggcuccaaaccuuguugugguuucugaggacucuggcuguggcuuugcacaguccccuugcaaccucccaggccucacucuccagcagcucaggaggcaggaggcugcagguggugcugcugcccuccugcuggagggaucugguguuuguaaagcaugggcaggggaguguccaugucaugaggaauucuuacuccuggggaggagcagcagccuggaaaaaguccugauucuugagauucaaagcaugagucugaagcagcuggagccaggccagccuuaccugugcgggguguucuguccuauaaacaccugagucaaacacaggcuguagauuuugcugggugagaagggaagaucccuggauggcuggggauauugacaagacacgaauuccuggggacuguagggauuuaccuuuguagcccucucgcugccugcaccuccauucucccuccagauaagggaaccauccacccaaacacucugugcccuggggcugugucgcccucgcugugcucuuggcaagucccugugaugcaugauuaaagcaacugagaguagauuuaauuucuugguuggucuuucccuuuucaaaaugaaaguuuuaaguguggggacuuucuuacaacaugauuauucuguacauuuccaaagaaagaagaaucugcccuacaucucaggcugcucuccagccugcaccuaagcuuuauuuucuucccagagacugugcuaggcuuuguaguaacacuucuccccgcugccgcaugugauuuugcagagcggcauccuucuugcuucuccagcuuauucucuguuugucucaugcuccuauaaauacucaggcccugccacaguuucuuuagcaagcugucacugaauccucaagauaauuuaagaggaacacauuuuuaaaguugccuucugcagucguccauguguaacaguuaagaguuaaaagcaggacaaucuggugccccggagcuugcuuucuggaagggaagaaaacccuuugucuuuggggucucuagccucgacagggccauguggcucgguggccagcaggucagaggccucugccuuuaauucucuuugaauuagaucucagagucuuccccagugcuaaccguggcucugugcugacucaggcucuaccacuguggauaaaucaccucaccuuggggaccugagcuugcuuggcugugaagugauggcugagaugugcucccacuucucacagcagucuccuggaacaaggccugggcccaggagggcaggugcaccaggaugugggcuggcuuuuauuguguagcuuuggguaggaccagccauguccccaaagcacaacaauuuaugucaacugacauuggcgccaacuuggccgguuuuaugugagugccaugggcaacaccagcauuguccagaggaaacuaaaaguugggaucuggaucccaggccuggcucucccccuugcaugggaggugaauucaggcaaguccuuucugggccuugguuuauggaugugacccuggccaccucgccaggcaauagaagaaccaggaccccaaauauuuguuguucucuucugaacacaucuccgugugcauaucugaggggcacuggaaauccagcauguccagaaccagaucuuucccccagccugcaucucuguccuuccagacucagccugcagcccccauucaucucccuggaugacugcagacccuggaaucaagcucaacuugcuccuccugccucagcaucccugggucgaguggauuuacccucagaacacccgguguccuuccucuccgcccaccuuccacugcucuaguccagaacuccagcaguuuccuccuuggccauugaaacagcuuagucucccucacucucuguauucucucccucuccaguuaccagagucaccuuaggaaaacuggcaaacuccuucucaaaucccugcuuauccuucaaaaccuaggucacacgucacuccuucuuucuguggauuuucuagaauaacaaaguccacccuccccccugccucauccacacaccucugggaugaguuacugcucuggcagcauugucucuagguuuccaugagagccugucuccugugggaucguagcugucuucccccaggucugugaacucauugaaggauggaccauguuuaauucaucuuuugucugcagugcauuuagcacagugcuggcucugaaccugcucuauuuguuuguugaauuacaauaaacugaugaacugaaccaaauccccucacuucuaaucucagcaaagugcugccgcccuauuuucuguuuucauuuaaaauuuauacauuuguauaauucuauuuauucugucuauagaauuuguuauauacuauuucuauauuauauaccuacauuaaauauauauggaucucauccuaauaguuuaaaauaucagugguuuguaguuaacuggcuuuucaacacuuuaaauauagaaaugauucaccguaacuuuguauccuuccuuuaccacuauuuuacaugguaggugcauuaaucaauguuuaugguaucacuguagggcuucaaauaccagaauaaauggcuaauccaugauaguaacacucaaacuguaagaucuguccccuuuuccugguauacuaugaacaagaaauuaugauuauaguuuuuuuaaaaaagcauuagccagauauccuagcuguauauuuuacuaugaaggauccaaaguuagaguuagacgaugagcugagcuuuccaaaugcaucuuggauguuuuccgugaccauacuggagaacuugcuugacugaagcucauccuaggugcccaucuuaccuguggcacucucuggagugcaccugcggcucuggguccugagccucaucuaggugccugggucugagggcaggucagaugcacaggggucagagaaccuggcaucccauaaaauagugccaccgaggagcagaggcagacccaagucauuuggauugccucugcccaucguaaguucuccaugaggaaagacaccccaugacuaacagcaccgccacaugucuaugaagcauaucuuaugccaucccccuaggaagccaggaagacgagucaugauaaucagaggagucaguccuuucugagacguagccugcagaacacugcuguuccugaccucagugaagaacagccaguuuuccaacuuuugacagaaacuguguuauaacugccuugaaaaggagaugacacagggcuguuguccuccuguucuaagcugguugcugugagucccucguggccaacccaacccugagugggaucccaugacccagggccaucaccuugccugccugucuccuuuugaagaugggagugcgucugucuagagacaugggugacgucccgggcucccaguguuggugugaaggcuacaaagccacccugccucccugggccaccagcccggaacccugguuucuagauguggucaggagcucccacuccauccugauacccauugagagcaucaucuccacuaaacguagcagugauaguucucaucacacacggaaaccauuagcugcuugugugugucaucuggugucaccagugaccggucuaaacgucagccugugcauuccugcaggaggucccuucucaaacagguucuuucaagacgccuaucugugaggaagaaccugcccuggggaccccgcacccugaauucccuagucacucuauuccccauggaauuucauacgacccagcccuagacaucguggccaggacugcgucccguauuuacccccagaaaaaucuccauacucaucuaaacaugaauuaucuuuaucuucccaugaaacugacagcguaguccccucaugcuguuuuggacauugguaaaugccuccuuaacuuugaccuugggguauaaccaaaggcugggacuaucaguauaauuagccuuucucugcuaauaaauuuuaacuaauuguuucacaaauaauauguugagauggguaaucaguuuuaguuacaguuaauggcuguaacaaguuuccuagcaucuaaauaagagaauuaaggcauugcuaaacauuaguaaaaaugacuaaaccuaaauccguacauauucgagggacauaaauaauauauuuuuggauuucaaauagaaaagaaaaaacuuggauuauuagcuuugggaauuuucaagaagaauuuagagaucugucagaaucauucuuuuuuccugacuucauuaaacaaaaguauuuccuuaccccagaauaacauuguguauguaagguguuauccagggauuccuuucucucaucuuccuacccugucacucaccauaaauacuaagaacagagcacuaaacauuaggcaaaaggcgaauuucccccaccucaguucaugcugcuaaagaacuuaauaugcacaagugguggucauugaagcagggcuggaaagggcacuuccaugaagagauaaucgcugaaugacaaaggcugcagagacuccacuccaagugggcuccggacaggcuggaauuggcacggauucugcauacaaaugcaauuaccacucuuaacaauaggucuccauuagucaggaggugcccgguucugccggcugucuugaucgugcacuauccugaccagcuuucuuuuugcaauacacucggaaucagugaagugccagugugcgugauuuuaucuagaacucuuugcacccucuguuuuguggucuuauugguguuguaauacauuaccaagaaugaugugagaaaauacaacccaucacuuuugugaauucuucauucagucucauaauguuagauauuuuccucaucuuuccugaaauccuccagucauuuggggaaggaacuugccuucuuuuggagcuuccuacuugagaagccgucaaggauugugguggacugggauguucuccagccugucuaagggggaguguucacgggucgcgagguuucccauccauccuugggggugcccuggcuguuuguccuccuaguuccugccaguuguuccuaacgccguagccuggagggcucuagagaggccauccaaauccucccuaaccuggccucccuccacgauuaucuuguuuucuuuggagucugcuuugccaggucgggcacccuggcuuccuucaccuccuccucgccugccuuuuacguccuugcaccuguggcucucaccuuccauacagagggcucucucucgccagagcucuguccuuacccucaucccggggucccaggguaaggggcaugcauggaggugucuucagcagcuucacacuccucccagucucccagggccuggugcagaacuuguccuuaggaggucccuugaaaaacaccuguucaauuaauacccuuuaggaccccaaauggaaagggcuaaggcauuuuuaucaaagugguuguuuaaaauuccaccuguccuugucugggcacgguggcucaugccuguaauccuagcacuuugggaagucgaggcggguggaucaugaggucaggaguuugagaacagccuggccaauauggugaaaccccaucucuacuaaaaauacaaaaauuagccaggauuggcggugcgcgcacguagucccagcuacucgggaggcugaggcagaagaauugcuucaacccaggaggaggagggugcagugagccgagauugcaccacugcacuccagccugggcaacagagugagacucugucucaaaaaaaaaaaaaaaaaaaaaaaaaaaaauuccaccuguccuugaccaucauggaucauaucaaacagugaaagcauggaguacacagcaaugcguuucacaagcucccccucucugaugucagacaagugguguggagccuuguggcguucccauccagucagguuccaagcccacucauugauccacugcagaauuauuagugucacuugaggccacuuugugugguggcugugaugauccagaaaugaagcagacacagcgugcuccgggaggauguggucacucagggcuugcaacugaugguaggaauucuaccacuugacgagaagauucuaaauucugggagagaugcuguuuaaugaaucugagucagaauuccuguuauguuuuaaaucuugcuuucaucuccaaaagcccuuggauugcaguugguccauguuauuuucaugaaaauguacacauuagaauucaggccauuuugucgcaguacuauguuacaaauuaaccauuucagcgaaggagagaauggcugguuugccgaugauguuucauuguuccuuucugaaaccacauccgaacaaaagcugaaucauccguggugugacucaucagauuaguccgacaaaagaauuaccaaaauagggcuggagagaagaaauuucagcugcuuaugagcaaagauuauauuaguaauuuauccacaaaacauuuucugaaauaauuacggcauauuuugacaagaaauauggaagauaagccagaaaaguuuuccuaaagaaaacggaaacuggaaucucuuuuaaucuucuuucaugcugagaugguuuuaauuagaguagcacagucggucugcaucacaaccgaagggaugucugucaucuuagaaaaagauguagcugugucaaccaucucaaaauuugucagaaagaucacguuugguacuugggguuucaguggucuaggaggaagcccaucaauccucugccgaagaaguguuacucagcucugagucaauagauuugccaauaagggagagguguuuuucagcugaggaaugccuugugacucuccacacuuuuacccuucugugcagucucuugaaacccauaguuacaucccuugcauaauuguaaaaagcagcuccugggauuucagaucuggaagggaccuugaugaucccuuagugcaaccccagaggaccuggagacugaacagacaccccacccaagagagagggcagagaagcucagcccuaaccuugcagguacgcggcaggcucucacgggcugauguuucucaccuuucgcuugucguacuggugguuuuccccccgccuugaaauugcaucaagaccguuuguccuuuugaugcuuuucccuaguccucuauauuuccaugacagaauuauuuuucacagagaaauauguaccgccucccauggcaaagguacccauuuauuacaggccuguggugcuaaagccccaggcagccgggucuugaacacaguauccuuuucaucucccugggccaggcauuacuggaaacacgguggauagcuaugcugcucggagaggguaauuggguuucgagugaaaagugguguuuaaaugcaagacaggcagggucaaauucauuucccuccagggcuuuuggccuuccagaaagcaggguaugacauuacaaugugugaacacuggcagcugugauggccccacguguucucaagccucugggacaaccacagucaugugacauuuuaagauuuauuuugaaauuccuuuaagcuacccaaucccgggguguuccaggcaucccauggugcauauggagaaguggguuguaauggugguguagggacucacaggaaaguuccugaacucccggauucagguccuugcaacuaagagccaggcuuugaucugacagcaaggacuguaaccugagcuauacuuuccccugcugcuggaauuguguuucuacagauucauaugcaggaauucaaggaggacuuggcuguaaguuugcaugggagaacaagacauggauguagauuuguaaagccuuugaaauuuggagacacccucuggcucacuuggagucuauacuuccgagaugcuguggccacccauguacacugcuacugagucaccugaauaggugacuccuccugcccaaggaacucacuggguucugaacacuuuucuaccgaagaaacuucuauucuuaagcuucugacauuugggggugacucacagaacugaccgcaagcugcgaggucauccagcucaauccccauugcucacccuccccuuucucuuugcucagugggacccugagggaagugacccuguguaucagcaacucucagccaccagggcagaaucacacagaccagugcuugguagucagauaggauuacauaagcccucuuagcugaugugcuagauuaaccauauggcccuguccuuucacgacauaaguggugcacccaugaugcugggacccuuaacuaacuggcuucucugucuuuguccugugacucucuguccuuacuucucaagguucaugcuuaccaagaggaugcuagauuuguuccuggaccuguuuauacaauuaguacucacuauugaaaugaugugauuauugaaugucaugcaaaccacugaggcaugagaagauagucauugcuguggauucagugcuuuggaaagagugggguaccacaaaauauucaaugaaaaagguagagacaggucaaguauggauucagaaggauucugaucucagauucugccacaggacuuugcuccacuuuaaagacaggaaaauugguguggcucauggcagaucauuugaaacuguagugggggugccacauucaaagaaaacgucugggccucaccucuaaaggcugcccuaacuugaaaucauucaaaugggagauuucaauucaugcgauucaaauuaaaauaacauguuuaaguuagguacgugucaauuuuuuaugauuuccccauugauugauuuuucaauuaauggaccagaagugaacuuucacucccuuuaucaucucuuccugcagaccucagaaaacucuuauccaacauaauaaccaccuuaagaguaaucguuaaacuuuaauuauuuccauuauaacaugauagggaguuuaggaagcagcauuugaugagcuauguuccacuugguagucacagugcagucuuuauuugaauacuaguucauuucuugaguuucacacuaguuuauuucauugacaggacucaaugaaauaaagacuuugggaggcagcaggaguccagccgaaauauuacucugcagacuguccugggaccaaaagccuuccaguguaacuucuguuuguagcagaaguuuggcuguuguagggauguuuugucauugugaccacuccaaagggagugauuuuaaaaaucaggaaagaaagaucuaaaacuccacucuuccucaaacacuaccucuucuagaaugccucucccauuuauaagggggugacagucgggucugcaggcuaccgagggccacaucucuauucaguuucugaagaugccacccaaaucacccgucuguaaaaucacaucugcaguaaaaguucucgaugaguagucaugcauuuucccugcucguaugagauaaccagagcgaucacagugccucgcccucuaccuagugagucuuccuaagucuuggcaaauuccuguggugcuuggucacucgcaguucuucuagcaaguggaccaguggcugauguauucggauucauguagagugauguuugagccaguucaaaacagugaccacucgagucauuccugaaaggacagauuucuguccuucagagacuuauucagucacuuuuaaugucacuuuuuauaggagugaauucuggauuuagagcuaaguucauuuaaauuauuucaguuagguuaaacaguguucacauauauauauauauuuuuuuucgaucacccacagaauauuacguagguuuaggcugaacagcucauucucugaaccuacccuggaugucuugacucacuguugcuugguugcguuaaagacgguaugagcuuuagcuuccaaacuaacagaagcugaacucugaguacgugccaggucaucuacacucugcacuuccuaacguacugauguucacggagggucauuuuaugucaguguuacagcccuuuguuguugauucaaaauucucuuuugcaagaugaguggagugaaaaguuucccauuaagcaaacuucucugaucuguugcuaucauugaguuucuaauuuggaggaauuguugaagaaaagaccugcauggaugccucauuuuaaccuccucacuggcaauugccaagaacagucagcagcuuggcgugccaugccaggcugcugcaggggccccuccucccuuccugcugccaggaggccuuaccagcuugugugugccucuuacaacacucuaaggugggggugguuucaguaagguaggcuuucucaaccucagcacuauugacauuugggacuggauagcucuugguuguggggguugcccugugcaggcagcauaggaugucagcagcauuccuggccucuaccugcugcauaaccggcagcagcuccucaguuguggcaacugaaaacgucuccuuccagacuuugcaaauggcccauugguucagaaccucugagguuaaggaaugugcugauguggccuucggugccuaucucuaccugugguuucuucugccuccucccagacaaggucuccaggugacccagcuuugcuuuugcuuuuaaggaaccugggcccuaucugggaugcucugucuggaucggaggcauggacggccaggucuaggcuuucccuugggagagaacccugauggguugaagauuguguagccucaagccucuuugcucuccccaugucuguguucuuaaugcagaggacaguaacuuugaauaacuuuuuagaggguuuuuugguuugguaauuguuuuuugauaauuugguggaucacuaaaauuauucuccagucuaaacuuuagaaaaagaacuuacucauaacauuucucaccgcuuuuauauuuuguuugugaaaaauuacauuugcaaaaagaaaagaaaaaaggauagccauccuucugaagguuuugacuauaucuuaaaauccuaaauuacugaugcaggccaaacacagcuucuuccuguugggaguuucugcuguauucuuguugaugucagucauauaaacaaacuucaaauuaaaaaccacaaggaacagcuguaggggcucuggagcagggauucugcccggagacaggcaggcagcacaauccucgagaguucccaggaaaugaaauuccacauuuggugugagcagcccaggucuuuccaugguauuccuagcacauacggugugcuuucaagccuuugaucuauacccucugaagggccuauguuuuacagccuuuccagaacacagagcccagggcucacaccuaucgauuccaagggagcaagccaucaaacuuauaccaauucuugaaaccacuaagauacauuugcaagauaaauggguucaagcucuccuacaucccacgguucuauacuuggggugggguauuuagagguagcuuagaauuacagucaaguaagguccuucacuuuuugucugauagaaucaucccagcauggccccagaucguucuugcauuuguggguaaacaucauuugucacucauaauaagaaagugggaagaggagaauguuaacauaccuauagauaauacaugcacuguuccugcaugugucacaauuagcugugucuugccccguccgauaugaaagccuacaagauaagaacaggagagcauuacaagcgguggcugggggucacuggcuuuauagagcagaugccucaaaucaaaugccuucccaaugccaagcucaucauggucauggaaauugauuaaugcaugcuucccaguuugcuccugucucugcuuucguuguacaaaaccaaugcaacaccuacagcuaagaugauauuuaaauuaaauuuagaagugaacauaagcuccuggaugaaguaaauaauaugauuucguuauaagcacagggaaugugggauguuucaaugcagauuuaugguguuuuaaagaaacuuugaggaaaaaccaaccacauacacauaugcugacuccauggcuuauguuugcucuaccccaccuguccugcuacaacugggacuggcaaagugcggccugcaggccaaaucccgccggggccugguuuuguccagcaaacuaagaauggauuuuacauuuuuaagcacuugaaaaaaaauugaaagcauauaauauuugugacacauggaaaugauccgaaauucaaauuucaguguccaugaauaaaguuuuuacuuuugaaaauaaaauggugaaaauuuuuaugaaaauaccuauuucuaguauccucaauuuugccucuuggucugcaaaucccugaacauuuacucucuggcucuuuagagaagaaaaugccaagccuuauguuagaaugucuuacucccauugccauaacuucugaguuacuuucccuggcuuuauucucuggucaguucugucagaccccugaggccgggcagauuuuggccuuuguaggggagguugcuaauucuccccccuaauuaaaaaauuaauaauaaugaucuuggggucuuucuguaguauauuguugaagguuguauaaacauaaaggguugaugaugagaauuuucuggaccaggcuggaguugccuuggcuguuucuugguccagccacguaggaacagcuggggaguguuucaugccuucacaguuucuccuauuuuauccagccuuuccucucugacauuuuuaacaugcagauguguauuuucuggauauuauuuuguguccaggcacagacaugauaaccggaauguuaaauuuguggcaggagaaaagcucccaucugcauuagcuuauaaacacucugggggcaaauuuccacguacagagcuacucaccagaguaacagugugcacagaaggucuucugucaacauugcuagucaguacuuuuuauccccuuugcuguguaaacuucucugcaucauggguuuuaaauugaaaauaacuuuuguuuuccucauuauauugucuguuacaucaacauuugacaaaaggauugucugcuacaugccgugauugucucagugggcuugcaaaacucagacgugaccucaugguuaugugcaguuuguugaucaagugaccauauucugcuccaaaguguugccaggcacuuucugugauucaucauauuucagccagaauuggaauuacaguauggcugucucuaucgucuuuccaucaucaccucccacaugaggugccuuuggaaccccacagcaggccauuccguucucccguuggcuuugucaggagagagggggaugaacagccugugccuuauccccuccccuuguuccucaccagacacggugauuuuguaguccuuaccccuuuccuccucauggcaagccccaagaaugcauuccuccugcaccuucccaccuggcuccagauuuguccacccuauggcaaggcucuuccacaugaugacaucacccuucucccuucucucuugcccuauauagacuuacagccuuucuccaucagcuaauucuacuggagcucggcucuaagcucagugcugaccaaggucauuuugcacagugaagucagugccauccuugagcucaggugcuggcaauggcacgguccacgcugaauguguuguuaaacuguuggcuuggguggcagaugagguacugcucuacuauuguguugugcuaguggguauaagccagcagucaggagaaaguaccuaguacuugucuauaugugcuagucauauccaaauuuuagguucuuacagugggcgaaaccagggauauuuacaguuuucugaaggcacucuuuuugugcucauaggaaagugugaauucuaagcuuauagaaccuuccugcccuaaaccucaggggaaaugucuaucaagccucaucaacaucaacacuccuuccuugcccaguguccaaguuucccagugccucacuugcauuagagcccugagccuucuaauuaugcuagccccacuuacagaggagcauacagucacacuucagguccaggaucucauuauucuuaggccccaggcuucugaugcucccugucaccuugcuuguaugcuggggcugguguucugcaccacauguaauuggcagcuugggauaggcaaugaaccugacaaugagaggacaaaggcuucaggcaccugaaauguacaagaggaaucuuccaggaccuuggaguacuucaguaagaaauugcuuuucugaaucuuuucuucucuuuucuuuacuuuucuuuucucuuuuucuucuucuucuucuucuucuucuucuuuuuuuuuuuuuuuuuuuuuugagaccaaguuucgcucuuguugcccaggcuggagugcaaugggcacaaucugggcucaccacaaccuccgccuccuggguucaagcgauucuccugccucagccuaccgaguagcugggauuacaggcauacgccaccacucccggcuaauuuuguauuuuuaguagagacgggguuucucuauguuggucaggcuggucuugaacucccaaccucaagugaucuucccgccucggccucccaaaguguugggauuacaggcgugugccaccaugccuggcccgagauauugcucuucuaaagcccuuccugaaaagacuuuacugcagucacuuuguagaaagcacauauuccuccauuacggucaguaagcaaauaguuauuaaguacauacuaagugugaaacauuuuucuggcucuacaggagacauuugcgaauaagauggaguccuuguccucacaaagcucacaguggcgugggaguggcagaagggcaacauaaaugcauaaaugagcgaacgguuaauuuuugauacugcugaguguuaaggaaguguugugaagcaguauuuuggucuagaaugaacucuaaggaggugacauuuuuagugagaccuggaugguaaugaaaaagcagucagucaucuguugacccaggguuggauguugcaaacacaaagaccgucacguguuaacauccugcagugggaaugauguuccucuguuugcaagucagaaaaaaaggccagugcugcuggaauagaugcagcaggugagaguggggagagaugaggacauguguauaaaaugagaggcccuuugggcauuauuuuaaauugaaugggaagccacuauaguuuuucuuauaggugguugaaugacauggaaacacuucuugacuuuuacucucaauccucuccuucuauaacaucauuuucacucaauuuucuuucucuugcuucuuuuauuuacaacccagcccaauucaccaauuccugagaaaugguuuggcugacguuuguugguaagaaccaaaggagucauuguguuuucuuuggagacauaucuguggucauucuuuuuuuagcuaguugaaaacaguggguggucugucaguuucuaaauauauguauguuucucccaugugugagaauuauuuuuaggacuucauuaccaugaaggugagguuuuguuuaaguuuuguuugggaucuuucuuuuguuuaaaggaaucaguuguuuggaguccaugaaugucagcaggagauuaauuugugaauaaaauuuaaaguguugaccuugucaugugguuaauucacaggcagcugccagcagcuggugucaaucaggguaugccugcuaaaauuuuauuaagcacgagaguguucucaauagagggcuuaaaacuauguaauccauugugcuuacugcuuucauaauccaucuaauuguccuugaagcuuccaagcuguaggguuuggcuucacugauaauuuuauggucacauuaauaauugggcugcagcaucugaauauguucuccaaauagagaugaaacagauaaguuauuucuacaggacagggaacacagagugcuguuauggaauuucccuauuuuuuccuucucaacuuggaaacacaucagaaaacaguacuuugaaugauucucuauauugccauugccauaaggaagaacaaccuaaaaacuuuaaacugcuagagcagauucuucuccagugacaguagggcuggagaucuuuuguagauuagaaguuuagagaggagaaagcuuagguuauugauguaaaaccugcaguggaagaacauuuggaucacaaauuauaaauuuucugucuugcagauuaauugcuaccuuuguaaagcacucuucccuuuugcuuugaggagccuguauuauauauacauaggcuuguaacuccaugcgugauacaauaccugguaccuucugggcguucaguuaauguugauguagccaagucauagaguccauauuuguauuuucauaaguccagaauaacacacuuaccuauuuaaagaauuccaacugaguguggacaaaaacccugacagguauaaauugugaaaaguucuagucuucauuuuucuccccauaugaacuccuuugggugcuaaugauaagcauguucauuguagauauggauuuuguggcauucacuauguaucgucccauggcaguuaguuguaaguauucucuuaacaaugcauauagcuuggaaaacaucgcauucagcaccagggacaguguuaaaaguccaaggagcucucuuuuuuuggugcuuuuguuuucuguucuguugacccucuagccucccauccuucuagaacuggguuuuaucccagggaccaauuuggggacccuggaccucuccuugcuugaugccuuuugaacacuccuuggucaagguaggcuugccuguuagaggagccuggacaugaacuguuaauagggaagcuauaagaacauagacucugcgacagugcaugaaagagaaggugaugcucuguuagaaacagaagggaucuggacaagccaauucuacaaggugguuuuuguggaguccaguuuuugagucauuuacauuucuguuuuguagugaaccaccuuucuucacaggacuuugcucuacuuuaaagaaaggaaaauaaacuuggcuuacagaacacagcguggagcucuagucagggcuaccucucuguaauggccuggaccucucagguuuagcucagcaugcaguuccccaguuucucuagcuaccuuauaccuuuauaauaaucggcucuaauucuucaguuguuacuaucagcaauuccugaauguauaaauaaauauauauacuuguauacuuacaaguauauaacauaccugaauuuuuuuguguguaaauacacacacauacauaccuuuguaaauuuauuuucaaaaguagugacaauucggggcaugcaggucuucaguuaauccuuuuuggaccaauagcaaaagagggaauauaugcaccuuuguauauuuauuuuaaaaacuggugacaauuugggguauacguguuuucaguuauuccuuuuacggaccguuggcaaaagagggcaucacggguagacauuugaaaagaaacaaagaagggcaggcccauggcagagcuggugcugcaguuuuugugacaccacugcaggaaugauaaaggaggaggguggcugccggccucagccugagagccgcaccauggccacguccuggguggcagggacuccgaggagcagggcacgggagggcuggacggcaucugcucuuucaugcugacaccacagggagaucuaagucagcagggcccuggguguuaggaaggguguugagaaaugucagagaaagaucacugcaagcuuucuucccggccacauauccaagcucugcuuagugucuccgagaccuugaagauggggccugagaggcaggacuaacaacucugaggcaaucauaacaaaacaugaauuguuugguuaaaaggucaggaaagaaaaaaaaaaaaaagucucucacugugcugucauuagaagcaaagaccgagaaagugacaagcaucuccuagaggaaugguuagcaaguggaaacuaauuuuacaguaccuaauaguaauuacaguacuaguauuggguuauuggauugauguaaaugugcuguuuuuacugccauagucucacaacacuguuuccuucauaagaucuuaaauucucaauggaaaguucucuucucacauuccugggugacuggauggggcauuugugugugccuggucugguugcagaguucagcagcaugcugugggccccucccuggaagauguguucaguacucagugcaggggagggcaagugacccaguuguugauuugcugcucuuuuaaaugccuuguuaauuuucagccaguucagagcuucuagcaugucagggagcagcacguuggauagugcugaaaucaaagcaugaccuucuaaguguggucuucaaaauguucauuacauaggguauggcaauugucacacugaaucaauucagaggcuguauccuagguuuaccuguauggaccuuagcuagagauggugguuguugcagauauaaaaaaggcauggucucugcucucaaagaaaauguuuuugccguuaauuuauucucuuaaguuugaucucucuuguucuuucaguuuucuuacuggaugcaacaaccguuuuuuucuucugcauucuuacccagguuugugcacuagcugucucuucucgauaacuaagccaucauuuaugucagcaucuugaagggcuuuuucacuuaauagucucaaagugacauuaauuagaggcauaaaaugauaccaccacuauugcugggagaaauuaaguuucaaaaaguaguaaaggcacuguuuucagugauucccuccuauguuugagagccacucugagcaguagauuuggcuuguuucugaaucuaaggucucaccaggaguuugccagauuaugccccggacauguacuuauuuuagaugucagcuguuuacagcuaaaguggauuuagacuucaccauauacucauggaaacgcaaguacauugucuuagcauuugagcuguuaaaugcuagaauuugagggaacagccaauuuaugguugcuaaaagaauaugaaguugauuuucauaaccaacucccaggaucaccccuucauuagucaaaggcgguacuggcuuuuggugaugguuugucuguucccuuuuucccaguagcugauaggacccaucugucagccagcauccaacuugcugaagugaggcugagcaguuaugagauccuugcuggccuuggaucuccaaguagacaaaguaaguuguuagugguaaaaacugaaguugcaauuugaagagcacaaauugugacccuccauacuggcaaggcuguuuggaguacugccucuguucuccccugcuuuugggaugucgaacaggggugaguguugacaccucuccagcugcccggcugccaccuuuugagaguucugcuggagcagcuguucuuuacggauccuuuggcuggcucucccccacucuccucgccucugcuccauuuccucugccagaacaccugucuugccauguugucauggcaggcuaaucuuucuuuguucgccagucacagaggagauggcaagaaagaucuguggguacauggaaugaugaaugaaggaacaaaugaaaaaauauaauugagaaggugucuuugucucagaucuauggggguuggauugaccccuguuccagagaaacuuagcagcuuuuuccugacaguuaaguaaaacucuggaaaacugucucccauguuuucugcucaggacguugaugaugggacaggcagugucugugguagaguuacuuuaauauaaccaccacucauggguuucgagaacguuaaugcgauuugauauugucugauugguuucucuuuucuccagcucuuucgccugcagauauaugucaggugguaaagcugaucccauuagcucucaguauucuccauuugucuagaaugucuuucuggggaagggcaaauacuucuuuuucagacacccguguaaucucccugaauaugaacaugcauuuucuauaguguuucuuguauacaguugugucccaauugauuaguuuaagggagaucuauuuuugucaucccaugugagaacuuggaaguaauauaucucuaagaacaugauaguuagaucugauagcauucuaaugcugaaucuccauauagauuaaaggauuuugagggcuacccuggcaaccucaacacaaauuacuuagcaaugauguuuggagcacagcuaauucagaaguugaguugggucugucuucaucccauuucucuuuaccuuacuuuuuuuccaugguagggcaaaguucucagaaucacacacaucccauuccccuaaagccaggaaucgagauuuaaacccuggaaggaucaccuguacauguaaacuccauguggucucauuuaacaugucaggauaauuuucaacaagccuaguuauuucuacuuaguguucuaaucauagaccuuaauggacuuugcuacaaaggagccgacauaacgagccggccuccccaggccugccagucccaguucaucuggggcuugcugugugucagcacugugcauggccugugcuggggaacaguugcuuggaagaauaaaacacaggucucgcccccagacacuuaaaauccagaagaccuuuguuuccaaaaugaaggaauucuugauggguuaaggaagcagagucacagaacccugaacaguagcacuccuuccaugggacuguucuaacccgcaugcaaaccugcauccuugguccgggcccggcuucucucuucccuccggggcagcacagcacauccucagugcagcacucccagcaccuuguuuguggcucucuugcagaccaugccacuguggaaucugaugaucagaugcacuuucucuguccuaugggacugggcauuuugcuggcugggaacaugucuuuguuccucuucacaauccuagcugauagcuuggugacuucugcagaucggggcuugaggugcaucagcaaugccugguccuuucaugcccagugaaagucaguuuccuucccaccucucccucccucccugcuugagacuucuccgccacauuuaucgccauggaguauaccgggagcuguagcuauuucgcuuucccugucucccuccacgagaaggucaacacaaugugggcagagguuuuugucuguucccgggcgggcaaacuuucagugcccaccucagggccagaaguagaguagaugacugagaaauaucuuuugaauaaugcuugagugaaugaaugaaugagugaaugaaugaggagucugugugagugcccuuuugggugaacugauaacaugcccuuuugcuucugaaagggaaaauaggacucucacaauuuugugaugcgucugucuaaauaguauucauauuagcccauuuuaaauuuccucaaacaaguagaaaaaagaucagucgucuucugcuuccgacacccaguuuugaaaauaaauagcuuagucuugcaccuaaaccaggcccacuuccgugucuggauaaagccuuccuuuuuuuuuuuuuuuuuuugcccugaagcaauccugguggacguguuccaggaagaaacacccuuaaugaacucaguggcuuucuuucgaugguguggacaaauuaacuuuuauuggccucgcagcuccccagauguggugacacuauaauucuggggaggcucuggcuguuagggaaguuuuaaugcuuguuuucauuaucaagaauuaaaggguaacaaugcugguggaucguggcaaagcaucacaguuagcagggagauuccaaccuggguggcgucccaggggacgcaggggucagccgggcucccucuccucucuuucucccuuggcccuuugucuucccugucauuugccuccuuuuuuuuuuuuuuuuuuuuuuuuuuuuuuuuuuuuuuuuuugagacagaguccugcucugucacccaggcuggagugcagaggugcgaucugggcucacugcaaacuccaccucccagguucaagugauucuccucccucagccucuugagcagcugagauuacaggugcccgccaccacaccccacuaauuuuuguauuuuuguagacacgggauuucaccauguuggccaggcuggucucaaacuccugaccucaggugauccacccgccucggccucccagaguguugggauuacaggcgugagccacugcucccggcccugccuccuuguuuuuguugcuccucucuguagcccugucccagcaacuuguaugcuuccuuuuucacagagccaucaugcaugaugaagaaaauggaaugcaucaguauuuuauagacauuauuauugucagaaauacaugcagauuuggacagggacaaauacagagaugaacacuauuauuaaggcaggacuuuuuauuuuuuagcuuuagugccuuuuaaucauauuuucauaauauaaaaucauaacauaaauaucaggaaagcuaguaauuauuauuuuguguguggacugccuggcuauauuauaaacagggcaaagcuuacauuuuccuuccuucauucaugcagucagggaaauacuaaguugcaaaaugaugacaaugauacaaacaagucauuuggcccagaaggcaccaggagcagcuauuaauaaggaaaacaacuuuuuccagcugaggccgaguugauuaacuuauuuuccuggaggagagauaaagcuuaagcuauaauuuauugaaaauuaaugaaaaugaauuuugguggcacuggcuaucaaacuagaaugaaaauaagaaugugaguauacuguauuaaaccaaauuuuccuucaggacucccauauuucuucagcucuuguacugucacagagguucgaauuugaaagcauuaauguugucauuuuuugccagugguucugaugguaaauauccacagagucuuuuaucuuuaauuucuuuugauguguguuuuuagaucaagcuuaguuagcaauuuuuaaugagaacuuauacaucuuggagcuuuagugcuuuguuucaaaagccugaccuugcauuugcuuuuuaaacaaaugucucagagcucuuguugccaaagacuaaaaucuugaaauuuuggugugaucauuuauaaauuucuugauguccaguuaugagacuuugcuagggggauaaccuagugcuguaaccaaugacauacugauagaaaaaacuuuacugccuuuuugguugaaggaugcucguuguuagaucauuuuuucccccaggaucucaauuuucaugaauguucuuuccagccuaucuuuaagguuuauuuuuauauugcauugcaaacaaugcaguaucaaauguuuguuguucacauggauguggacaucaauaugaggaaggaagagccagacaggcaugugacgguccucugaaggaccacugauauuacaaauggccugugaacuggguucccaggcagguuccucaaggagagacguugcauccuggcacccagaucccuggacuuaaagaucaauggccuugauuugucugaaauuacuucacagagaggauuccuguuaaugauuacagauccuucccaauacacuuuauuuaugggacccucucaaugaggggaucucugcugucucuagcaccggaaagaugcuuucuccagaagaugaauuggcaugaacccuaccaggccugggaggguaggagcuucuguagccuuuucaaguaaaagggaaaauccagacuugcauuagcaaaaaaauuaaaaaauuuaaaaaaugccugcauuuucuuauuuauuuauuuauuuucugagacagagucucgcucuguagcguaggcuggagugcaggggcacaaucucggcucacugcaagcucugccucccgggcucacuccauucuccugccucagccccccaaguagcugggacuacaggugccugccaccacgcccagcuaauuuuuuuuauuuuuaguagagacaggguuucaccguguuaggcaggauggucucgaucuccugaccucgugauccacccaccucggccucccaaagugcugggauuacaggcgugagccaccgcgcccggcccaaaaaaaugccugcauuuucauuaguucauguugguuccccauuuucaggggagagagaagaugagugggccggucugacagcccagaugugaauucuggcauuaacaugucuuaccagcuuuuugaccuuggagaagguacugagcauauccaagcucuagcuuccucauggagggcauucccaccuuggauuguuacucuaaagauuaaagaagauaauaccaaauggcuggcacauuguaggugcccaaaauaggugaccucuguaggucaucuguauggggauucucauuucacuagaacgcucccucagcuccagugggaaauagagcucaaaccauuuuugcauagcuuagcaggaauugcauggaguuuuuaaaauuauuugaaaauuagaacuugcauuucauuuuuuuuuuaaauccaaauucugggacacaaauccauaaauuccauaaauguucaugccaugccuugaauugcucauuuuaucugcaaaugggcugucuggauugccuaguggcucgguggugaggcuuuuauucaccuaccaacuuaaaaggcugaggagguauuugaaaucuauuuuggcauucugcacaggaagauuauuuaaauuacauuuucauguaugugugauaccuacaugaagcccaaagcaagaauuugaaauguguuuuauauucuuucaaauauauuuugcuuuauuuuucauauuagagauggaaagccuuauuauuuuuuaagaacuuaaaaguaguguuuacaaaguuauauaaauauaagcuauaaaaaaggcuugcugugacccugugaauuaaaugaagaaaaugauagaaagaauaugaaaugugcuucccauuucaaaauuucaaagaaaugauaacuuauauuugggguuucgaacuugaauauucuauugcaaauaaauaaaagccauuaguuucaacagaaaaagaaaagaaaauggcuucccugaaaacaauucaaaggauugcaaccuugcaggacagagaccaacucuagcauuuguaguacugggagagauaaggaauugaugaagugucaagaggaaaaagaaaacagaacagugggaucauugcacacuuuuauugauggagaucugcagcgagguucccccccgccccgaaacuuuuaugaauauuauaaggcaguggcugaaauugugauguucucagacaucucuauagaauauguucuuggagcagaaaggagccucuagggccucuccucucauuuggaccauguuccuuucauaucaaaaaauguagcucagaggcuaggccagggugaacuaaaacaaaauccaggucuccugacgcuacaucagcuccccugcccgugacaccaaaugaacugguccuguccuuuucucuggaaaccaccaagacaaagcuucaugucuccauuuagugauccucaccaccaccccccauccccaaaauacaccacccuguaaaauaaagcaagaaaaucucuucccuguguucaagcuccuccccuggcuucaccucccugaaucuuagcacuuggaggguugcuucccaguagcaaaguaaccucaaagguaguaacuuacugagugcaaacauagccugaggacugagacccucuuuguccauaauucauuucaucuccaagagaagcccaagaggcagguauucucagcuguuuguuacagagaaaagcugagguccagagggguuaauaagccugugcacgcaggucaggagagggaaggucagcaucucaggaccugcagaguggagagccuggucaccccacccuaucccucuccugaaucucacucuggaaaaauggaagaaccaagugcaugggaggcugaccucagccagcuggcuggaaugauuuaaaauguuuuggguuaugauaaauguggagagagacaucgaaacugauuuaucaagaauauuagaaaaugaagugcugacauuuccaugccauucaaauagggagugcuaaggcacaggagagcauuuggcagcaacaaccuuuuugcuucugaucucagcucagcgcugcuuucucucugcugcucacaaugcccugcuuuucugugaugcaucuggccagagccagggaacacggcacucaguauuccagagaagagccacaagaucauuuucaggacugcagaggcuguugagagacugucuaaugucacccaccuccucuccucaaaauugggccauucucagcuaaccagguggaagacuuugaucucuauuaaguggguagguuuuggcaagaacaaccuaaucauccugcuagagagugcauagccaaauugggaugggaucaccucacugugcccagcuuuccccuuggcucuuggaggggugagccugggaagccaggaaaucagacucuaagcccacaccuucgugauuccucagcguuuaugcacagcugcugcagcggugcacaauuuuccauguggguucuuucugcucuguaacuuaaauaguccccuuaugcuuccucuguaauugugaugcaguauuuauucuguuugggcauugguaauuagagcaaauucagagauuucuuauccccugacaggucucucugauucugagugauuugucaauaugaggacauaagauacagcaaguauaucauuucuacccaucuagcaucaauauucuagguuaacgcaagucacaucacgcaaacauguucugugauggcuuuuuauuucugcugcugggagaaugagaccuuuuucauguuuccaagagaugcugucauauacauuauacauacauauuagguauaugugugucauacacacacagaguuccaaagcaggaccccagguuguaugggcugaugaacaauuaagcguauauuugaacagccugaaugccgaugaacugugaaccccucaaaggcugggcccgaauuccuuugacucucacauccccucauugccuggcacaguguccaucacuucagugauguuuggcagaaaccuucuaaaugugugaaugaaugauaggccggugugcuuggcagucacacaccuuggacugccugcacccauauucuggccugaacauuuuuagcuguaugaauauggucacuguauuuacaaaccauauaucaggaguccauaaccuauggcuuguggcccaaaucuggcuaccaccuguuuuuguaaauaaaguuuuauuggaacacaaguaugcccauucauacagauucucugugggugcuuucaggauacaauggcagaguugaaucauugugacaaagacuggcugucaauauguauuuacuauuuggcccuuugcagaaaaguuugcugaccucugccauguaggagcugacccugagccccugcaguaaacacagauguccaugagacuaaguccuuaccucuuaaguauguguaugugcacaugaccuuccauuacuuguuggcuauucauuguuuuugguaaaguugagcaaaccuugguacaggauaccacacuucgucuguauuaacucguuccaucccucagcucuuucuuccucucucccuugucuugaacaccaccguaagcggcacccucacagagccccugaacucaggggguuccuuuagcuucuuuuuuuaccacugugugcccgagacuugggagagcuggccucacaccaccaagaaaccacccuuucucaaugaggaugaacagaaccccugcugacagggaacugcccccaugaugggguggcagggaugaugggaggugauaaaugacuggguuugccacccuuccugcaagguacuagacucuuuggguugguguguuacuuaggauuuucuguuuuuaaucauacucuugccuuugcucugaauuaguaaagucacaaagccccgaagccucagggucuuaucacuaccugcuggucauguuuaagggccugggguccucuugcucucucccccuaccccaagccugcagguaacacccagcaaaugcugagggaggccuggcccauagaagaaucugcuucacucugggcagugacagauucugaucaugugcuugauauccucaaguaaagcuucucacgaucauuucuggucuucuccaaauagcagaguaucauuaggcugucaccagccaauggacacuucaagagacuaaauguuuggcguaggaaaucuaagaggcaaagagcgcugucgggguugccacacuguaguugcuggugaguuuacccaaugagccaccaagaccuacaccccauuggucugaggaucuccugcccaggaaucccauagcugcuacagugaauuagcacuguucuaauaauugauuggguuuuuuaaauccacugucccauuugccuuguucuuagccuucaaugacucccauuagugacuuauuuagguagccugugugacccugaacuuccccagaagacacaagcauaauacuaagagcucugaaauaagcaggauaauucuuggcauucaugcaagcccgcacugcauaaagcagagugauuuuagugaauugccccaguguuuuacaagggacuaaaaggcgugauuuugcauacuuuuugcacaucuaaccuacuugcagaauucaucccacugaaaugcucguaacaggauauguccuuuauucagcgccaacugugugcugguuauaagugggagcuuuguagauacuguauuucagugucuaccaccccuaguugauuucagacaaaauugaagcucacagagguuaaccugucucagccauaaacauucucugccgaagccauuuggaaaucuacauaagcaaaugaaaauaaugaaggagagucucuuacgaaaaauaauuuggaagcuacugagagcgguuguagccagugacacagaaauuccugcacagguuaagaacuacagggaagcacuugccugacaaacucaauagugaaaagaaguccuauuaaagagauuuuacaauaaacauguucuaagaaacauacauugcccagggccaucagcgggauucaaagaauacuggcuucccaaggagcaggcccaugaccccuuugggccaggucagaccuuaaguauaguguggaaaugugggggcaagauuugucacuuguauucaaacucaugggcuccgaggugccugcccucacuaggacucuucugaaugcagaugaaauucuguuggaagccccuguaugcuuuauugggguggcaaguggggagaggaacugacuuuccccagcuucaagaguguucuccagcuccugauuuguaggcuuuagaauauuuuccaagaaaaguuccauugauuuuauuuuuauuuuuuugagauggagucucgcucuguugcccaggcuggagugcaguggugugaucuuggcccacugcaaccuccaccucccggguucaagcaauucuccugccucagccucuggaggagcuaggauuacaggugcccgccaccacgcccgacuaauguuuguauuuuuuaguagagacgggauuucaccauguuggccagacuggucucaaacuccugaccucaagugauccacucgccuuggccucccaaagugcugggauuacaggcaugauccaccgugcccggccuccacugauauuuuaacuuggucauuugaguucauugucguaucauauaauaacuauguaucaguguacacagagugcauuuuccuguuuucuuuuuuuguuuguuuguuuuuuuaaaccaugagaugcaacuaaaauaccaacuucccaguucagaucugguacauaaaguaagcccugugaaucccucguucuaaaguccuagaacuugcccuucaagggauugguugggugcugaguggagcagaguguuacauuuuuaggauuucaugagauugaaauuggccacgguagcaguauuuacaccauggaaaucagcagaugcuacuucccuucccuccagagccuguuguuccagaugucccagcccagugcuggcugccacugcucacagcugucacuccugggacucugugcuguacccagggucugggaagggauggagaaugagcuugcaucuuaucugccugucucugaggcugcaguccucuccuauguucugacauggagaagacgggugggaaauuugaauuucagccaaauuaaugacccuggggcauugagcaagagggggccccauaagguggccuugaauuuuggagcccauaagguggcacuugauucuuugcuaucugaguccagagggcucugagagagaggaagugaauguucccaggaacacaacagagaccugccuuucuaccuuccaccgugagcuugugcuggcagcaacugaacuaggauugauuuuaaaguaaaaccauccuuugucuugauuuaaggugcccaaguccucagaugcuuaagaaccaggcacugugccauguucugggauaccggagugaaugacauuucgugaugauggaaauguuccguagcugcacugucuuauguauguggcuaucgagcauuugaaaugugacugcugugacugugaaguuucaauugucauugaguuugaauuucaauagccacgugcagcuaguggccacuguauuggauagagcagcuccagaguuucagggacagucuuguguggcagccugugugccgggcauauaggggaugcauucaucacauuggacgcccacaagaccacuaaguccuccccagaccccugcuccagcauugcuggccagcaagaucaacacucaugccacuaguggacaucuacccauucagacacaccugccacuaggcugaacacauuagaaggucaccccaugucauuccauccccugucugcaggacagacagugaucucaacuuacaggugaagaaagaaggcacagagacauacagcccuugcccaagcccucagugccagauuccuacccagacaugucuuaguaaacugagaaccacacugcuagauggauggcaucucagagaacccugaggaucuuauuuaaagcaaucuuccauacuuguucuaagaggaguguaagaaggcgcucccauauaucguacgguuuuccuuucuuguguucguggguguucagcccucucagguucuucuuugggcacacacuccugugaguaugcacauuaguguacauauuucauuuuacaccauuuggugaacuuuauuucaccaaagauguuggcaucuuucucuuuugcugucugguuuaauucacuaccaacuauaucaacaucagugacugggucaauguuugaccuuuuaauuuuuuugcaggaauguggacuacugaucaguaaaucacuggucucccccaccccacgccugaugaguguugcuuuuggaucuguacugauggaaaugggaugaaaauggagauguaaacccaagauugaacaaggccuuuuggaaauguuauaugguguuagauuaccuaugaaucuacuguuaagauuuuuguacauuuggcuggcaguucuuuuugcuuaagagcaucaagcuguagacaggccuccugcaccaagcuggagcagccagagcccagggcaggaccugccccagccucuccacugcuggagcugggccuuucaccucagccuccaccuuaaggcaggagguguuuccuccccauucuuugcagucagcaaacugucuaacucagccacagcaauccucuuaaggaaacuuugugcccaggugguuuucuguccuggaaauacauuacuuggcuuauuucaggcuggcuucuagcuugcuaaacccagggcucagggcucgcagagugaagggugcacaucacaugaggcaacagggcgcugccuccgauguuaccuccaguacacaggcuagcaggaacacagacacuuucaaggggcaaugggcaagagaggucucggcaauccaggcgaaguccgauaacccccagacccagaguagaacaggcugcuuuguaucagcugagcacaugccggccuguaggaggcuuccgcacuggggagcucaagaacuaaaaccccaccuuuaggucauuuguuuuuaaagaugcugcugcacaguuuaaacuucaaaacaugaagugcaagauggucuuaucaacgcaauaaaguauuggccgugaaguuaguaucauucuuucugcagccccacuggacacauagggcagcccguggggaagggcaucugucuccuaaucauauacagucaggacuggucucacaaugcccauugcuucuuuggguuccagguacagaauggaaaacacacugucuaugauguaaagccuuguacaguccugaauaccaauauuauuucaauuauuuauuauaagcaagucagcauuuacuuuuccaaaugucacaugaaauuuccuuucucuuccuaauacgauuccuaagaggccuguggccucuucucuuccugauucucuucuuauuuagaauagauauuuuggacuggcauauguuguuauacauuaucaauaucauaaaccuuuagcccuagcagaauaaaaggaaaggucuaucaauucauucuaagcauagguaugguuugaauucaaggccagaaagaugaacauuaaccagaaagcguaucgugcaggaugcagugacgucuaguaucauaaaauaaucugcgaccccuuggagcucgccacgcccuuagacuaugaccuguuuacggaaaugcuggcuuuagucucauuacagacuuggguuuggggcuacagauggacucuguggugaucagccugcauagcuuccuaagacaugggugaacauacauacccuucccgaugggccucuccuuuuuccaacuccugaaugacccccaagagcacuuugaugguuucuuggcuugaacugaucaaguucuccaucaucugaaguugugcuuugaggucgaccacuuccguaugaggcacgauucguuggcauucuucaccugcagcaaccgcugugggacuaggcugguuccccagccccggcggggugugagucugcgacggcugcucacuacauucgggggacaggcacugcaucgggggugagcaggccagggcaguuuccgagggcgccuggagcccguugagauguguggcucuccuccgcucgucaucugccgggcagagugaccacuggcuggcggcugcagagucugacaaaccaggcucgggggcccuggcacugagggcaggugcguaaacgguggcaaccuccguuuuaaacacccuccugagggcagguggagcgggcuccucggaguuuggccucccccgguccugcuuggcccucccgagcagcugguaaucgggcucuucggauggaggccgaguggaguuuuggagcgcagcuucuccauagcugagcggcuccgggcuuuuacagggcucugugcaguugacccccaaaggcugguccacuguguucauguguugguuggaauggaaaaccaaggcuguggucuugugcacccgccccgcgccacauggccgggccuccuccauggguccagccucguucuucucuuucgcaucuguuagaaacccauuguuuuggcuuuuaaagggaucugcagcugggaggcuuuugagguuccccuuuuugcgguccagagggaacgucugguaacacuucuuaaggucgggcgaggucugcacgccugugcucuuggugacguuggggauggaccugcgugcgggcacugucauguauuugcgguaggcugcucugcaggacacgggcuuggccucccgcuucucccccagcuggcccgaggacagcugugugucccucugcucauucugugccucgcagauauccuuaaaccgcaccugcagggcuuuguuccguuuuuuaaucugccgguugggguccagggcguauuucaucuccagggccaggcaggcggcggguuccacuucacucuccgacguugugaguaugcauuugccgguguccuuacugaccaugguuccugcauucagaaacagcaacagaggugucagugggacagaaauacacacucaagcaccggccgcacaaacuuuuagccaccacgacgacugccuguuuccuaauuauauuuaagcaggugaggucggccuuuauguuaaggaaaaucacacgggcugagagucgcuggcagcacagcuugaaaugcuucucagauauuaaagccugcuugcuuuuccaggugggauacacucgcuuuccuuuugacaguaaugcauguuuccccauuagacaaaccuguuuuacuacauucaucaagaaacccaaugaugcugccucuucugcuuugcaaauuaucuuuucacacgcgugacuccccuucuuaggcagaugguuuaccaagugcuacuuauuugguuugcguuuugacuauuuuuugaggaugacgucauuaaucuauugcuggaaucugggagagcugcuguuuuaaagacuuacuggagcugccacgucucgagcagauaaauguggagagcccuccgaggaggaacggaaagaaaucuauuugcgugagccguuauggauuccgggggagaguuggccgugcuccugggugggaaccgugaaggagaagucgucgagggguggucgcuucucauggguuaacaucagcucuaaaaggaacguggguuucccugcaucuacaaaggccauguuugcaacuccuuuuauuccauggagagugguacuggaaaauaauucuuaaaaaaaaaaauaaaagaaauuacucauucuagaaucaaguuuuguguugugaucacaaccuccgaaaaugaaaacaaugguggugguuucaguacuuaaauucugaaagcaaauaaaacuaugaggcuuuauguuaaucaugcaaauucauccugggcugaauuauuaaaugcagcuaaaaagaugcagguggccaaugacuccucucggggaauaccagugggguaaaaugccuucacuuuauuaggcggauucacagcuguuuauugcacauggaagaacuuauuugauggcugcgcuuaaagcaagaaaauagaguuaaguguguuguuugugagugaggcuucgccuuuuccccccuuguguuugagaagaaaacagucaaacggaaggcacugaggguguacggggcccgaguggcuggagcugagugcccagagaggcaaggucauggacaugggcccgugagagcugcacagaaacagacuucguccacauugcccccagcccagcugccgaccuugugcccuguccugggggugucugaaaaaccagcccagagaccuguggcagcacucauuggaaaaugccacaagaacuaugacaugcgcagcauggccacugcuucuggagugaggugguucgagugccagaugcucugcucguucacauacagaaugccuugcuuacaaauguuccugaaggucaaggcuacacuucccauuucaaggaggauacuaggguucagagauguugcgucauuuuucggugucacacaggaaauaagcagcgcaggcaggagcaggacccuacuuuaguggaccgcugaauccaugcuguucucauagacccagcuguccaacagacagaggcaugaccccuccccacauccuuagcccuuacugaguuagcaugacaggccgaggugcacggugguuccauaagggggaagaagagacaacuucacagccaccaucuaaaaguaagugacaugacuagcccucuauuaaaaugaccucuaugucucaggccagccuggucuugucaccuugcuggccuccacugcuguucacuggaugaaagagugaaggaaucaaauucuucauacauuaugcuaugaacaacuaacagguaaucauguguaagaacaacaaaaaacaaucucugcagcauuugauuuaggugggaccagaguuucuaaauccuggcacuacugguauuucaggauggaucauuugcuguuggaggggcuuugcugugcggugcaggguggucagcagucccuggcuucuccccacugaagaaguagcaccgcucccucccagugugacaacuagaaaugucuccagccauuaccagaugagccugggagcagagucuugccuggcagagaaccacugcauuagcccuugcaccucuggaugccucgggcucuuguucgauuauccuauaguguguccugaaaggugaggcuugcguagacagcaaaggaaguccuuggugcuuuacuaggugcuggggguauuuggagauugcugcaauuugaaacuugaaaaacugggcaguuuuagagaggagagaaaaggcaagaaacagacuggagaugcaccaauaucuuggccccguuugggauggcuagaugauagguggaaggagggacaaggcgugccugcucaggagaaagcaucgauggcuuuuagagauucuuaucccagcagguuaaacagaugcacacaagacagcuuggugugggggacaguauggguagcaguggggguggaauaagaaaauuaaaucuuaaccuucacucugaucuccuauucauucuuuaacugccuuuguuguccagguaugucagaauguauugugccaucauucugcagaagaccuucauacuagggaaaauuugaaagagagagcauuuuuacaaaaagcaauuuacuaguaauuuaucagccuuuucccugcuacuucugaaaaaugugugucugaauaaguuuguccugccaugcuauucaucaucaccauuugcuagggacugcacugaaauaauuuucuuacaucaguuggcugggguaagaaauauucuaggucuuggacgcaaccaucaaacuaauacaacaaaucagaagaauuaauugcugguggccaaauaauaauaaaaaauucuaagcucuucucuguuuuauagaggguugcugguacauaaaaaucauuucguuguuaguaaaaaaaugaugguaauacuuaggauuuuuaaucacuuuaguuuguuauugcugacuuaaaaaacaguaauaguaauugaguucuuauucucugauagggaaaacaccaaggaauuuuuguggcugguuuauuuuggcuucaaaugagguuaugaguucuuucugacggcuggaugacauuuucuaaagcuuuaaaauugaauuucuggacauuaagaauuacuaagguggacacaucuuuucgggguguucauuugcucuuuauuggggguggaggguaaggcuuacagugauuaccauuaagaaaaugauuuuguuaugaaaggaaauggggcauucuacagaggacuuucccuaagacaaguggaaccuucucccacacuauuucauucaucauuccuucaugcauuuauucagcaagugaauguacauacguuacaguguagcauuaacauucaguaagcaugcaguuaagugcuccuaugugcuaaucaaaugucaccauuccccuaugcauagcaguuguguuuucuagauuugauccucaucauauccuuacaaggcagccacuauugauacccucauacugcagauugagaaaccgaggcacacgauuuugggauuuuuugcaacuugcucagagugaggaggcuagugggccacacccauugaaacagcugaauccguuugaaucacaugcccuaacccacuaccccugcucaaggaacucuguaacuugaagugauccaugauaaacuugaaaacaucaaacaacugaaacucaucugagcaaugcccuugucuuguucccacaguguaucugggugcugguuaggcaaggacauccagguaguuccgguaacacaguggguguuggagcacugagugaauguugccuugaauucuggacugagcaugaagcugcaauaggauucuucaugauggcuugccuuggcugggucacccuagagaaccauggacucugguuuggggagcugaucucuuggcucuaaagcagcaggaguucauaaaguuuauuuuucguaagaaaauuguguuuuagaauucauuggacugugcugucuugaggugaaaauggcuagucaugguugugccuguuuggcucgagagagcuagaugucgaggagcuguuuggaauauaaaugucuuaauuacccucaaauuaaauuucauaaucaaagugagcuguaaauacauaaacccugcauuuuuagauuagugacggagaaccaucucugcaugcugcuuuaaauuaauggcugauaugaaaaugugcauuccaacuuaaauaagugaaaaauggaagcaacuuaauggcuaacaauagguaaacaguuaaguaaauuaugguuuacauucacucugggcggccauuaaaaggauaauuauagagauuauuuaguaucauagaaaaacacgaaauaauguuaagugaaacaaagcagucuacagauuauacuggaaaaaaaugaacaaaaacggucaucguugugguauuaagauagcacauucggagagauuuauuuuuccuucuguuuuccaauuuggggagaauggagggagguacagcgucguucugguuuugccaaugaaaauaacacaagguaaaaucuaauccacaccugaagcaggccucuggaaggcauaaccacuaguaucagaauaagaaaaacccagaaaugaugagauggggcuauaaguaauuugucaaaggucaucuuuuauuguuuugagggagcccugauaaagaaugaaaaugaauuucaaguguguauauguauguauauaugcauagguauauacgugccugcguauguauuuggcuauguauaguuaaauguuuagcagaagauaugucaauauuugagcaaacguacuguaaggaaggaaguuagcaucuguuuuaauuagaaauaaaacagacucaauagucugaaggcaauuuugugggguuccauuagcugccaagagaaacucuccauuggauucuguccauucuuaaaauguccgugcugauuugcagguuugcaguuugacccugugaugggauuugugggggaagaugcaggcagcugccagucugaccgagacaccucccagggcccagcagucuccgcauauaguaagauagcuaggcaagcagucagaggagugccacaagggauuguaugaaauuauggguuuuccuaguggcuuucucacuguucagacaccuuggagucaaagaugcugguggggauucaagaugaacugggucagcauuuucuuccauaugccaagggggugccugaacaugaggcuacucagaaugggagaauggugaaaaugaacaucccauucuucaccaccggcuuccaccggaaggggagguaaaauagaaccucacucacuaaaugaagucacucacauugugaaauaguuaacuuagagaccuguuucauaggugccaauugagucuucagaacuggaaguccucuuuuccuuggggcaaagccagcugccauagaugguggacugugucuuagauucauuauccgguuuaauuuucuuuauauagugaaauguuauuuuuucccuacauuuguuguuuucagcagaggucacugaugaggaccaaaaaggggugacuggaugaauucagacacccuugugugacugagcaaugcgugaggaacuguuuucuugcagaacuauggcuccuuggaggaaacacggagauggcacgccccguucccucgauguguagaauauugcagugaaaccucugucauuaagaacugaugaccaccuaguccaaagcagggaaaaggggcacucacagagguuaaauguaggcaucgaggcagaagaaaaccuaucuuagguucagcccccacucaugcauaucugcgguuuuagaaaacacucuuaacgaacaaaaaaaccuauggucaguugcuuuagccacauaauguaaaccacaaaggcucacacuggccuacuucggggagugagaacaaaggagggcaagcaugcaugcuuggggcuuggugcuuggugcucauguuuuaaaagaaccagggaauggcccucuuaaaugguccagacuuuuaauuuauguuucacuacccaguucuuugauuuucagcuuauguugauguuaaccuuugcucauccugcuacauucauagagaugaauuaccaaaauuuuaugauguuggugaaaaucaacuggaaaauaugccuccuugaaaugagacauuaugucaauguaaaaaaaguuuuauuugcagcaguuagcuaugccagcuaauaauggccaaaaggaguucaguacaguugguuccaacaacucaccaaaaucaccugugagauugguaaaaggaacuaauuucccugccucccuguuucccaucaucaugacagugacagagugugagacaggagggcugugcuuugaacacagcucaugaguaccuuuaguuacgauagcaggugucccacugacccuggaggcuuccuggugaugaagcaacaaucagcugguaguuuggggcccaucagaggcgggaguuggcaggacacagaagagguggucucccuuuuuuagacuuagugggaaucucacucacaugaaaacacaaagauacauacuagaauguacuuggggagugcuuugccuuccugauuauggugaaucuuuuuuuuuuuuuuuuuuuuuuuuuaacuaaacagcauguuuugacucaugauuuaucugaaacuaaaacuaggacauugauuuuuuccccccuaaaaaugacuuauaucaaaggagucuguuuucccugacacuucccagucuuauuugaggauacccuauugggacaaucagggcaggauaucugcuuggagguaauggucacuacaauggaagucauuuagaguugaagaugcagucugucuuucuggcaaggccaugggaaugcccaucaacucgaccaucagaauggaucccucuuguauuuucaucguaguaugaaaaugccacaauguuucuuugguuuggccaaauccuaaacuuugcauggucuucgguucacugcagagguagcugugccaggaagaaaaggagacuugagcauuucuuguaaugagcuucuauuccuaagcugauagccaaauguagagaaaauaaccugcacuugggguccauguacacaauccuaaccgaagucugcagaaagaguuagugcuuguaaucuucucggcccucauacaguuugcaguucauggccuagucugaaaagacugucuugguuugaaugagcuauucauugcaagugugcacagagcgaaauuuuagcauucauaacacaaaaugucauuuuuguuggggggcuggugaagagaaaauaaacaaaaggucuauauauuguauacuugaaacuguauauuuuauuccuuaaaaaucuaccucuuaucaauccugguguuacucugccagguuaguugguuguuuaauuuuucccuugaccagcagcuguugugaaccucugucuucucugugcaugauaauaaguagcuacuuuuuaaaaacaugaaaccauauccuucccucacaaaguuucaucuaaugucuucgaagguuuaucucuuugugcaugaaaaacuuggcagugucucugguaaucuggaggaggaggacucaguggucuuucuugggaagcagucugacaugauguaaugccugagacccaaggguggccuggacucaacccagcaacacagcuacugugcuuaccccagcugagcuuggagcaaaagacaccccauguuaaaggcaggacuggacuugguuugcauuggggucacgagacccaucuccaacuuaguagauucugucaguauuuuuaugcugaaggcuuccaacaagugcugccaacggcuugcucaauucauuccccccccagucuaaucccccaaaucagucgucaccaugcccuauucguuuuuguuuuuccuuccuguugcuucuccuacugauuucuucccuuuaguuccacacuguucccacccugaucuuggccuucauaacucuccugcccucagcucuccauucccccaugccccacccccgucccccauccugcagguccugcuagucuuggcuucaagugcacacgucgcuucucugugcauauaccuggauacaucccaguugguagcacuuccaaagagucucuuauuauaagaucaucuauacuuuuuccuaccugcucaucuuucuagauuucucuuggcuacucagaaaugcuccaucugcugacuuccauuaagccauuuccugcacugucuccugaacacaccauggucagucucuacuuugugucuucacuuccacugguucauuuuccaggaccgcgcccugguccuccuuccucauggauagucuguguuugguggucuagaucuagucuuaucuucuaugccuucuccaguccuuaccugucaccuucauuuacucacugaacagugcaugccuggggugaccuaggcaccauacuggaugcugggcacacaggaaaaaacaaggcauacucuuuggcagugucuaguccagcaggagagagacacguugaugccugacaccaguccacugugcacaagaccauguaagaggagggaaguacugagagugcucccuggggagucaggguaggcucuaccugggagaugugcaagagcaggccugaaggaugcucacuuugcuuugcuuugugucgguuuucucuccuuaacacaaauauaaguguucuguggaguaggucccucuaagucuuccuccuaugcucagucauccuucuuuacuuacugguuuaagaaucuuaacacuggccaggcacgguggcucaugccuguaaucccagcacuuugggaggcugagguggguggaucacaaggucaggagaucaagaccauccuggccaacauggugaaucccgucucuacuaaaaauacaaaaauuagcugggcguggugaugcgugccuguaaucccagcuacuugggaggcugaggcaggagaaucgcuugaaccagggagugggagguugcagugagccgagauugcaccacugcacuccagcaagagaaucuuaacacuauacaucacaguauccuuagagcugggaccuuagcugagauacagcaagaagacuuaggaugaguguacaauauuaauggcuuccaaggagucuuuuuacauuaucuggauccucacauuagguagaaccuggcuguauaaugaaacaugaguaggaauuagagaaguggaaaggagaagggauaguuuuguucguugagguaaaaccauauccagagaucuuuaucuucugaacuuuggcaugacuaccuugagugguuguuguacaaauguuuccggugcugaugggagagaaggagauggcacacacacucacaaaaaugaguagauggcacagaaaugguacagguucuauauuuaaccaugcaguauauuggggccccauacuguuguagaaaaugugacuugcuaggaauuaucagaagguuuguucuuauauuacucaacuuucuucuuggguacucccaagauaugguaguggcaaaauaaauugaguuuaauuaaaaaaucucaauagcuuggaauaacaacguuuuagagcauggcaccuuuccuaaacucaguugucuaaucugcucuagaggaugaaucacuggcuuucagagggaaaaaaacaauagagggucuggggcauacccaggguucuagugacuuccaaggguguauuaguccauucucacacugcuaugaagaaaugccugagacuggguuauuuauaaaggacagguguuuaacggacucuccguucugcauugcuggggaggccucaagaaacuuaaaaucauggcagaaggcaaaggagaagcaggcaccuucuucacaaggcugcaggacugaaugagcgcaagcaggggaaaugccagacacuagacaugguggugcgugccuguaaucccagcuacuugggaggcucuccuuaacacauccgauagacaaccaucagaucuccugcgauuucacucacaaucaugauaacagcaugggagaaaccgcccccccgcccccccccgauccaguuaccuccacccaguuccacccuugacacauggggauuauggagauuacaauuggaggugagauuuggguggggacagagagccaaaccguaucagaggggcauaaacauaugaaugaaauagcuuucauuuuccuguucuuuagacugagaacaaugaauauaaaauuauacuaaauaaggaagcgcaguacuuaggaaucucaugccacacugcuguuguccauugagaugaacguggagaggaaggagaagggcaauggggauguauaaagagagagagguuguuaggggaacggugagucgagagaaaugcacagacaaacagacacaugcacacacagauacaggaggggaaggggaugugugcuggaacauaaguccaggucagcugugggacaucugugggcuguuccuugaaucaggcacauagaguuuugauagccuucagccaugacucccagcguuuugguugcucuuaaagggccaguugcagcaaccccaucuccuguccagaagggaacgugacaauucaccccggggcaaaacaagagcccaggcucgggcaggcacccaaagcaggacaucauacaguuuccuguucuaugaagcacccaacacauaacacauuaaguguuaaacucaaugaagagucccauuuucagcaaauauuccugcguuugccucuaucuuuuuaucucuccagcaccuccuuggaacagaugcccugcuacuuuacaaggcuuguggaaaagagaaagagaacaguagcaaaagccuguguaguucaugaauagaaguuagcaucguagugaguaagcaguacugaugaucugugaaaugauucucuguggacuugagcaugcuaaaaagaucuugaaaaaggaaaacauaaaucuuuccaaaaccucacaugaccccuguaugcuuucgccuucuugaagcuuuggaggagagcauagguguggaugaaauggagucuuuuaaaaguuguuuugguuuuuguuuuuguguguggguuuuuaaagagagcauauccugccacguagaagaaaauccaggggguggcuguccuccuacaggaaggagguaaacaagcauuuuuccuuaagggcucuauucccucagccucgcucccucgaaggccacacuuggaggccaggaaguuaauccauuaaaaaacaaggagaagaaagagagaaagaaagaaagaaagagagaaagagagaaagaaagaaaagagagagaaaagcaagcaagcaagcaagcaaaagcaaaagcauauuggucucuaccccaguccagguaaaucagaacuucuggaggauggagacuggguuccacuguuuguuuuaaaugccuaauauaauuuuaauaaugcacauacgauaaagaaccacuggccuucuuccuuuaucuuuuucacccuuuguugucuucuauuuccugcuguaucuccaaagcuuagagaaguuuguggcauacaaaaaguacccagaaauauugacugaacgaagggcuuaaugaaugagugaaugucacgggggagcagggagguugagccccuuccauuuuuuucuagaaugaaccuggacaucagccagguguugggaugaucaccagcagaucccacacaggcccacagagugucugugcccuggccuggcugggcugugcugugcacaaacagaugggguggauucauguuccacagaggagagagcuaguggccaguuauugucauggaugaaaauccaggucuuucacaacauccauuaauuaugggauggcaaauuccaaguaaauugucacugagcagacccauaguaggaauagggcauauucacacuuuuuuuuauguauauauauuucugguuggagacgcaaaacauuuagaauucuguucccuucuagaaauuccauggcuuggggcagcucuuuucaaccauggaucugggguuugagaccagucauucguacauugacagucuuugcacagugaauaacucuggaauuucugcauuagagagggggugcucaaggucuucccaugcuaccaugguuugcuaacgugguuaauuucuggccguaguccuuacgaacuggggcuuugagaccaccugcuuggauuugaguucuggcccuuccccuccacuuaauagcccagaacucugggcaagugaucuaaccugggagagcaaagaucagaaaagguaacacuuguguauaacacucagcacaagcuagguaccguucugugcuuuguguaugucugaaccuuucauucuccaaacacccucugaaggagaaauuacuauuuguaauaaagauggggaaacagaggcacagguaguggagucacaugccaaaggucacacagauacuggcagagccaggagggcaaaggaggacagccuggccuggagccuguuaccgcaccaccacgcugcacuccacugugagcugggucagggcucagguggucggcuccuaggaagcgcucaguacacagcccuggugaugaaguggauguacacaaagacagcacaccuugggauguguugugcauguggaugacacuggaugcaggaccuacgagacacaagcuugagaaucaccaccagaagguuccaaccuugaguggcugauuaaaaacuguacgguugucuuagacuuauacuuuaaagcugcauuugcuaguggucacucucacugacucuucagauacaguuagaacugaugcuuccauguggaauuauuuuaaauaauuacuaggagugaguugggguccagucucugccacucacucaguaguugaccugcccagugcaguguggggccaacccugccagugagccugggcacucugucugaggcuccaguguccagccaccugcuaacuucugucauucagccucacccuggguguuuuugccacauggacaaaugugauagacacaauaaauaaaguagauauauauucagaauaaauauuauauagcaagacuaaaauauaaauagcaagugcaaaacaaauuaaaugaggauaugaaugacuucagugaagccacugagcuaacaacuaccuuuaaaacuaaaacaguaaguaauugagaaaugcaguuaucauugggcaagaagucaaaugaaaaauacgguuugaaagugaacagcauauuuucagcauuccuuuaaguucacacaguacguuugcacauggcacauuaucuaagcuaugggagucucaagugcacgguuaaguggacacugugcagugugauuuacgcaaggaaaaaaagacaaaaauaaucuuuaugcagcgcugucauugauuuuuaaaaugauaaauuggugggucuggcacagagaucaauggaguugaagucacgacgucaaauugagaugugagguuaaggcugagagacagacaucuccuucucucaugcuggcccgaugaacucuccaguuuuuuuggugagcucuggugaaaacucuuuuuaacccagaaugucagcauuuggguuauaagaacauuaauuuaucugacugcagugagauacauuuucucaauucuccuuauuugcuucuuuuacccuaauacuaggucaccaaauucaaagacauucuuucucuaaaaacucaacuucuacccaacugaauuuucaccaaaggaaucgcugagguugaguuuggugguaaagaacccaacccuuuggugcuuuuuucuuuucuaaacacugcauggccagacgucaguacuguucagcccuggaagccgucuuccucuuuacugccuucucacgguguuuccuuuaauuccugcuacacaaaaaguuacaaguggaaauggaagaaaacaauucuuucccaaucaggauucccugaguugguagcaaaaucacuggcuagguuuguguuaguagccucauuaaauauuuauuaagcaccuguuauagauacuacuaugcuuagucauuuaaggauuugcgcugugaaucgcuucauccaauuuccuccuauuucaaaguauuucuuguggacauucuaggacguaagagauaaugaaaaacuuauuuuuuaaauaauauuuccaguugaaaauucacacucaaauauuuaauagaaauccuaucuuccccccccccccccccccguuccugcuggcucccagauuucuguugccauuaaaaucccccaccgccuugcuggccuuggguagcaucuuuaaucccuucuuucuaucuugccacauuacaaagacuugucugccagaagguuuuacucauagcugcccccuaacuuacuucccagugcuacugagacuggcacauucucaucugugacaccuucucaacuggucuccaacuccucuccucugguuugccucuaguuauaccgccuuaaucuucugagaauauauguucuuguuucaaacaucaacagaggacccucuugcccugcugguuccuccucaaacugacuccagacuaugccuccacucucugauuccagcaccucaaccuuugcugaaugucacuucucacucuucccauacaagucuguagcccugagcacccuaccacuuggcuuaagcuccaggacuaaugucugcugggcucaggagugcaaucucaagcaucacccacgaagugagccggggcaucacucucugccuguaaucuccuauccugauucuaccugggagucuuuaggcuccugccacuuccuugccaccuccuccccuccuccuggacuugagcuucuuggaguccucucacuuggucuuguaacaccuuacacauugccuuggccacugcugcaacagcucaguacauauccacaaaucagaaguccucucugaacaaagccaucugcauauccaucuaccuucccuaugcuugccccauuuaaaaaucccagguuuuauaucuuugcugcauuuuuuaaggaugcuaaaaucacuuacuacaaaaauaagcagauuucacuguacaaaaugcagguaguaagagguaucuaaaauguaaccacuaaguacacauagaaaagauuuuuaaaaacaugaagaaggaccauugacaaauacaagauccuuccuagagaagaacaagggugggggaucucacaucaccaguggaaugaccuagaaacacaaagacugcucaauuucauuaagguuggcagugaauaggauauagccccaugcugcuuccucaacugaacagcuguaaaaaggcccucaugccaucagccugugcuuuuuccucuuucucucugggaugugccuguccauggaaccccugcuuugggauauagcugugaucaucucugcugagauggagugagagcaacuuuuauuugcaaggcugccuguaguauuuucagcauuccguagccuccuucccaugucucucauauguuguaguuuacugcauuucauuucauggccaaagcuagauuauuaagggcugaacuggaauuuuccauauuaaguagaauauaaacuucaacaagcauuuugauauggugggguuuucuuuuguuucuuuaccauucuauuggauagaauaguauaauucauaugaauguaugcugugcagagauguaagacucucuucuuuucuuuuuuugcucaaacuuccuaacagcaggauagugugguaaagagaacaugucuauggaugugcaauacuuugaauaaacaguucagugcucuauaaaauaaauauucacaaauaaugacuuuggggagaguuauuuccaaaucccuuugaaauauguuguuagccaaaagguuuauagaguaauuuagaaucauaauuccugcuugucccuaauaucugcuguucuacauucaaguuaauuuucucucagucccaauuagagcugggaauacauacucagcagaaagagacacauuugucagguuagaauguuuuguuuuuauucagguagugauuugucaucugauaacaucuuuauacaccucaaagucccucaacccauucauuaugguuugaauaaugucuaaagcacguacgacucaaaugcacacugaauauccugugacuuacaguagaggggucucugaaaggacuugaauuuggagccaggaaaugucucugaaguuaugguuuuucucaaugugagagguaagauccuugguugccuggagauaccuuaguuagugccuucaggaucugaaacagacacauuaucacacaugguccaaagguucaaaccuauccuuucauggcuuagugcuuaacacaagacauuguccaaacaacuuguuuacagcaauccugucagggucccuauaguuugguuccugcaagucuguauucuguccuuaauguauaagaacaauguacauuuuaaauaaacugauuaaaagucaugaaguuucacuacauauauaucauagguuagcuccaguauuggaauaaagacuucucucaauguuuguaugagaauuucaugguaaugaaagugucgucauguaguaucaaucauauuaaauuuugcuuuaaaauauugaagucaccccauaauguuaugaaauauuaaaaucaaauaugugagacaaaaaaggaucugcuucauaaaucaugccagcuaauuucugguuggggaauguaggucuccaaccaguggaaucaugguggggagggguuguggugcuucacauuuaugaaagacuguugaaaaugacgaugacacugguuuuaucuggggaguuuuuaugaccucacacucccagaaugacggugguuugccucaaguauguagaauuugccugccuucccaacugagcuucuuggaugcuauggacgcguugaacagcauccuucacaagcguuaaaauccguggugaaccugucacugcccuccuacguaaauaucugaccacagagcugcugcuuugggagguagcugugaucauuucuguaucaugagucucugagaagcauaagucaccugcuucucauauuccagaguucaguaguugucucuaaaugagauagccauggcugggcgcaaacaagagaauacaaaugucuacgugaacgggucuguccugccacuccacugcgauccguuguuauuucugagaaucauuuugauuuuuggacugcuuauuucaguguguaggagucuuccuuguagaugaaugccuuucacguacaagucuuucucuuauuuauugauuuauuuaaaaauuuuucccuacagagggagaaacaaaacacaaaaauucccuuuccugccacaggggaaaacaacuguggcaaaacagagaagcccccgaaguaaacagaguaauagaguacccagccucccauagagcuugcagaaaucucauugugcagacauggagcuucccagcuuuugccuuguuagccuauuucuuaaccaguaauucuguuucuuaauaggauaaagggccugacuuacaugaaagcucaaagucuuaaucacaaugauaaaauacaaagucguggcaacuguaauaaguuuaaagacauauguagcuuuucaaggacaucuugucuuuaaggaaaagucuuucauuuagcuaaagaaauuaaacugaauuguuuagucuuuuaaacaaaaugaugaauuuagugaagaaaacaaaacucuccauggcuaauguaauuuaugcaaaaucaugcaauuagugauagcugugcuagacuuuuucuuuuccuuaaccaaaugcgccucuaauaaaaccaucgugaggagcagugccaucuaauguaaguaguaaacauggauaguaaaugauuaauaucuggugaggcaugcagauggcaggacuuccauuuuuucuuugagcuccuugugcauguuugcuaaucauucuugcaaaaaaauugcaaagauaaauaugaacuuucaaaaguaacauucaacaggauaugaauguaagaaauaguacagugugggggaauaguaaaaaccagcacuuuccgccucugcauagugaaaugacgguaacuugcuguagcguaagcuuaauaaggguuauaucauuuucauguauguacuacucugggaauggcccgggucuugugagugguauuuuuucaucaaguacccagccagcgcagucacucugacaguccccccacugagauaaggcauggaaagguaacccucuagcaaguccucguugaggggggagcguucaagugcacagacgucuacccugugcuauccugagcuguagucuucugaaaugaucguuuggcuucccagccaaggcagggcucccccaaaguucauucccacucuugcaguuucaccucgggaugcuuccgcagaauuucagcgccuaagcagacaaggucaaaguaaaccgcuucaccgcugcuucuggcgcaggggcccagagcgcgugcagcuccccagcacagaccaacagcaggagagggguccgggcgggagcccugggcuguagauaagcaaaacgcacccauuuucucuccuauuuacuccagaggcaccucuccucccccacuccuggcaucucuuuaucacuggcucccucucccuguggcauauuuuuggguaguagaaugcugaggucacagggagcggcucuuuauccaagcaguggggacaucagccuggagcccugagcaugaaccagcaagaugcagacucucgcucuugacuuugggcuccaggagcugccccgaccccgggcugcccgcgggcucccuccucccuccugcccucgcccgccagcucgcagucucuuaggucugcagcguugguugguuucccacgccugucccggucugacucgggcugccaggcaccgggaagccccgcggcgccgaccccaacccgcagccccgggaaggugccaaccccagcgaguggaggagacgagcauuucacgugggcaucugccuucacugcugcucgcgccucuccucaacggccggcgucagggccccucuguuccaacucaucccccccccgaaguuaaucagccguacuuguacuuuccagggcgcuuuaguuuggaaaauacuuaaaagccucgaaaccuuccggggagacggccgcccccagaucucccaguuuugccuggcuagggcugucgggcgcucacgaagcuguggcgucugucuggaacccacaucgcagaggcgcagccccgcuccucccugacgucgccaaaguugccagacgccccucagcgacccggucgcgccagaugcaguugcauaaccuugccccccaccugcgaccgcaccggguccgcucccggcugcaccggggugucccggccccgggagccgccgaguuuccggccaagccgguuuggggccgagugugugcgcccgaaucggggucggcgcccgucccagcggugcucugcccgcggccaaguacgacgggcgcgggggcgcgggaggagggcacgcggggcuccgcuuaccuuccgcugcuuacagauaagucgaggucgaugcagcgccuggcucgggcaugucucgcugcggacccuggcaagccuggggcggcacggagcacuccggacagggcauccgcggccagacucgccgcgcucacgcggaggaagccucggcuccggggacuuggcccgcugcgcgccugcugcccgcccccuccaccgcugccggcccggcccugcuggcccggccggcccccgcgccgcagcucgcgucgcucgcgucccuccggccccgcuuagcgacgcgcgcggggaggcagcggcugggccagcuccggggacgcccgcgcgcucgcuugcucgcgacgcggcggagccagccacagccacccggcuucgcgcuccuccgauguccucauuuacugcaauugucuucggcgagaucucagagccagggccaggaggcgggggcggggcagaggagggagcaggagggaaguccuuuccgcugcuccaggucccagcuacuccgcggagccgggcggccagaggcgagggcgccccaagccgcgcgccugccgccugugcgcccggcuggcaccgaggcgggcggagccccgggccccgcggggcggagguggggcgggggcggcgcggggccgggccgggccgggccgcgugcguggggugggggauagggagggaguggaggagcccccucccgccgccgccagagcuggaggaggaggaggaagaggaggaggagguggaaggagcugccgccggcugccgccggcugccgccugcgcgcggggcuccgccacagcgcguccuccggguuucugggcugcaggcggcgcugcauggcccgggaacuuguugagucuacccuggagccgccuccggagcagcuggcgggcgggggacuccguguguucucucagggauggggggucgcuggggacccugcugcaugacugucugcugugccagccagccuggcccggcggggcuuugggaagccaggcuugaagggugcgugucuuguaggugccuggccgcucaccugcggaugcugccuuguagaagcaggaguucggggauccuuucagugcuggcuccaaccuggugucagccucucuacauggggacaggagguccuaugaguggccugaggacugaagugggagggccugccugguaauguugcaugcugacauuuagggacacuccagagcaggcgccacugccacuccuagccaggaacccuaccccccauccagagcacacaccacccgucagcagaagccacagggcgcagaggcugaguuccuuuguggcagaguagaauucucuugggagaggaaaagaccuaggaugcacacggagcuauccccgcccuuaauuucccacccaccaaagaguauuggguguuuugagcucagagcagcagacccaggggccccucugaugccugucaggcccuggggucugggccagggacuaagcagccagccgagugcagggcuccuggcccccuggauuugcuccuagaauguaauguaaaauguaaguagccacauuuauuagucuguuucucaggaaaggucagagaaguaguggaccccagggaagggacaggcuucggagaggaaauugggaggacaaauggaaagucccuucacccacccaccucuccagacacaucagugggcagugagaccucuuugccuauacaucccugagucucugcaccuagcaccagcucugugccugugaccaagccauagcuccauccuuguucgcugagcugaacugagccuaucacugccuuauagagugucuguuuuuuauaaaugacuuuauacgaaauaccuucuuuguauguggaugcuuugggcaguguguccagacauuucagaagaaaaaaaaaucuaaaaugucaucuauuucccucuuuaccccgcagcauccuuugguauacaauuuugccagccuuggggauccagauaugcccaggacgggaguccugagccuguggauccaaacucugcccaccucacucuucuuguuguucuucuuaacucagaucccccaagcugauuuuccagcuuaccagggaggcuguugggagcuggcuggaaagagaugcuuaauuuugugugagcaguauggaaacugcaguccccucuucugccuggaaggggccugggaagggaauguauaggaguuggggacguuuaaaaccagauaggagaaguugccacucuccagcauguucccuuggggaugugcuguugcagcugugggcuccaguaauuuucccaguggucuggggaacuucuguaaaucuuacuuuauuggcaauccauaaaauugaaaucugccuuccgucuuuuaaagugacuguaaauaaagcugccaggaaacuugggcauugggcugguaguaucagaaggcugaaguuuuccgggaccaagagugaaaacaggucaacauaaaugcaugcccagcaaggcagugcucagccacagguggcacugugaacuggcaagaaaacagcuccaaggacagugcuaucugagauucgcaugauguauaacuccaggaagaaaauggaaagccguaauuggcagguuagaaaauccacuuacaugaagaggagaguauaacggaauucuguagcaucaucaggacugcuuagaguuguucaauuguguaguagacuuacaguuguuuugcuaagucuauuaaaaucauuggcaucgcuucuuuuuuuuuuuuuugaaguaggaaaccauuuacauauuguagugcuuaagugcaugucuucagcaucacaaaucaaaauauuggugaaaacuugccucaccuuaccuuuggcucuggagagauauuccacaugggugaggugugugucaucaugcuccaggcuuuaaagcaagcaucaugcugggggcuggcuggagagaagggaguuucagccaucuuccugcccacagaucccucuugcauuuuuuuuuaauagaugggauguaggcauauuuuuagggucuagaaugagucaauaugcucggcuuccucaggaaaaaaaaaaagugaaacuugauagauucauuuuaggaaucaauugguauuggcuuuuuauauuuugcuuaagauuuuuguugaaaaagauagacuugcaaaggagaaaauagcuacuuuucaagugggauuuccuaaaagcagaggaauaaaaauaagggaaaguucaagacggcuaacuaagcaaaauauccacgucucucuucuuuugccuucuucuuggaauugugcagggguuguacagagaauugcuggaauuccaccccuaugguauagugaguuugaggucucaauuuccacauuaaaaagucaagaauauacaagucaaacauguucaagaauguucauaacagguuuaucuauaucuguuccaaacgggaaauaauccaaauaccagucaacaguagauaaagauuucuugguucuucguauaguggaauacuagacagcaacccaaaagcacuaacugcugaugcaugcuuuggcauggagggcuucuacaaaggugcagaacaaaggaagccagacgcccaguguuuaugacaugauucccuuuagaugaaguccaagaaugcgacaaaguuaucaaugguggaaaauaucagaauggggauuaccuuugaggcauacucguugcccgggaccacagcaacuucacuggugcuggaucauucugucuccugcacuaguugcuuaugcaguuuuccaccuauauagaaauucauggagaugcuuccugucucagugugaccucauuugucugagcaucaucacugugucauugcaauguccacaugcaugcuccccaauaacccuuaccccucagugaaccaguguaucugucagugugauuaaccuguauccucuccagugugcaaggcaggagaagagaaaagugucuccaaacuagcaacugcagaagaggagccuuccaguuuagcuacacagcagaacuuccuucuuuaggagacugccgaugaaacgccugcccucccaacuguccgaugucgcugugacagagcucgcuauggacgugaauuuuucuuucccaugucuuuguuacacaaaagcggucccgauccagaucccaagagaggguucccggaucucacacaagaaagaacacagggcgaguccacugugcaaagugaaaacaaguuuauuaagagaauaaaguagugaaagaacagcuacuccauagacagagugggacauucccaaaaguaagaggaggaaugcguccagccuagguacaauacucauauauauggggagcucugcucugcuacgaggguuugugauaaaggauuaaauuucuuaauuauuauauuuugcaagaaucgauauuaucuguuuucguuuuuguuuuuguuuuuguuuuggagacagaguuucguuuuguugcccaggcuagaguggcgugaugucaguuuacugcaaccuccaucucccauguucaagcaauucucgugccucagccuccugaguaaccuguaaccacgccuggcugauuuuuuguauuuuaguagaaaugagguuucaccauguugcccaggcuggucuccaacuccucagcucaggcaauccacccaucucagccucccaaagugcuaagauuacaggcgugagccacugcgcccgauauuauuaucuuuaaaguaaaauuaggaacgccuuuguucucaggaugucuggauauuaggacacucccaagucugggucuguuuaguaaacaucaccaguguguucccuuaaccuuaaacaucuagaggugaggaaugccuaacuuucuaagaaugcagcccaguaagucucagccucauuucucuaguccucacucaaaauggagucgcugugguucggaugccucugacaucugcauauuccaaagagacucauagaugagcccaaccuaagucugugaugggcagguuacacccgucaguucagaagcugugguagcagaucagccagugcucaacgccuacgagggaaaaguaacucauaucgccuucgaccuguagggucgagaucauucccuuggggacacuuuagccuugucuuucaagaacaagacagacacaauccucaaggugccccaguggggccuccuuuucugccgagaagcccugcaggaaggcuuucugcaucauuccccuugucauauucugcucgagccuucacucuccucuuucugggcuuauuucugguuuaagacucucgcuuuguguaaagccccuugcccguggcucuugcacgguccuggcagccgagccguguuuccuucuggugggaaccagagcuguuucugaggugcugguccauguuccagggccaugccacuccucuggcuuucuuuuccuuucaugguaagaaacuagagaugguuuauuggccugaaauacaaauuuguuuuggaaaaccugagcaucgugaggacucguugagaucccuggcuuucuaugaugcaucauugugaaucugauuuauccacagaaauggaagguuuuccuuuugaaagagagggaaguagcucuagguuuuuguuuuuuucuaaugcucccugcaacugaggcagugauguaugggaauaaggaagagcaggcgugcacucuggcucuccccucuccccucacaaucccucauuuucagggcucugagcaaaccccaaggcuuuccccucccaacugcagccucuccuuucuuuuaggcggacuccuggggaaugaaacagaaacccuuuauuuuguugaccuuuauuuggucagucuugggugcugguuucuauaggguuucuuacuaucccauucucgucacuggggagccaaccucuucagcacagguagauggcucaaugggcuugucuuaauccuugcugguaaggccaccagucucauugagccugcugaagccaccuucucauaaaguggcugacaugcccacagagagugacacuucugaucagaacuagggcaggaaggagccaggcacgguggcuuaugccuguaauccgagcauuuugggaggccaaggcgggcagauugcuugagcucaggaguucgagaccagccuggccacuauggugaaagcuugucucuacuaaaaauaggaaaauuagccaggcauaguggcucaugacuguaaucccagcuagucgguaagcugaggcaguagaaucacuugaaccugggaggugaagguugcagugagccaagaucgcgccauggcauuccagccugggugacagagcgagacucugucuccaaaaaaaaaaaaagaacuaggacaggaagggguaagaauggauuucacacuugaguuuccacccaccagcgcugugugcuggugcuggagcuacuggcugcccuucccaggccuucugccccggugcacaggaggcuuuucuuuagggagcugcugcagggaggccugcagucuucucccagcugggggguguaggaacuuccuuguuugcccuccauccccaccuuagguuccacaggcauggaagagggaugggguaaaggggaaggcaaggaacauggaagccuccuuguuguacuuuuuuccuuccccaagcccugacugaauaugagacuucgaugagaaugaugcuccgcuucgguugugcgccuccaggguggcagguacucgguccauuguggauuauauacuuugguucuuaccagauaacugggcacucaauacuguuaaacugucuccacagauguggaucagagaacguaaaugaucucuccaaggucacacagcuaggaagggguggagccuggauucaaauccaguucugucugaugcaaccagaggacagauucugaccaaaaaugccaacugcucaugccaggcucucaggaagcugaugcugcguccaggcuggcuggagaguagcuuugaccagcauucuuuugucgucauuagccgucccucauuaucucacuguauuaguuacacuuugaaauaaaaacaggcacugaaacagcaauauacucaaaucauuuugcauuucgauagcacucuaagcuuccccaauauaauuucagugauauucucacguuuucuucguugaauaacagcuauuaaaaugauucaucacaauauacguaucccaucuauaccacaagaggccacuucacacccuucuggugccauguauaauggcaucguauuaccauggccuuuugauuaucuugaacaccucuuuggugcugucauuugcugagauucagucauaguggacaggauauguguuuuuauuuuuuuuaaagaugacuaacacacugugcauauaauucuaauuaccuacccuugacauuuuaugcgcuuagugcaauaaauuauuuugcuaguuuggucuaagaauugacgaccugacuuuagauguauuuauuucgcagcguggcucaugggugaugugauaacaagcuaugaaacauuggaaagcaagcauuuuauucuuuaacaccaaguuccaaaugggaaaaguacagaauuaaaaauaaaaaaaucucuaguuauguuugaugaccucugaguuccuggaacugucaguuccauguuuuccguaaacguuuuuuuuuuuuuuuucauauuauugagucuuuggagaauuaaacagucuucgcuuuaauugcacugcacgguagggcugcggaucuccccguguccaauucaccuaauuuguguuuuggcacauucugcagcugugccauacucuaaaugugugugcaccccucacuucgggguucucauauauuaguccacuaacuaaaguuaaaguaaaaaaucaaaaacuuauuuuaagacauuucuuacacaauuuugauuuuuuuuuuuuuugagauucaaagaaaggcagggaauuuggcuuguaaauguugcuuaauguuuuuuucucuuuuuagaaacuccaguguccauaguuuaaagugaauauggcuagaauguuguacaaacgcuccuggcuucauccacaucccuguaucucggcagucacagcucccuggcaccuucucccccuugccuggacggaggcuucugagugaucuccuaggccuuccuagauugagaggggaaagggaagaucuuaagauuccagaauauucauuucauuuaagcgagggaggcaaauccuacagagcuuuuucccauuuguguucauuuauuggcuguuuccguggauucgagaaagaaacuugaaaaucuguuuuguuuuguuugguuugguuuugagauggagucucacucugucacccaggcuggagugcagugaugugauguuggcucacugcaaccucugccugccagguucaagcaauucuccugccucagccuccugaguagcugggauuacaggcaugcaccaccacacccagcuaaucuuuguauuuuuaguggacuuaggguuucaccauguuggccaggcuggucucgaacuccugaccucaagcaauccaccugccucagucucccaaagugcugggaucacuggcgugagccaccgugccugaccguuuuuuuaaaaaaaaauagagaugggcguuuggaaacugagucacucaaaaggugaaguagcuuugucccacagaucuguuacucaguacaaaguugaaaggaaaccuaaauucauuuuauuuguguuuccagugugcaucccagacauuuguuucagaauuuguuaaacauugaagaagaucaccuaggguugaguagguaagaaguaaauguggcuuugagaggccgugauagccgauacccucaauggcugcucuuggccuguuggacaagccauccuugcacaugacuugcuauccuaugacccgccuccagaucagucacccuccccauuugacuguggguggccuggcucuguuugaugaccaugagcaauaaaguuacccuuucauuaccaugccuugggcuaucugagcuggaugccccuaaguucuaauagaaaauaacauuuauugaugguuuuuuuuuucuucucugaacccaaauaugacaaugaggaaauuuauuuuaaagguacugauuuuuuccuuccccacagaguaaauauugucacauggaacugcugaugauacuucugagucccuuaaaauaagacuugugauucauucacaccaugaaaaugguagagaaccaacaucuucaccuucagauucauacguuauuggcucuuuccuuuuugguccguggguguuaaugaacauuuucacucuggagcuuucucugcuuccgacuccagcguggaugaaggagugcagcuucuggccugccugguucauccucugggucucucagcccugggauuuccacguuccaucucuguuguggugggcgaguugcaugaugcauucgauuugauauuuuacagaaccucuacugagaaaauaggguaagcagauuaaagcugaacucagacacguguuuggcaaccacccacucuugauggcguaaguggauggaggcagguggccacagcaaacaccauguggcuuuacgaagaaauguuccucuuccauacguuaggccuguguaaaguuccuuguuggacuuuugcuucuucgaugacaauacauauuuuguuaguauuuaaaggacauuuuuaaacauugcugaagugcaaucagcuuaaauugcgauucauaugacaaguguugaaacagggugauguuugccaugaaauuuaaauaagcuccguuaaagcagaaaugucuauauaccauguaagacacaauggucucccauagccuuccccuguucuuuacuucuugacaagcaugaauagucucucuguuugaauacagaguagagucaguuauuuuaaaagaguuaucaucuauggguauaaugcacuuuaagcaaacucuuuacaugcaaguaugacuuaucaacaaguaaaccuuaccaaauaaaugcucauuuugauuaaggcuaccuucagauaaccacuguuuaucaugcacuuagagggauucaguuuuccaaaauaauuuaaaaggugacuuuuuagaacaucaucuauuacauugucaucuaccauauauucuucuucucuuuuuuuuuuuuuuuuuuuuuuuuugugacagagucucacucuguugcccaggcuauagugcaguggugcaagcucagcucacugcaaccuccaccucccaaacucaagcaauucuggugccucagccucccgaguagcuggaauuacaggcacccgccaccaugcccagcuaauuuuuguauuuuuaguagagacaggguuuugccauguuggccaggcuggucucaaacucgugaccucaagugaucugcccaccucggccucccaaagugcugggauuaaaggcgugagccaccgcgcccggccuacuguauauucuuauauauacauguguauaagaauaugcauuuacuuaauacgcuaucaauguacagaauuguuuguuguggauuucugcacauguuccuuggguaagagagucuugaugugauuugcgcugugagagcagaacuuaggugcucuauguucuccaaagucccccuccaccuccuggauggcauuuauucaguagaauccgagcucaauaaauaaagaaccucguguacuucccaaagagccagacacuguguuagcugcuuuauacauacaucucuuaauuuucauuuuuugacaacauuaugaacuaugaaauauugauaggacaugaaaaaucaagagcuggucuuacggaauagugcaggauuccuucccugcuccauuuuucaaagcuuugcuccauuggaacuuaacaaugugcugucuuucaguacgucugaaggucuuuuucaauuuaaaucaguuuauuccuguuuuuaccauauccagcucccugcuacuccuaauauaaacagacuuaguggccuauuaaguauuuuacuucuaaugcuuuugaguuuuuucuuggcaguggagguguaaucucucccaaaaccugccugcacuucacagagaauaggaccgcaauugccagaagaaacugaaccuuuaugggggaaaaagaaaaauacagccuucccucauucuccagucuuaauugagcuaacucaauuuaugccaaccaguucuugcuggucauaguucuagagcuuuaugagaauuaaauccugaucucaccuuaauccuccuaaaaucuccgugaaacugggcacuguuaucagcaccauugugaaaugaggcagcaaguacagggcggucccuaaaugugacuaagucaggaaucuuauguagaaagcuuacaaggaaguuggggggugauuaggaauugucuccagaaauaccagauaaacaguucaaauuuuagugaagcaaaagauaggcauauuuuggccuuguuuaacuuguaccugaauguaccaauaacacuuuuggaagacuuggacguacucuuccucuuuucccaggaaaaugggagaguauucauuccuguacauauugagaacauggacaauucucacauuuuaggauugucuuaauaggcaacugacuuuauuaucuacguguugauugaaagaauagcucauagcagguguuaaaaguuuuuccuaaagagcuacauuauaaauauuuuggacuuugaaggccauaacaucguaacauuucaaaggucaugaaaacccagcucugcuggugaagcagggaagcagcuguagagaauauguagacaaaugggcaacuacugaguuccaacaaaacuuuauuuacaaaaccaggaggugggccagauuugguccacaggcuauaguuuuaugaccccuggcuuauagcauaaguuguuggacagaauuuugauaccauauguagacccaaauuuuaagaaugaauugaugcguuugauugaucacaggagaauucaguguuuuuccccuuugcuucuuacauacgcuagauuguaggcucacccggccuccucugcgauuugggcagaauuagagcaguauauccuaucaagaauuacuucuggcaggggauauggugaaggggccauucaucuguuaguauuugaguaagaaacaguuccauacaaacaauugggaauaguaaugucuuugucauugugaaacggaagaauuuugcugucuuaguuaugggaaugcuccaguuaugggaacuaaagugcaguaauugcuuuaaauggacggucauauauguuuggcuccuuaguccaauaauuuuauucaccacguuccccugagagaagacuugacaagacaauccuggacagucagcauuggauuuucaucuccagcugauugauuuaguauuucaugcaacccaauggaguaucuuugcuguaggguuuuaauacuggagcuauuaugaugacugauguaauuuaguuuccuguauugaugguuuccaaacaauugagaugaauaguuaaguuucuauaauuguucucuguaaccauaugaaaaaugauuauauauuagcuuaacaugaguuuuuucacuaaaauaaaaaucaauaaucaguugguuauccuuuugaauauuauauuuaaugccucagauuugaauauuaucaggaagccaagauuucaagaccccguuucauuuuuuuaaaaacaugacaaaaugugacauagugaacauugagaucacugagcuucauuguggauuagcaccccacuuucaaauuugucaacacgauaucaucuguuagaugauaucuaacguugagauguucucuaagauaauaacguugagauauucucuaaagaccuaggauaaaguucuaauuuaauuuccuauugcaguauuuuuguguugccugucauuaagacuguggagcuuccuuauuaauuaaauuuaguucacuguguauauugcuaccacuuaccaaguggucguuaauacagccucucuuaggugauggcuuuuuguuuaccuagcgaugaaaagcuuaaccuacacugcauuuuuuucauguguguuuaaccgaaggaaacaucuuugaauuuaucuucucacugcauaacuggaaacacugaaauuuauuugaugauccagaaucaguuccuugguuuuuaacuuuauuuccauccacaacaaguggcagcuuugagaagguuucaguucuuuacacugagauuccaguggaugagucugaauguuuaacucccagaaguuaggagaagauugagcuugcuuuuggaguuuaagaaugaaaaugcaagugcaugugccuauuuuagggccuaaguuggauuuucauaaaauaaagcaaaaucugaggucacccugugugggaaaaccucauccgagacuggagauugaaaauaggagcaagggccagaaguagccgccuggagagcagagcuaaggacuggguggugccuguguguccuuugggcaccuggugacuuucaggacaucauagacgcaagggugagggcccaucucauccuuacugucagaggcaacaguacagcccugggguguauuucacauuauaccacuagagcugggugcuuaaagggcaucaucaaauccauuuuucuuaccuugaguggaggugccuuucauuuguaaaugauggauuugaaaaacggacaaguagugaaaaugcaggaaaaugauucacaucaguaggugcuccagcagauguggaguaaaaaucaacaugucccacaaaugggcaauuaaagguuacacauagaauuuauggaaagaacuuuggagugucccagggauugcaaaggugguuauaaaugcaugugcucaccucuuccuguuagcacacacaccuaaauacgcagaaucucucagcagagacauuccguugagagccuacuuaauaaaccucauuuuaauuuuauucaccuuaguaaggcugcaggaguugguaagucccguggacuuggagacuuagguuaaggaauuccaaacuugacugcuaggcugcugguacaaaucaucuuucucucuuucuagucaccuggauacauuaugaugcgaugccagacuuccccaaaaccccaaucaagaaauaagaaaagauuuuucuccauuuccugguucccucacagugagaaugagauuuuuuaugaagucuuacauuuggugguuauuggcccauuaccuauggaaaccacuguaaagaccucacagugcugccaucagcaugcgcucuggacuucggcggugccacauaagguggccccagugcucaucccaggaagaauggccccugcuugucucggcaaaugacucccacggaagcuguggagagccacgaagguggcaggcggcauuagaggggcuguaaagggaccgaugccugagaauuucuucugcaggauguagaaccgugugcauuuggaugauaaugcagucagaggagggcuuccugugauuacgguggaauaacucucaggcugagcccgggaaaccaggaaaugcacgucuaccaggagccgaagcagagggguuucuuuuucccucuugcucugucucguugaaccuugguucuucuaucugucccugaguccugccucugagccacugccuguucccuggguggcuccagccauggacugcaugggugccaggcacauagcuggugacucugccccucuggugagugcagcauggccucugcucucucccccugccucuuuuuguuuuccuuuucugaggguuccucagccucaugaaguuuaaagccuaaugcagauccucucccuccgcugcauuguucuaggugucacugaauuucuccaaagagaaaaauaaaaacucagaauauucuugugacugauuucugaaugugacacguggcguaaugacuuaaacguauuacagccagcagcucuugguauaggacccaugauauuuuauuauauuuuguuuagcauuuuguuguacuuuauuauuuuauugucuuuguuuuauuuagaacacuuuauauccacccuuuucacagaguuuuaaauguacguuacgguacuguuaacucuggguacgauguugugcagcagaugucuagaacuuacucaucuuguggaagugaaacuguacaauugugucugugauccuucuuaaagccuuagcugggcugcugaguccugcacucuaacugcaggaagggcagcuaaggaaagccaagugcaacuugccagacagaugggauuuucaugucucaucuaucaggcaagacauugucucaguguacucagcagacuccuagacucggguucugggcugaugcugucagacaucauaaaaggagagacacuccucucagccaugcuccuaauaccccugauaagcaugcuccuaauucaucuacugcccuuagcaaagcugccguuugugucuccgauuuggugucuuuauagacaucgccauccccuguuagugaauuuggggucuugagacgucaucugaugaggaccugcuguuucacagaggaaauauaacugucugugugcuuuuuauuauugucauguuugcugcugacauuucacagcuuucauuuauugaauuuugaagacauugauuuuuucuucauagcagaaauuauggaucagauaauuggccaaauaagaaaaauucagacagcauuguuuuucuaaacauacugaaaauaacgcauguaccuggugaaaagugaagacgucaugacagaggguccagcccugcuguccaggccacccccaggaugggagcccugaauccucaugggaugugcgcugagauacaaggaggucccugcacacaccugccuuuccccgcugcuggacucuugcaaaucauuuccugugagugucagccagcccacugcauguuccgaaagcucugcagagugcgccaauauuccagaguuucaaaguagugcccuuugaaaagauuuaaaccugcaaauaaaauuaaauuugcauuugagaauacaauguguuuuccuucuugaaggacuugaugcuuuggugaauaagcauauauuacaaaauuauucaaucacccaucacaagugggugugucauuccagcucugugcauccuuucaaugacuccgaggaugauauccucacggaagcagaguuauuuaaccccaguucacugauuucucagaguuguuuacaaggcggcuuuccgugaugugucugcuuggguaaggcauuaaauuauuucaagaaucauuuuggucuuugcucucaaguaaaagugguuuuagaaggaaacuucuaccuggccaucgugugacaacacuggcugcauaucaagaaaagugagacuuuauuuuuugcacaugauuuuauacucauguaugcuugaaggaauaugcaagcgucgugagaucuaauccauacagaaguugagaauguguuuccauuagaagguaaagagccucuaguauucaaagccuuugauucagcgggcaggugcgaacgguggaggacugugcuucucgcuugcagacaccucgaauuauuuuucuuuagcucccucugugcuuucagggagccugcgugaguuaagccucuccuuguagugauuucccgaugcccagcaaggccgaagcucucauuuccuuuaggaguguuguuuuuuuuuucucaaugaaggaugaauuuucuaaauccauaauuacaccugaccaugauggcagcuucucuguuaagggcuuggaaaguaccuuguuaauuacuugacuuauuuugucaacauuuuuucauguucuccccaccccuugccaaaaaaaaaaaaaaaaggauggagaaucucauuuuugcuucagcgucucuucugugaugauuucuugcuuuucaauucacguuuggaaaaauguuuucauuuaaacaaccucccuauuuaaaaaauuuaacaguaauaccugcuuuuuguaaugagugaagauaauacaauaaggauguaugaagucaaagcuaauuaaucauucuucucccccauccccuuucuauccauccccuuuagauuacucaguaaugucgacagcuugcuguaugucuuuagacaccuuacuucuuguuuguguguacccaugaaagcuuuuauaugcauagauauuucuuuuacauguauuucaaaaagcucagaauauuguugggaagggaagagagagaaaaauguuuucuuugauuuuuaagacaguacuuggaaguuaagugugggcaucaguguaaguaagaaguaggaugcuagagacagaaagaacaagauggguaguuuuucuuuuuauucaaagcaaucagugauauguucuaaugcuuuggaaagguucuaugccuagaauguucccaagaaaggucugauuuauucuucauaaaguacuuuuguguacuucugagcuaggguggaauuuacaugguuuggaaucauuuuuggggguguuuuucaaaauguuugauuggaauagugauaaguucucuuuaaagagauugaucacgugagauuggguaacaccaagaugaacagaaugaaaaauguuucccuauagcagugcuuucagaaacgugaauacauuaauguacaccaagcauuuguagaagagggauuagggcucagcauuacaguguuuuccuaacuuuccuuacucacaggcuccuuauuuauuuauuuuuuguuaggcugccguggccagcguuccaggaaacacacuuugggaaaugacgcuccuuuggcuguguagcgcacaaggggcugugagcuuccccuguagacguuucugccuuauuccagcugaucaguaauauucaucagcaucauuucauucuuuuuuuuaagacggagucuugcucugucgcccaggcuggagugcaguggcgccaucucagcucacugcaagcuccgccucugggguucacgccauucuccugccucagccucucaaguagcugggacuacaggcacccgccaccaugccuggcuaauuuuuuuguauuuuuuuucuuuagcagagacaagguuucacuauguuagccaggauggucucaaucaccugaccuugugauccacucgccucggcgucccaaagugcugggguuacaggugugagccacugcacccgaccuuuuuuucacuuuuaaaucaaaacagaucauucauacaagagaagaaauacauauguagagaugacaaaucauucagugggccucucuguaaugcuucccgcuccagucccugaguagcuccccccgcccagcugugcacgucuucuucuuugugauguggucucuacacagauuugggauucauuuucccucgcuucucuuuuuaguuuuaccacauauuaauguauccuuaaacaauauguucuuaagccuugcuuccuuuugccguuuauagaagcagagucaaacaauauauauuuuuccaugacaugcuuuuagcuuucagcacugugguuuugcagucucuccagguugaugggugcagcugugguccauucguuuucuuagcugaauaauacuccuguuguaggaauagauggcagcaagcguaaccccucuucauggauggguaccugggugaugccaguguuugcuauuaggacagcguguuagauccugcauuuagcgaucuccaggcacaccugcgggagagcgccuccaggaaacacaccccgggguaggauugccaggccaacagguccuuaaggcagaugauuaccuuagggaaacagaggcccccaguguuucuuaggcuucagaaguguggucuacacagcaauaguaauaugaagacucagcuaccgugauuccuucucagccacuccuccucuuguccuaacccagaaucauauuuaugauauugucauuuuaaacauaugcguguaguuucuaugugauggaauaugguagugagaaucuaaguauccagccuggucacccgcuccuuuccgccucacgugcaggaugguugcccucauuuaaucaucguguacagucucccucgggcacccugagcccugcaucuguuucacccagggccucccuuugguucucguuuuguucuuugccucuuccaggacuccugccucccuuccugccucgcuaucagccuucuuuagaauacauccccagccacguuccacacccaauggacagcuuguguaaucauguucucccacaucccuaggaguccugggauccaugaguggcuguuuguaaaucucaggaagcuuucccugucuuccugcccugcccugucuuccuuccccugguccacuggccucggguuuccugcagcauccauggagcacuagggaagacccagccacgcagcuccaugugaucccucugugguccgccuggugcuacuacugaaaggagggucucuguuacuuggcgccaagcauggcagguccaguucccacggauagccggggcaucuaaccaagauaauuuagagcagaagcuguagcuacauucuguaccuguuuaucuugaguuccugcuagcagguaccaauaaugauggauugugaacaaacagcucugccuuguuuuuuuagacccugaaauagacagauuggcuuugauaaugcuuuuugacugaugggcacuuuuuguaacuaaaucccauucaaaggcuuaaaauaugccgcccaagguugauuucaagauauauuaaauugaccuaaagaaaaauaaguaggaaaaaaaguccuaccuacauaugggaugauguauggacauuuucaaaauagucacaacccaacuuuaccauagcaaaaacaagcaaacaacacccccccucaccccccagaaaacaacaaaagcaaaaacaucaaaauaaucccugcagugaaacaagauuuccccuuuauuacuaaguaccuucagccaaaaggaacugcaccacuucauuuaaaugugguucugaauauucguuuguguuugcauugcuggauuaucuaacugcugcuuuccaucugaaacguaagccuucagagauguugcuccccaguaaacuaucuuagcuuugccaggaccgggccuucacugaguguaauagaaucccugauccccaggagguagggaaggggcugacaaugacaugcaugaaugagaauguuuucuagagaggauguagucugccacguccuggagcugcuuuagggagagcaaaaaccuguuuguaucuuucauuauauaugcuuuuaaguacccaaguuaggaaguagcuaucugugagcuuuucuaccagucuucaugccaaagugauaauuuaguaaaaaaaaaaaaaaaagaaaaagaacaaacaagcccucgaaaccaaccugaaagcgcaggauacagauacuuaugggcagagagagacuauugccugucuuuggaagcauugccagcuauugcugggaagaccacuccugcuuagagggguggaauucuuucugagcuagcuuguccuggaagucuccgccccaagaguguucuugaugcgugugccuuacagccauugggcugggcaaccucaccuuuccauuggcuggaaaaugaagaggauaaaccccacucucauauguaggcaaaagguuccuuuugauaaagucgugauuucuccaucucaauaauaauaguaaugcacccaucccaaccgccccagagcuuugcuguucaggaaacauaggcauaucucaaaguacccuuuaccuuaauuuucaaaaucagugccuugucucaugacuuuucaagguuggugaaguucugaaguacuuaaaaaaaauugcugauuuaauaaacuugcuaguugaauaaaagagucagaccaaguagaaagucguuuuaccacagaugugacuuuuucuuuuuguggugaguacaugucgugggcagugcauggggccugucacaacuggcaucauuuccauuugguugaaauccgagccucugcauccugccuugagaucagggcagagcccuugcuuuuuaguuucauggaggcuacauuauaacagagaggaagagagggagagggaaggaaaggaggagaaagaaagagaaaagaagggaaggggcacaggcaggaaaagaauaggaacauuccaaagccaugucucaggacauuagagcuagaaccagugucugugcuaaugggacucuugcaaacacccucuuauuucacuuuaccugggguuaguuuuugguuuccugcuuuaacagaugaaaacagguuuuuuaauuggauucugcacauuaccccugugaaacugcagaacauaagcgguuuaaguaguuucacacugggcuuuauuucauuagugauaugcuguauggauuguaauucucauaaacugauaauaugcugauuuacuggaaaccaaauugacaagaagccuaucauguguauuggcagucuguucagcuugcuggacuuggccaggagaccuugagcuccuaagauuuuuucauccuucucuuaaaaaauagcaaaaacauaucuuuauuuucaguuauuaaauuuugaguucacuuaacaguuucuuaucuguuugcagaaccacauggaaguaaugauaaagucuuguuucagauauauaaggccaacauacuaaaaaucugagcauauucaaauaugcuucugcaucuugaagaauaagguugucuauaugcuaguaacauuuaucugaaaaacaugccacauagaaauaccuuuauggggacuuggccauaaauucuuugccaaagccaaugucaagaaggguauuaacuagguuuucuucuaggauuuuaauaguuugagguguuaacauuuaaaucuuuaauccaacucaaguuaauuuuuuucauaucacggaaguuaaagggccaguuuuauuuuuaugcauauguuaagccaguuaucccagaaccauuuauugaaaaggaguccuuuccccauugcuuuuuucuuuuuuuuuucucagccuuguugaggaucagaugguuguaggagugcagcuuuauuucugaguuuuccauucuauucugcuguucuaaauaucugauaaaauaaaaguugaaauuuuuaaaaaaguaucuuuaugaaaucuaaaaauuguggaaaguaauuaaucucauuaaucuaagagaauccuuguuaauguauuugaauacagauauuuauagaaauacaacuauaauuugaccuaauaugcaguaguauacaugagacuuaacaauugaaauuguuguuuuaucuaaacagaaucugcucauuuccuuuuuacaccagcaaugguagagccagagaacuuugguucacaauggaaucaucaagucauaaaacuuuugaacuucaagggauuuuuccauuuuuuuuugguuggagguggugauagggaaaucuucuucaaugacaauaaguuaaugacuugcauuacuucuuggccaaaguuaagacuagaacagaaguuuuccgacucccagucuguucaguauuuuccccaucauaccugugauuaucaaccuuuucucacucugccaaccaaaaauguucccuuggaaugacuucugacuguuugugcugaaaugaagcagugguuuuucaaagcucacacaugaccguauggacucugcacaguuggugccauauuaaaauacaaugucucuuaccuuuuuuucccuccacuuucuguuguuauuucccaaucaaaguaaaaccaguauuaaggucugucuuaguucacuuugugauguuauaacaaaauuaccugagacuggucauuuauaaagaacaaaaauuuguuucucgugguucugguggcugggaaguccaaaaucaaggcaccagcaaguuuggucgucuggugaggucugcucucuacuuccaagauggcgccuuguugcuucauccucuggaggggagaaagcuguguccccuccuggugggauggaaagggaagccaaccuagggcuaagugaaaccucuuuuuuaagggccuuaaucccaccucuuaaaggaugcacuucuuaauacuaucacacuggcacuggcaauuuuggagggggcacauucaaacuguagcaaggacuaacuucuagcauauuguuuauuuaauuccccaaauuaaguaguggggacugcagauuaguucugaaguuuuccuuucaggagaaaguagaauaaauggguaaagaagaaaccauaaauucaucuuggguggaagugcaguuucugaauauauucuacacaucccaacaauugugaaugugcuuugccaucuuaucaaagcaguauuauauuauagaaggaaaggcuuugguugagcauauggcuauuucugaguuacuuagcuuuauauuaacuuucucaucagcaguuggccuacuugcuuaggccaauuaguccuuggccauuuugucuaugugggcaugcuaggucaugucagggcugauuuuuucuucucaaaaauuuuuaauugugguaaaauauauaucacauagaauuuaucaccuuugccauuuuaaguguacaguucaauauugugaagaacauucacauuugugcaugacuaaauuccagaacucuuuuuauguuauaagacuaaaacucucuacccauuaaauaacaacaccccauuucucccuccucucagcaccuguagaaccaccauucuacuuccugucucuaugaguuugguuacucuagguuauugggccaauuuugacagccuuucuugagguggaauccucuucccaacauacuuauuuccauugccaaccaugacccugcccauggagcucuauccuacacucuaucccauccccgucuucagcccauccuguuuggugacacccaccauggccccagcccacaucuucagcaggugcagaaugucucuuaguguugacuuacacccuggcaguccugugcaccauucacaggauagucuuacuuacagauugagaaucuacaguuuugagaucauuaucuuuacauuucuguauccuccauccuucacagagucuucagcacagagcaugaguucaaaaucaaugcugggagcauuaggagaaaauuacagagaaaaaaauguucaaagauuucauguaguuaaacauucauuccuuccacuuuugcauccuagauugaccccucuugugucuuccuagauaaaugggaaguugucugucucaguugaugugauauuuaaauauaccagaguuuggaguuugcagagaaagaguguggagaagcuaaguagggaaacuugaugagucccuagacugaggauacaggagaaugaagaggaggcaggaguggggaggaaggaacagagaaccaggaggcccagggacguguguguugcagcagcuuugagugugaaugggcaagaaugaacugcacguggggcugccacauuuaacaaauaaaaauauaagauaugcagucaaauuuuaauuucagguaaaaaaaaaacuuaagucuauccaugcaauauuuaggauauacuuacacuagaaaaaauguugcuuaucugaaauuccaauuuuacugaguguccuggauuuugucuugcaacccuagcuguaaagggaagaaggagcuuugugggguagagccaagcauuggacaaaggcauggauggaggagcgaucgguguccccaguccaguucaguaauauggagggcggaggguggagauuacaagaauuacaagcaaagaugggggccguagaauuccaucuucuaccuuuaaagaauuugcccuuuuuuuuuucccuuuaauugauuuuucccucuguuuuuaaguuguucucuuuugaauacucugcuuauagauuuauuuccuaaacaagugcuguuaaauggccuccacuucacaggcuccauggaggagcagagcucuccucucucuaugccgaugcuuucagcauccucagaauagcagcuggaaggcaguagguuuuauggggauaacugugcacucaccaguuuagaugugugguugcuaagagucacgguauuuguuugcaaaccuguugguaccauugguccauguuuagcuuuguuuaauauacauaaacaaaaaaguguaacuggaagcuaugguauuuuauuuuucaauuagcuauggaaaguacaagaaaaucaaguugcuaagcaauuucuguugaauuggauguggguggaaccauuaucaaagguuggaagaaaucguaaaaauggaggagcauuuuauauucacguuguuuuuccuaugucuucaaguucuuuaaaggaacugaaacuggaaauugcagaaaaugcauuaugggugugauuuaugagguaaagaagaguacacagugcaugguguguuguuauggcaacccuaggaaacuaacaucaagaucuuaacucaagauauugauccucauguauguuaacgugagagacaugugugucuuguguggagggccucuccaggugagaggguggcugugcuuucacucauggucagcuccagucugcucagggagcucugggcauccaugugcccaugugucauccuugugacaucccuucagugucagcuacuuuuauccuuugaucaauugcuccagggcucauaauacaugauguaauugguuggaaacguggauguccaaaaagugcaucaacgcucaaggucauguguccuuuguuuugaggugucacucugggcagagcuguccggugcaacucaggggaagugguguccuggugagaaccaagucagaauguggcuugaaaugagcucuuguaugaagcuggcaaauuauggcuuaucuuuccuuuaguagguuuucuucauuuauuuccuuaauuuaauggaaugccuuagugcuauuucaauuaaaaaauauugaugguaaauguuugggaggacauucugcauccuuugaugcucaagauuuucuguucuccaaagcaguagagacauuagccucacucaaaggagaguaaaauuauguucaauguguaaacuugcuugcugcguaacaaaguaauauuauggcaggguguuugacagagacucuuuagcuuaaugaaauucuaucagggagaugcaguuuuaauagcgucguucauugcuuuuugucccuguagucuuuaaaggcucacauguggggaggacaguggcugcaucugagcugccagcagcagugcaggaguucagaugugaaauuucacucaugccagcauuuccagcauuuauuuuuaaucaggaucugcgcuuaccgauggccuguuaaaaaggaauuguguaauuagccuacuaaaucaccuuuucuuccucagucucuucacaucucugaaaaacagcccccauaucacuguggcuuacucucucucucucaauauguuguaggaacuacagaaguuucagcauacccacaaauacuggguugaauaccucuuuucaaacauuaguuuuugaaauuguagucagguuuuuaaaaaacgguugaaucagaguauaucaaauugucauguuaacgugguaacaucauaaacaaguuuccuugggagauaaauuuugugguuucuguacauagagaccaccuuucuuuuuggucgacauuucauuccuccuguguuuuuguuuuguguuguguuguguuguguuguguuguguuguguuguguuguguuguguuguggagacaggaucuugcucugccacccaggcuggagugcagugguaugaucguggcucacugcggccuugaccuccuaggcuaaagugauucucucacuuuagccucccaaguagcugggacuacaagcacuugccacuacgccuggcuaauuuuuuucuuucuuaaaaauuuuuuguggagauuaggucucacuguguugcccagacuggucucaaacaccugggcucaagcgcuccuucugccuuagcuuccccaaauucugagauuauaggugugagccgcugugccgagccaguuucuccuagguuuuaaaagauugacuuuauaguuuggaucugcaaauaaguuuuaaaaaauuguagaaccuguucccauguauccuucauucagucucugcccucauuauugacauuuuguguuaccaugucacaguggucacaacuaauaaaucaauacugaaaaucucuuugaauuuauaacaaugucugauuauuuaguuuuacuaaucucaaaauuuggaacaacauaaaucagcaacuuucaagguuuuuuucugaaagaaaguagcuuagaaauguauacaaaagcaaaucaacucaaaguguguguuuaucauuuagaaagguaaaaaucuauuuuuccuaucaaaauuaucucuuaaugcuuuuuaauuuauuuucuugaguuuaguaauucuaucuugcuaauguaccuucaauuucuacuuacuuaguagaauguuaauauuacagaucgagcaucccuaauuggaaaauucgaaaucggaaaugcuccaaaaccccaaaauuuuugugugcuaacaugaugcucaaaggaaaugcuuauuggagcauuuuggauuucagaugagagauauugaaccgguaaguauaaugcaaauauuccaaacucugaaauaaucugcaaucugaaacauuucuugucccaagcauuuugaauaagggauacuccacuuuuauucuuauucaccaagaaaccaccagagaagacaucaagcaucaagugaaagcuacagaugagcacuuuacuuuuuugggagugcuguuuguucguauaaagaagugaggcuuuuuaagaaguggccuuuuuaggccuuagcaccuuuuuaagcugaucacugucuccuugucuauagaggggacccaggaaaucuuaggugacagugaggcucaggguggagcuugguuacuugucucagcaucaagggacaggaucaggggaaaggaugcugagcugugcuugugggugagaaaugaguuaauuaagcccuuucugccaugauaacucugguguuuguuuucugcuauuuaggcuaucaaaguuaguuagugacucacagcaaaaagaagauacugauauuuucuuggguuuuguuuauaaucauguuuugagcuuauauagacaugcucuuucuuaaaauucauuuauuugcuuuucauccauggaaaaccaguuuuuuuucaaugaguuauaaaguauuuaauaagaagagauucugauuuaauuauauccagagauggcuuuggaucauguuauuuaagauggagaaugacuauuuagaaauauuaauguuuggccgggugcaguggcacacaccuguaauccuaguacuuugggaggcugaggcaggcaggucacuugaggucaggaguucaagaccagcuuggccaaacauguugaaacccugucucuaauaaaaauacaaaaaauagccaggcauggugguacacaccuguaaucccagcuacuugggaggcugagggaggaaaaucacuugaaccugggaggagguugcagugagccaagaucaugccacuguacuccagccuaggugacaaaacaagacucugcuucagaaaaaaaaaaaaaaauuggugugguagugcaugccuguagucccagcugcuugggagccugagguaggaggaucacuugaacccaguagguuaaggccguggugagcucugaucacaccccuauacuuuagccugggagagacagcaagacccugucucaaaaaaaagaaaagaaaagaaauauuaauguucauauguaucuauauauuaucuauaucuguauauuuuuauauuauaauuuaaauuauuucaguagaaauuugaaguaggaguuuuagggagaggcaaaaaggagugcaugcauuaaacauuccuuuagggucaagacgauggagccauugaguacauuuuaaugaaugugaauguuaucugggcugcuagaaaagaaugaaaaagccauacuuaauuguuuaaggaaaccauagaagaaucuacuguuggguaaguugcuacccaaauauacauacauucuuuuucaaaauauauccugaaguucauauuuuccaccauuaaaucuauucucuuccugccaggaaaccugaacuagagagguuuggaggucuuauguuguuacgugccaaaaauauagaaaguaauuuaugagaaggacaagaauugugauacauuacuaaggcgcauguaauuuucuaaguacuaaacugacagguguuuuauauauauauuuauguuuuauugguaaagacagaaaacaaauacaucuuagucaaacaguguuccccgacuuaccccaucaaugccaagggcacaggagggggucugcaguaacuuccugaagcaaagcacggaggagagcagguaacccaugacaugaccuggcuugcgagccuugauguuuuccguggguuucauucuuuccuuugagaucccaggcaaaugacacaacauagguuguaauggaaccccuccuuuuccuuguuuagacucuugaacaucucauauugcuccugacugccagcaaccaaaugaagggcuucauuaguuauagcuaauuaacuacacaccagacugaaggauuucuagccaaggaguuugggguugcuuuggaauaauagcgagaagcuagucuuuugaguuuuaacuguuggaucccuagcuuagaaaguuaccaguacccuuuuuaauuuuuuacucuguaaugggcaggaauagaaauuauguacaacaguggaaaaguagaagaccauaucaaaccugauguacccauaagaaguaguuggacgggcaugguggcucacgccuguaaccccuucacuuugggaggccgaggcaggugaaucacgagaucaggaguuggagaccagccugacuaacauggugaaaaccugucucuacuaaaaauacaaaaaguuagcagggcaugguggcgggugccuguaaucccagcuacuugggaggcugaggcaggagaaucgauugaacuugggaggcagagguugcagucagccaagaucaugccacugcacuccagccggggcgauagugcgagagacucugucucaaaaaaaaaaaaaaaaaagauguaguuaauagcauaugcuucuccuuaagugaucacccaaguuguuggaguuuccuaaucaucaguuuuuuucucugucauuuugagcuuccuggaauaggacugaauuugcaaguugaaugauuaugcauaaggcucaagaaaaacuugaaggcagauaaaauugauuuauacuccuuagcucuacccuacccuaucuacagguauuucuuggcggucagugaaggaucaaacaagaacaggguuggguaaugcugucagcaggcccacuacaucccaugccaggcgcucauggcguccugucucugcuccugccucacuuuccaccucucugcccagcccccauaaauaguaugugggaagcugggcacaguggcucacaccugucaucucagcacuuugggagccgagguggauggaucgcuugaggucaggaguucgagaccagccuggccaaaauggugaaaccccaucucuacuaaaaaauacaacaauuagcugggcaugguggugcgugccuguaaucccaaguacucaggaggcugaggcaggagaauugcuugaacccaggaggcagaggcugcagugagccaagaucgugcuacugcauuccagccucggugacaggggaagacugggucucagaaugaaaacaaacaaacaaacaaacaaaaaaaagaguggguggggcuccugaugccuucgccauugugauuacacaauacuucuaccuggacugccuuucucccgcucccauccccaccuucaccugggaggcaugcuauugcguuccccacagcacccaagucaccccgucauggcucugucaugcugcauacaccacugcuccuuuaaagggucauuucucacuagacacaggggcagagaccauguugcguauuuucuuccaugccccaagccccagcaccggacuuggccuauagcaagugacaaugcuuguuuuuauuaacgaaugaguacacgaucccaggaaucucguugaaguccaguucuccacguggccacccuugacucccacagcugaccugggauugacaccguggccagcccuguuccucaccugaugccugccuguagucuucggccuugcugcuccagaacuuuucaucguggccccuuuagggccauggcagcacaaauacacuuaguaggugaggccaugaggacaccuaccaccauuaaggaugccuguggggaguagggagauggaggauaggcugguaagacccugccagugcgggccugccucagugccuuggaacgagguauucccagugccucugagcugcaucccaguguguccugagcacccaucuggccuggcaagaagcaggcacgaaaggcauaugggccguagccucuagccuccugccaccugcauuccaagccacguuccaguagcacuuuaacugaaacaucuagcuacacaagaugggcugagcacucuacacagaugcugguccaugcagaaacaacccuaccccuucugcaccugaaaggguucccucugauuagaaaagguuugcuucaaguucgguuauaaaggaaggcuugugcauaguuaguggggaagccacagggaugugcaacuuuucccuacagcccugagguuccaggcacuaagaacuuggcacgucuuuccaugcuggcugaaaucaaaaugaaaccuucuuugacuuuugccccuucugcuggggcauugacauugggguuugacacuggcucagacagucaaaucuggaagccaaaccuuagaagccaaaucuuaggguggcauuaggacuaagcugagaauaaauucucagugaucccauucaucugccucccaguguacuaaaguaggacuuugaaccuuccagaaaccugauauguuggcaauuucucaagcuuugacucuuucuuccccauugccucuaaacccuagcuugaauuuuacuggcugccuuauaauugcuauuuguuaaaaaucaaaacgauuuuccauccugguaaaaugguaaaaauaucaguaguuugcagacaguaaauaucugucuuuaauacuucaaaaacaagccauauuugccuccugccuguuuuccuuaugagggaauuaugcuguggggugguagagugagaaggguuaaaucacuggggacccaccuucccucguuccucauggaauuuagaugaaugugcucuugcuaaauucuccagaacguguaugugcgucacccccacgcugcccggcccggagguggcuggaagucucacuuuguuuuucaucugcuggguggugaccagcagagagcacugagcggacuguucuuuccaaugcuauaaaaagccuguuugcaaaaugaggauuucugcuuccaggggcugaauuccacgucugcauuaugcuugcuggguggguaccaggcacagucuguggcuuggucguagccuuugccaugucuuuugaugaugugacaugccugagacacaugguggagcucugcagguggugagcagccacgaggcugugcuugcaugcuggagcagaaccuuguuacugcugauugaauagucucgcagaccccuuuucugucaaacgcaaagccauguguuuuuguuccauguggaaaaucacacacauucucuagcauauuacauugucauuaugucaacauuuuuaaauuuuauuguuuaaauugacgaauaaaaauuauguauauuuaugauguacgacaugauguuuugauguaugcuuacauuguggaacagcuaaauugagcuaacuaacaugcauucucucacauacuuauuuuucacguguggugagaacacuuaaaaacuaccgucuuuggccgggugcaguggcucacaccuguaaucccagcacucugggaggcuuaggcggguggaucaccugaggucaggaguucgugagcagccuggccaacauggugaaacccugucuuuacuaaaaaauacaaaaaauuagccgggcgugguggugcgcaccuguaaucccaggcugaggcaggagaaucgcuugaacccaccaggcagagguugcagugagccgagaucgcaucacugcacuccagccugggugacagagcaagacuccaucucaaaacaaaacaaaaccaaccaaccaaacaaaccucacaaaacuacugucugcaguuuucaagugugcaguauauugcuauuaacugaagucaccgugauguagacuucuugaacuuauucugccugucuaaaugaaauuuuguuuucuuugaccaucgucuccccgguccccccgcucuccaguccuugguaaccacaauucuacuuucugcuucuaugaguucgacuuguagaguccacuuagaagugagaucaugcuguguuugucuuucugugccuuacuuauuucccuuaaaauaaugcccuccagguccaucuauguuguuccaaaugaugguauuuccaccuuuuuuaaggcugaacaguacuccacuguguuuuuagaucacauuuuccguauccauccauugaugcacgcuuaggcuguuucccuauuuugacuauugugaauaacgcuacaguguacaugggagugcaaauaugucuucaacauauugauuucauuuccuuuggguauauucucagaagugggauugcagcaucauuugaugauuuuaguuuuaauuuuucgaggacccuccauugugcuuuccguaauggcuguuuacaaauuuacacucccauccacagcacacaggggcucccguuucuccacauccuaacacuuguucuuauuccuuuuguugauaguagccauucuaacagguguaaggugauaauuuauucugguuuugauuugcauuucccugauuauuagugauguugagcauuuuuucauacauauguuggccacuuuuuauuuugaaaaauaucuauccagugaucaccuuagccacacauguacuaaauaugucuguccauuuccuuugccccuuuuuaaaacaggucauuuauuuucuugcuauuaaguuaucugaguuuuuuauauauuugagauauuaauccccuuucagauauaugaauugcaaauauuuucucccauuuuguagggagucucuucacucuggugauuguuccuuuuacuguacaagagcuuucuaguuugauuuaacaucauuugucuauuuuuagccuuauuuuuuauugugcuuuuuaagguuauauccaaaaacucauugcucagaccaauuucaagagguuuuuuuucuuuauguuuucuucuagcaguuuuacaguuucaggccuuagguuuuuaauacauuuugaguuaauuauuguauaugguaugagaugagguuauaauuucauucuuuuacauguggagauccaguucuuccagcaucauuauugaagauuauccuuuccucauuguguguuuuuggcaucuuuguugaaaaucaauugacuguaaguguguggauuuauuuccaggcucucuauccuguuucauuggucgaugagucuguuuuuauggccagcacuauauuguuuugauuacuauagcuuuauauuagaucuuaaaaaaucugguagucugaugccuccaucuuuguuauuuuugcccaagauugcuuuagcuauucuggguuuuuuguuuuuuuuguuuuuuguuuuuuuguuuuuuuguuuguuuuuggugguuccaaacccaucuuagaauuguucuuuuaauuuuagugaaaaaugucauuggaauuuugaauaggacuugcguuggaucuguagauaacuuuggguaauauggauauuauagcaauguuaauucuucuaauccaugaacauaagguaucuuccauuuauuuuuaucaucuucaguuucaucaauguuuuauaguuuucaguguacagaucucucucuuucuugguuuaauuauuccuaagucuuuuauuuuuugaagcauauuuuaucacacguuugauuacuuuuauuaaugcaacuuucauuaaacaaccagaaauuuuuguuuuaagacucaucugguaauucuuuucuaucagagcaggguuaaaguuugcuuugaaaaugaucacauggagaucaaacucucuuuagcgaauggguagacugaauccaaggcuuuuuuuuuuuuuuaacauuuaaaugcccucuccacaagccccaccacaaaguuauuuugaaaauacgaauucaguacuauucgauacaagaaaauguugguguagucagugucuuacaauguauauuuuaaguguauuguaaaaaagaauauucagugcaugaauuucuuuuucuuauucuuuuuuuuuuauuuugaggugaggucucucucuguugcccagguuggagugcaguggcacaaucauggaucacugcagccuccacuuccuaggcucaagcaauucuucuuccucagccuccccagcagcugggacuucaggcacacaccaccaugccuggcuaaacacauuucuuuggaagagugccauuuagcuagaggcuuggggaucuuuaaaaauacuagaaaugacaucuauaacuuugucagaagcacauucacucauuaauugauagaaucauuguccccuuauuuagacucaaggcuuuuguuggaauaaauguuuucccuuccuucuuguuuguguuaggcuuucuucuuuucuuugccuuuuaauguucuuucaaacaaauagaagacugagugcauucgcucagacaucuucauuuguucaaauaaacuccauuuuuucagacagacuugaacaaauggagagacaguucgugugucaccuagguaaaggcugucugcuagggguccuucaacaagcaaaaccaaggucccugcacacauggaguucauauucuagugaggagagacauaaacaauuuaugcaauuugugucaaccugauuggugcauggagaaggcagaaaaggagggaaggaagugagccagguggucagcuggcagagaagcguuccguagaggguacagguagaguacaauccugaagggugcagaccuuuuaguucugcaucuugguggucauauguauuggaagagcuugagaaaaaugaaaauaccauuuagcuuaagaaguugugaguuaucugcaagucaacucauuucaggaguggaagaauccccggaaugauuuccuaauaucaaaauguaugcagguuucucuuuugaaugucuuguauauuuagagagggugcuguacaaagucucuuguuuuccauacagcaaauuccaggaucccuugcuggauacuguggcuggagcaaugugagcaacagaggcagaguccgggaggugauguggggcuggggcacucaucauggccuuauaggucugcgccuugguccacauucguacugcaguuauuguuuuuauuugugauaaugauuuuauacuaaauaauggugauauuccuaccauauuuaccacguaguagugucugagguuucugauucuuucgaacaaaugccuccuguugacccuguuuccauuuaaccaaucaaccuagauuucugcuuuuugccccuucaugacaccaacacaguggguugaaauucaaaacaaguggacuucauuucaugaucucaugugcuucuuauuuaaacaggaaauaggagcauugcauuugacaacuuuuaacuguguagccagauaauuagcuugugaaaaacauacucaguuuuacaaacaaguugugauucuggaaaguaaaauuagucauuauaguacuacuuugcggauuuaccucccacugcaugcuguuaagaucucaucuaagcaagauuaauaaaaaauaaaaaaucuugacuaaacaucuguugcaaagugacuuucaauuuggcucuucaccaugugacuggugauuagaguuuuugguuuagguuaaggggauuugauuugauuuggcauggucccuuuuuaauuuuauguaugaggcaaauaacugaaaugucccugauugucauaagugaaaaaauaucauuaaaauauuugaauuuuguucaaggagauuaaucucuauaaaccaauguuuuguauucccuaauuagaauuaugguagucaccaguaugaucaaugcuaaguguuuauuugguaauuaggaagugcaagcucuaaauuuugauaagauugaugaaauggccucuucucauauuuucauuauguccguauaaacauaacuuagaaguuggaaauaugaauuuugucuacauaacaguggacaugcuacaacaaacaaauauauagcuacaaacaaagcuauauauuuacauugauauccccuugauuauuuuucucaaugagcagacauucaagagauuuuuuucccccacaaaaugugaugugaaacaucuacaauguauacuugccaagugcauaacuauuaacuuacuccagguaccagauggucuuauuaagauacuaauuaaugucaacucugacaagugaagcuaauguuuaaauucagcugccaguaaguucucugucagagcacucccaauagaaugugaguuauaugcgggcuucuagaacaauguccaaaacacagugugccuucgcaaagguuucagcgaacggauaaauacuguggcuacauucccuuucuaggaaauaagaauuauaaaaaauguugaucuucuaaguuuaauuuuauuauaguuugaccuuacauauaaguuguguuuugaagguaccauucuucccuucuuaguaaaaauguaacagcauccauacgaugugauuucggcugcuccauuuuauuguugaucuacuuguucuucaauaauagaacucuuguuuuauaauaauuuccauaccauguuuguuaaccaauaauauccauaaccauaacuugaggcacuuuguuauagcugauccugagguuaggaauacuuccuugacaugauacauacaguauauuaaaccaacauucaaaauaauaguuaaaaauuagacacuaaaagcgugcccauuaaaaucacuuaagaaaacaggcgcuugcugucauuauuauaauuugacauuaccgugauagugcggccugaggaguaagucuagaagcagaauuaagaccuacagugauuagaaaagacaacacaaaaauauugacagauguuggcuugauguauuuagaaacccucuccaaagugggggaaaaauaguuuggaaguaauaggagaauucuguagguucaauugcaaaauguacacaucaaauucaauaguuuacccuaauauacaaauaaaaauacacaaaauguucaaaggguuauuuaaaaaagcacucccuccaaaagacacaaaaauaaaaggagcuguuaaagauccguaugaugaaaaccacaaaacauuccugaaauggcauaaaaauagacuugaacaaauggagagacaguuugcaugucuaagugggaaggcugauauuguaagccucuucaauuaauuuaaaaauucaauggaauuccaauuugaaucccaauaggaccuuguuucagacucaauaauguguuucuaaaguacaugcaaaagaauaaauuggcaggaauacucaagaaaaaugugaaaaacaaggguaaugugaaguaggccuugcaauacugaauagcaaaaccauuugaaagcuacaauaaaguauuaauuaaauugaaaguacucuguuucuauauaaguguaagagcaagaaggaauccuuucaaauacaacauuaauuacauauggcuuauaggacauggugauuuucagauuuucuucuuuauuuuaaaauauauaaaauauauacuuuauauuuuauacauauaaaguauauggauuuuauacauaaaaaguaaauaauauauguacauuuuauacauauauaauaaauacauauaaguauauauacuguauaaagcauauauacuuauacauaaaucuauauaaaguauacuuuauauacuuuguauguauagaauacuuuauauauguauacuuuaaacauuauauacuuuguauacuuuauaaaguauaaaauacguauauuuuauacauuauaaaugauauacuuuauauuuuauauaguaacauccauucuucuuccuucuaaauuuugacagacaauacaguuguguagccacuaccaaauacaagauuuagaauauuuccauuuccguaaaaauauuucucaugccccuccauagucaguucucucuucuuugucacucuaguacugccuuuucuagaacgacauuaaaaauggauucauacagugucuagccuucuguaucuggcuuauuuugcuuagcaugauguguuggagauucacucauguuuauuuaccaguaguuuguuccucauucuugcugaguacuauucaucaugcagauaugccauaauuuauuuguuuauuuaguagguaguagguguuuggaguguccccuauguguggcaauuaugaagaaagcucuauaaauacuuguauagaagucucugugugggcauaucuuuucauuucucuugggugaauucuuagaagcagcgugguugggucaugaggugaguauauuaucagcuguauaugaagcugccaaacuauuuccuaaaauggcuuuaccauuuugccuucagaccagcaacaugaguuuccauuguucugcaucuuuguggugguuguuuuuuuuuuuaauuuuagccauucuaauagguauauaguuauauuucagugugguuuuaacuugcguguuccuauugacuaguaagauagaccaugcuuucaugugcaucuuggccauuuguguuccuuuuuugauuaaauaucugcucacauuuuuugccaauuuuugguggguuauuuucuucuuauugguuuuugagaguuugucauauacugcggauggaaacccuuugucagauagguguuuuuaaaaauauuuucuccaguucugcagucugucuuuuuacuuucuguauagugucauucaaagaccaaaaauuuuuaauuuugauuuaaguucaauuuaucaauuuuaaaauuuuauguuucaugcuuuuuguauccuaagaaauauauuccuaugccuaggucacaaaaguuuucuauguuuucuuuaaaaaguuuuguuguuuuaaguuuugcauuuaaaucuaugauacauuuugagucaauuuuuguauacgguuuaagguauggcuccuuucuuucucccucccucccccucuccccuccccuccuucccucucuccuucccucccuccuuugcucccucccuacuucccucccucccauccuccuuccuucccuuccuuccuugguauuuggguauccaacuguuucggcaccauuuguugaaaguacaguuugcacauugauccuucuugacacggguuuuuuuuuuuuuuuuuuuuuuuuugaaaucaguuaacccuaugugugcagccaguuuguuuuauuugucugucuguccuuuccaguaccacacugucuugauaucuguaguuuuauaauaagucuuaaccauauugagucuuccauuccaugaauaugguauauuccuccaauuuuuaggucuuauuugacucccgugucaauguuuuguguguuucaguauacaauuuugugacuuuaaaauauucuucuguauaugguuuuguguuuuauucuucaucaccaucaucaucaccaccauucauuuauguagccagccacugugcaaauauccuuaaauacauaucuaauuaaacuuuucaagaauuccagauuuuagaaucaugauccgaguuuuacagaugaggaaaacgaggcucagaaagguuaaauagccuguuaaaauuuauacagcaaacguacccuuggucaagugauuauuccaaauugucugccuuugaaaccuuuacucuugacuccuaaacuaauuuuguaucauuuaucuauauaacuuuugccuuaagaccaaaaaauauuggccgggcgcggugacucucgccuguaaucccagcacuuugggaggccgaggcgggcagaucaccugaggucuggaguuugagaccagccuggccaacauggggaaacccugucucuacuaaaaauaugaaaaauuagccggguauggugacgggugccuguaaucccagcuacuugggaggcugaggcaggagaagcacuugaacucgggaggcagagguugcagugggccgagaccacaccauugcacuccacccuggguaacaagagcaaaacuccaucucaggaaaaaaaaaaaaaaagacaaagaguauuauaaacuaaugaaaagagcgagggugauguugggauccauauuuggcagggaagcaagauauuuguacucuuucuuacaacuuccacuguauuuuguuaagaccugaauacaccucuacaguggacaguccaaauaaauaagccauucccguacuuaagaagcaugcauaugguggagcuuuaugugcaaaagcaacaaagcccucuaguuauauuuuagcuccucagauacuuuucugagugauuauuccugcugcuuaaaucucuguacuacucccuuuugcccaaguuaaaauaccuaaaucauugguuguaguucuauuauuguauucaguaauaguuccuuugauuggaaaagaaauaccuccuuuuuagaauucccuggcagucuguaauaacucccuuuuauaauauuuguaacauugugucuuaauuaauuguugucauauaagucuucucacuagauugugaguagaagcuguuuuccuuuggcuuuuugagauguuucauauguacaaaaauguugaaucaguauuaguguuaaacacacguacccaccuaaauucacuacauauuaacauuuugccaugucugcauuaucccugcauguguaaacuuucuuuucugacauaccaaaaaguuggucacagacacagggacacaucauuccucgcuucaugcaacuccuaugaauaacugcucuguaggcacaggaauauuaugaugccuaugaaaaugaacaaugauucccgaauagaauguaagaucucuucccugugagguuuucccuuugaccuuaaggguccccaccauuugucuugucaaaugcuguauacucugaaucugucuauucauuuccucaugauggaacauuuuuggcaaaaaaaguaacuacuuaagugauccugugugcuuagcauucuaccuaaaggcccauacuauaauuaggaagaaucuauaggguguuguuuucagauugagugagugucuucguccccaaagaccuuuuaccucgagguuucagugcccauugaggagccuccucuggaccaaccauuccuuuaggaguugaaaccuucaguuaucaaguucucuucuucauuccguguuuuuuuggcucauagucuuccguaggucacagcuuuacuuuugcccucaacccugccacgucgccuauaugucuguguagacacauggauuuuuuucucauucaauuugcuacauuuguuuguugucaucguucauuuugauauucagauugucucaagcaucccacacguggccaggggagccuccccacaccaccuccuguguccuuuugacauggccccacuagccuagaagaaagacgugacccagccucccacugaggucauucuggucaggggcuguuuuuaucuccugcugaccuacucuugggaacucaaugaugucaacacacugcacacucauugaauguugguugaguguugcacuuggcagugcucuucaugguuuugaaucuucuugucauuuuagccuuauccccuccauuucucaugacccauucuagaaggacccauuuagggaagcuucaauuuccccugggguguggggaaagugagacaagggguggaaguagaaccucaguggguugugcuuccuguguugaugcuuuccugcacacccugcuggacagguacagggcuacugcagaauuccucguggguucccacaaauugagucucaguccaccacaguaggcgauuuugaaaauaagcauuaggcauuuaugacuaaaaucacuuugguagcuuauguaguuguaaguagauaagcuauuggaugaucacuugucaugugcaguguuugagcauacaaccgcauacaacauauguauguauuaugaguacauacauauuuauaagaaauaccauaaaagauuaucuauguuuuuauuuacuauaaucucauauuucaaaguaucuuuuauucuccuuacgauucauuuauuuaauguuuuaauacuuuauaauacuuaaguaucaucauaaacauuuaauacuuaauauuuaaugaugugugugacauuucuccuuaauacaucauccaaccaauguuaacaauguugaggacaguauccuuuuaugauuuauguaaggcauuccauuuuagcuaagaaagaguuucaacuuucauuuauaacaaugauaauuguaguguccuuuaucuaugaaagucaguuuaaaaacacguauagacauauugaucuucucuucaauaauaagaguuuuuuuaagaccgaguuacgcucguuucuauuauaguguguuuucagauccucuauaucaugcgauaagacuucgaaaauucuaaacucucuaaggcucuauuauuacgugauauauugaguauauaaaaauaacguauaaaauuuucugcuuugcugucuugcuuuaggaucaaaugaauuauauuaagaagcugcaaacaaaguauauaguccucauuacaccauaaacuauaauuuuguauguaauauuugauuauaauuuauuuuuauacuucauaacaaaugugaauauguguuuaaauuauuauacuuuauaaguagcaaauaacuguuauggguaauuuaagauccagauauucccuuuugguauauuuguccaauaaacaucuucugcaauuacugccacuauaaaaaugaaaucgauuuuguuuuuaaauuauauuucuuuccuuauagugccuggaaugguaugagauacuaguacucuauaaauucaacuaagcacucaguuuaaauuuaagauacagguuuaauuuuguuguuaguaguuccaaauagcuaaaagaugacauuaguguaaguuauuuucuguuuuauauaguuuuggcuuuuuuuuuuuuuaacaaacauuccucacucuaaaguucuuuauaaaauaaagaaauuguaauauuugggagauuaaaugaguaaaaauuaauuauauauugaauaaaggcaucaugggaaugaauucaucuuuaaaugaaaaaaggaacaauuucaccauggguuguuuauaugggaaagguuuuaugaguucacugaugagaauggacacccauuuuccggugagcuucaguuuuaacaauaauaccugaaucagccuuuuuauuaugucuuaugcuuaaucaaauauuuaauuaauaaaacgugacauacuuuuugagggcacagcgaugacuccugacauucaauguaugcggcacugcacacuauccucuguccucauuuuacaacaucguucuuucuauauuuuuaauuauucuuucuuucuuauacuccccgcccccuuaaucuuaaaaggauuuugagguagcuuuaaagaaauucuauauaauaugaaaacacaugugugagaaaaucaaagcaacaaggagaagcuaucucauuucuauuucaacaaauauaagugaaagaacaauguuacaaggauuauagaauuuugcaagauuuuuccaaguauguuauuauuuuaaaucugagaaauaugauaguuauaagggcaaaucguuugacuuguccugaaaaucacuaagcugggggaggaauauaaggaagauaugaugaucaugaauauaaucucauaucuaccugaggauaguaauuauaguucuuuggcugggcgcgguggcucacgccuguaaucccaaugcucuggaggccaaggcggguggaucaccugagaucaggaguucgagaucagccuggccaaccuggcaaaacccugucucuacuaaaaauacaaaaaauuagccaggcguggcauaccucuagucccagcuacuccggaggcugaggcaggagaaucacuugaacccaggaagcggagguugcagugagcugagaucgcaccacugcacuccagccugggagacagagcaacccuccaucucaaaaauaauaacaauaauaauuauuauuauuguaguuuuuuuacuucucuuacauuuucuaaauguucuuccuuuccucuggguucuguuuuuguuuguuugggccuccuuuauuaaugcuggaugaauuuuuuucacaaggcccaguacucuugcucagacccucugucuccaaguuugugcacagagcauggaggcgcaugggcuuuccugcauggcaagccuggaugggcugagcugucauacuuuuggaaccuccaugcuuaguauuagugcuuauguucucuuuggcuggucauuuucaccaaagaggauucuucuggucuucuuucuagguuugguuugggacuaagguuaggagggguuaguuuaagccuccuugcugauaugcugggagcugagcagaaaagagagaggggaguauacuguuugguuugacaucaaacuaaacagguguuucuuccaggugguucuugucauuuucuucugcuuuucagguaccucccuuguccagagaguaaacaugugguccucuccccaggagugaguuggagagccccucacuggacaugcugggcauaggcagacuggauauagggucacauuucaaagccaucagcacuguuguuuuucaucucacauguagccuccugaguaccuggcacccuccaguuucugggccuuccuuggguuuugcaccagggauucacagacuuccuguuaaaugucaccacguucuugccuugagggcaguugguacccacucaucacccucuuuccugcuuccagaauucucuugucuuuaguugcaucuccucagaguccccugguccuugugggcuugugcaguuuuaauaugugccuuacugucauuuaaugugaggaacugggaaugcauguuuuaaauaguuucuaauuugugauguaggcaaccccuaaguauauuuugaaaaacuucagcucugugcagacuuugcaggaguuuggggcuaauuuauaacauuuugagguuuuguuuguuuuuuggacucccuguuuuucucuuucauauuuucucacagaaaauaccaccuaugaacauuuugccauuggcuuucccucuacaaaagagaaagccauugugcucuguuggccuucuaucuuaucagcucuaagaacucacucauacuuggauuuauuucaaaucauuuuaaagaaggacuugacucucaguuacauucccuuuuccuauauucucuucuucauaauauugcuuuacaguauugauucuuuggcuugaaugcgccccaaaagaaaaaucauccagaagucaucaccauuauguuuuuuuuguuguuguuguuuaguaauauauuuuaaaauguuacuggauaauucauuuucauugcuuuuuaugaugauuauaagauggguuuauuuucauuaauauauuugaaauuuaagcauuugagugagauuuccucuucaaaguccuugccuuagugaaaacacgguuaaacuuuguaacaagaccucaguugaaaucaugaagcauaaucccggauucagucuucaggguucuccuuuuauugaaaccgggcaccuaccguccacacucgucacuccugugucucuguuuacagcuccaacagcuucugaggcugggaacugcccagagauccuuuggaauuuagagaacuuagaagaacguuaaaauuucugccuguguugugugucccagagagcaaaucugugcuuuguacaaagugugagcuccagggucgauugagacagcucuugucuggcugaugaaauuaccaggagcaauuuuauacccugcuauccaagucacauggcuaaguccauuuuuauuacaccuucacagcuccucaagaauaugaauuaaaacccuuuggauuuuuuucuucuaauucauacuuagaccuuccacuaggcauaguugacaaaggcacuguuuaaaagauaugucucauccugaguuuccauucaccagucugugcuuuuguuagccuuuuguuuuuauauccugcaaugacauccugcauucaacuugccugucacugaaugucccccugcuccaccaccagcaccccauucuaccugugcuguuuuccuucuacugagacucacuuccaccugugcccaguuccaccugccuuuccuucuacccagccucaguucuacuugugcucaauuccaccugcccuuccuucuaccugugcucaguucuaccuguucuccauuuuuccuaucaaccuaccuagugaaaugggggcccaaacacauuuaaaacuggggcacugagguacuuccaggagggcugggggugugcggggacgacuucuguccagggcucccuccaggagcagugccaggcaguagccaaggccacaccaacagggggagcccugcgagagagauuuuuuaagacaggagcuuaagaaauggaacuagaucaggggcaggcagggagaguuugucccuccugccagauggauccuuuucuuucuggaccaccuuuaaaaauauuaacauacuuucucuuuauaaaaacaaucugggcuuagucucccuccacucaugacuaucugguaucuuuucuagucauuuuuuguuuuucuuguacuauauauucuuuauauuggucaaauguguauacauaauuacugcaguuuuccucuucaauuauuuucucaugcuauuaaaauauuccauauuugcauaauguuucuugauuuaaugguugcacaauauuucaucauaacacaaguuaugauugcuugacuugccaaauaaaaauauaggacccccaguucagcuugaacuucagguaaacaacaguuuuuuuuuucuaguauauguaucucucauguaauauuucauugcaacguuugggacauauuuauuuuucuuuguuuaucugagauucaaauggaacugggcauccuguacuuuaucuugcaacccuacaaaauaucauauuauuuacacaguuucuugugguggauguuuagaauuuucagcaaugcuauggacaucuuuggguaugaaauuuucuauuuugaauuacuuccuuugguagauuaucagaaguagaauuacuuaggagaugaguauuuauuuucaagacuuuucaaaccuaucuccaaaucacuuuuuaaaaagguuauagcaauuuauguucccaccaacagcacacaagaguccucguucccugcacccuugcucacauuaucaucauugaaauacuucuuugcuauuuuggcaggcaaauaaugauguaucauuuucaucuuugauuacuaaugagguucacuuuuuuuuguuguuuauuaggcauuuaguguccugguuuuuaaauuuucugcaaguauauccugacuucuguggccccauuuugcauugcuuugaaguuauaaggaauaugucuuauuuuuacuuauugacuuauuuuuacucagcugcuggugcuggagccuagucccuauguucaggcucagggaugguucugcacaguggcuuuugcucccagccuaccugcuagccuacccauugucuagaagauaaaagcuucauuuaggagucaucucccaaaugcauuuaaaauaaaucaguuaaagcacagaauaguaauuuucuucugagcacacagaauuaaaguuuuauuuucacagagcucgcucacuuuuguuccuaauaaaugacugguuucaaaaggcuuccauaaauacccguuuuauccacccuuauaagcccacagauaugcugcaggguucugcuguguucauggaaaccauaaggcuucaugguaucugcaguauuugcccaaaaaaauacugauaacccaaggaugggacuccauucccaaagggcagggaggaaggggaggggcauuucagugaauuuuaauaugcagaucauccguuuccuaauggaguucaugcuucaccuuagagcugaaaaagcaagacuuacuuucgcuaagaaaggaaagacugaacgaugcacaugacuucuggaacauuuccuuaaguuugguaaagagggcacgcacagugcccggcagcaccgccucuaacuuguggagauggcccauccuucuggcccuucugggccuccuguaauuaauccccaucgcaguuaaacaaggggccgcgugguugccuucucugauaugcucuuccagagagacuuccccacggggcauuuacauccucccaggacuuguuuuauggaaauugcuguguucgcuucaguuuuucguuuucuguguuacaacgguuuuggcauuuguugccuugcaugaauuucuccgcaugacgugacagucugcugccugaauucaguauguccacgucaccuguucacgucaucuggccugagucuggcugcacugauguuucucauuaguguuacucugugcucauacccucagcauuuugagacccccucaaggauuaugcuuuucuuucuacuuucagccugaucauuuaagcuaagcacauugauacauugcuucuggugauaaauagcugacuuugugauuucauuuauucuaauguguaagucuccauuguguaacugguuugaccugcagaaaauugauuucagcaccuacuagguucaccuaggcugauauaggccucuucuucagcgggaaaagcuccuccucucaaggggaagaguccgggucagcgacugcaucagggucaauugugggcagaguacuucgaagccucuucuuccucacccucuuccagcuuucucugaugacugcaagcguagaggaaagugaaucucuaccuuguguuggucaucagaaguggcuucagauuccuuagaggaagaguuaaaaugugcaucuggaugagggguaaagaaaugaggucagccaguaaguaccugucuuauaguccuagaguacagccuccacacccagcuuugccauucacuccuucagagagugaaaccucuaagccucaguuucacugccuguaaaguggcacaggaagagaaauuugugugugauugaaagaggucguauucuauuaaagugacaguguuguuauuaagacgauuauccacgggacacaucucauugucauaaggaguagacaagauacaaaggcagccuuucuugagcugaaugguaugccaaauauuuauauguuucaaaaguucacaaauuuugccauuuuacuaaucauugccucaauggaaaacaagcauuauuuagcuguuucccugaacaccaacuuggaaucuaaaucucagcaauuaucaucauucacaaauaauuuauauuucugggcaaauggaagauaucauaucaucauuauuguguuuguucaauuugaguaaugcguccuucgaggacucauuuggaaguagauauguguacuauagguauaaaauggauuggagaaaauauuggauuuuaacauuucacuguaaagccuguauuccaaauuaauauaaaagacauuuaggcauucugauauauugcugguaaaaggagaguuaguaaaagaaugcaauuugagagcucauuuaauagagaaaaaauagggacaugucucaaaguguguuucaugcuauaauuuuaccaaacuuguacuggcuuaaugggaaaaaauauauauccuguguuucuuaaaaugucauuaacuuagggggcaauauuuaaaagcaaggaaggcuuuacaauguuguuagcuacaaagccuagcagugagcaauugcaguuaauggcaacagaacugccuagcucacaacccgccaccaaagcaaacacccuucagggcacgcaaacaaacgugugcacacccacguccacacacauacuggcugccuccauuugcaacagccggagagacguuucagcuuuggcccuuuaccuuccccauucuugauuuucuguguugcuuucuuuuuuccuccuucuuuuccuuuccacccagcuccgucuggucugagaaacucccagcucucccacuugacauucugaugagcccacauuccuccuguccuucuucucggggaggagaauugggccauaacucauuguggaguuguggugauugccuccacaucgggcacagggggauacaggcugauuuugagaaauuagaggccuuucuuugccauggcccaagaggagaggcugcacacacauuuugccggauaauaagggcagcaaguuuccaagagagcacaaaacagaaguucccaugauuuccauccugucuuuaauuuucuuguauuuaaugcaaaaguauuucaagcuuauuuuuccagucuggacaacccuguaucaggaaacacuugagguauuaauaguuagagagaauaaaauacagcccugagugugagugcaccaguguuucucauucauguuacuguguacucauguccucagcauugugagacccccucaaggguuuugcuuuucuuucuacuuucaacuugauauucuaaggacccccuaccaaaaaacauuccugagguuggaagugacccaugccuuaugcugaucuucccugagagaggggcagcagaacccagggcucccugcccaugccccguugcuucucccugacaguuucaagucccagaaucugggaugauuucggcuuuucccaugaguguugcucugucucaucuaauucuaucuuuugauucauuuacagggaaacuucguggcuugcaugacagcuauuuuacgacaaauggaagauuaccauuaugcccacuugaucaagacuuuugggaaaaugaggacugaugugguaguaagugucccuuucacccuguucacauaaccauguuuuagggccagcacuuuagacaaaagccugauaucaauauauucauuuaaaauaggauuuugcaugagaacuugucucugauugauuucaaaugccuccugggaaggucugacugaagccuuguuucuaacaagacaaggguccggacuugcagacuugcuucuagggcugaauggagaaugacucaggggcugagcccagggaaaucucuugucuuucuuggugacaguuucuucuccugugcuuugggauaauuggaaauuuggagauguuauccauggauagucucccauuaacuccuauucauuuauugguugacuuuuuaauagcagaagccagagugacuuuucagcuuuaaguuguacuccauuauuaauuagcuguaaucauggaagcucaucagcauuucuccaaauaauucucuagucauccucaguaaaacuaugauacaacuuaauuaggaaaaguauaacagaggggaauuuauugcuuaugaacuaccucccuaaugaccugaaauuacauugccauauggcaaauauccucugcaaagcugcaaccaaacuuguuggcagacuuugugauuacauguugacuugaacucuaagauuccauuucuaaggaucuguaagguccuguagaacaggguccccaaucccugggccacacagcaggaggugaguggugggcaagggagcauuagugccugagcucugccuccugucauaucaguggcugcauuagauucuaauaagaguacgaacgcuauugugaacugugcaugcgaaggaucuagguugcaugcuccuuaugagaaucuaaugccugaugaucugagguggaacaguuucaucccgaaaccugccccaccacccccugguccauggaaaaauuaucuuccacgaaacugaucccuggugccaaaaaggauggggaccgcuguaaaagaauacucauagauaccugcagaacauggcaguguacuaguguuucuagaacagggguuguugcacuugacauguaccuuauuaagaaaugggaagaagagaaugaucuguaugaguuuuuucaaaggauuauuucuaauacauaauuuucuuauuguugccacuauauauauaaugcauaguuuucuuauauaucuauaguggcagcaauaagcaaauuauguauuagaaaugauccuuugaaaaaauaauauuuuuauacuuauauauacauauauauacacauauguacauauauacacacauauauacauauauauauacauguacauauauauauacacacacacacacacacacacacacacacgcagucguguguugcuuaacaauucugccaaaugcaucguuaggcaauuucaucauugugcaagccucauaguguguacccuuacuuaaaccuggaugguggagccugcuacacaccuaggcuagauggucuagccuguugcuccgaggcuacacaccuguacagcaugugacugcacugaauacuauaggcaguuguaauacaauggcuaugaugucacuaggugauaagaaguuucaguuccauuacaauuuuuggaccacugacauauacacagucugucauugaccaaaauguuauuacgcagcacgugacuguacuucaagauuucuaaggagaacaaaaauggaucuagaccuuaaagcucuagcaguuuccucuaaauaaaaguaagggaacaagaauauguauauguuuguauuucugugucugguuuucccugaauauuaauaaguaguugauaguaggaguauauucaaauguguaaccuguauccuguuuauaucccaugacucuuuggaaaucauggcauagcgaaaucaaauuuuacauuuguaacauuuuauuccauaauugaaucuaaacuacacccgacccccugcuuuggucaguguaaagcauaguuguagcuuaaagcuagaggaacaguuuugcagauaacguuccagguugaauaauaaagucuucagaaauagaagaauuacucaccuggaaaagucaggacuccaauuaguacuuugcccuuuuucagaacaaucacuucauaaaaguccccacgugcaaacauguaaucugaacuauuaagugcuguaauugauaaggauccuucaagguaagugaaaagcgaugaugccgaauggcauuuaaaaauuacuguagcuugcugaauuccaagugugugcccucugucuuugcucacaucccaggaucagauguuuacuguguguuguggucccaauuucccaggggauguuuuuccauagacacaacaguuuagaaaaaucaaugauuuguagacaauuugacuuccauuaagaaaugauguuggccgggcgugguggcucacgccuguaaucccagcacuuugggagguggaggcaggugggucaccugaggucaggaguucgagaacaaccuggccaacauggcaaaaccccgucuccacuaaaaauauaaaaauuagccaggcaugguuggggggcaccuguaaucccagcuacuggggaggcugaagcaggagaauggcuggaacccgggaggcagagguugcagugagccgagaucgggccacugcauucuagcuugggcgacacagugagacuccgucucaaaaaaaaaaaaaaaaaaaaaaaaaaaaaaaugacguuugugguuuuuuauaccacaaauuuagacuggaaaguaugugaacuuuuuuacuguuguuaaucugacagaacuuuuguaaaauguguuucuguuuguuaacuauaccgaguauaugacuguuuuucaacucugacaacgauuuuuuuuuugagacagaguuucacucuuguugcccaggcuggaguacaauggugcaaucucggcucaccacaaccuccuccuccaggguucaagcgauucuccugcuucagccucccgaguagcugggauuacaggcaugcaccaccacacccggcuaauuuuuuuuguauuuuuuaguagagaugggguuucucuauguuggucaggcuggucuccaacucccaaccucaggugauccucccgccucggccucccaaauggccucccaaagugcugggauuacaggcaugagccaccacgcccggcuuacucugacaacuauuaaauaaaagauuauuuuguacagaauuauuugauguuauuucguauuucaauaugaaaguggccaaaacacuuuccauuuuuuuuuaaauuuuauuauuauuauacuuuaaguuuuaguguacaugugcacaaugugcagguuaguuacauauguauacaugugccaugcuggugugcugcacccaauaacucgucauuuagaauuagguauaacuccuaaugcuaucccuccccccuccccccaccccacaagagaccccagagugugauguuccccuuccuguguccauguguucucauuguucaauucccaccuaugagugagaacaugcgguguuugguuuuuuguccuugcaauaguuuacugagaaugaugauuuccaauuucauccaugucccuacaaaggacaugaacucauccuuuuuuauggcugcauaguauuccaugguguauaugugccacauuuucuuaauccagucuaucauuguugggcauuuggguugguuccaagucuuugcuauugugaauagugccacaauaaacauacgugugcaugugucuuuauagcagcaugauuuauaguccuuuggguauauacccaguaaugggauggcugggucaaaugguauuucuaguucuagaucccugaggaucuagaagccacacugacuuccacauugguugaacuaguuuacagucccaccaacaguguaaaaguguuccuauuucuccacauccucuccaacaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuuuaaauuuguuugaguucauuguagauucuggauauuagcccuuugucagaugaguagguugcaaaaauuuucucccauuuuuuagguugccuuuucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaauguuuaagucuuuaauccaucuugaauuaauuuuuguauaagguguaaggaaggguuccaguuucagcuuucuacauauggcuagccaguuuucccagcaccauuuauuaaauagggaauccuuuccccauugcuuguuuuucucagguuugucaaagaucagguaguuguagauaugugguguuauuucugagggcucuguucuguuccauugaucuauaucucuguuuugguaccaguaccaugcuguuuugguuacuguagccuuguaguguaguuugaagucagguagugugaugccuccagcuuuguucuuuuggcuuaggauugauuuggcgaugcgggcucuuuuuugguucuauuuucuugagacuauuuccuuuuaacaaguacuaauucagguucucaaauuuagcccuuuuugguugagugagucauuuucauacaaaaucacacuuacuaucaacaccagugacagugagcauauagagcacaagcggaaugacugauccagaagagaaaaacaauagacauguucagcucagaacucugaggacagagaccaucccaacccuuuuggauucgaaccacaaagaaucuguagaaucuucuacacuggagaugcugaccugcccaaggggcugcuggcugccacguguccacgucucaguaacagaagcagagaaugugccccgauucucuguaguuagcuagaagggaacaaugacggcuuugguacuucuagcggagaauguugucuugccacuugucacaaauucccacucuguggcuuuggaaaacacacuacauuuuccuacacucucacacuucugugaccagaagugugugggucucucccaccgcaucccauucccugacaccagcuggauguccuacaauucaauucaauucugacaccaucuaccuggaguuagcaucagauucugcaaggaaaagggcuuaucugaccuuacucagauuucaccaguguuuuacuuauucucuuuccacuguggaucacaaaaaauuuuacaaauacagaaaagcugaaagaauaauacaauggagccaggcucaguggcucaugccuguaaucccagcacuuugggaggucgaagcagaaagaucuauugagcccagaaauucaagaccagccugugccacauagugagaccccauuucuacaaaaaauauaaaaaaauagccagguaugauagcuuaugccuguagucucagcuacuugggaggcugaggcaggaggaucacuuuagccuaggaguuugaggcugcggugagcuaagauuaugccacugcacuccagccugggugauagcaugagacccugucucaaaaaaaaaaaaaaaaaaaggaaaccaugauuccugccaccucaauucauccguugaaagcacguuggcauauuugcuuccgucaugugucuccaagugucucuaucuauacagccaaccccuuucagucagugagagacagggaugcaccugcccuaagcuguucagcaaacgucucuggggacuaaagacauucucuauuggucauauugcuccaugagaauucagcaacaaccccucaugccauuuguauucagauuuccuccauucuuuccaaauuuuuuuguccuuuucacgcauugcauuugaugauugugucucuuuaaucuuucuuuuucuaaaauaaauccaucaccaucacacuguuuuauuuucuuuucauagcauugcuuuucaguuuuuuugaagagaccaauccauuagcuuuuguagacuaucucccauucuggacuuuuuuugugcugccuuguaauaugccuuucgacugguuucuuuaucccccuguauguucugcaaaccagaagcuuguucugagauucaagcucaacuccuuggcaagaguguuucagcauugcugucgaaagcuuccugcuguguuacuucaggaaguaacacaggaagugggcuugucaugcugacccacuacuggcgaugcugaauuucaccacuggguucaaagcugguaacuuccagaucccuccauugugaaaguauguaccucuuccuaccuuugcaauugucagauaaucuuuggauaaaacuuugaauccacaaaaauguggccauguccuauuucccuaacaauccuucaucggauggguugaaaaucuguggcugguccuuguccauaaugguuacuccuuuggcugagcagaauggaaauuuccuaagucuaagagugaagaugcuuugucuuuagucuaagagcauugggaagccauuggggaaauggguucagugugaugucuggaaagcauugaugccuugaugagauuugucauuugaaaagugaagcauggggacaagaaaggacaaggauggaccuaaguugauggauuuggaguccccuguggcaguccaggugcgagaggauggcuguuuuauucuagugggugggcacagggauggaaaggugcagacagagguaugacacgauuuugccucugaagcagauggauggcugcuauuagagcagccugcuuauuguauaagacauccugugaauagucaaacuaaaacaugcagccgggcacaguggcuuacaccuguaaucccaacacuuugggaggccgaggcaggaggauuccuugagcccaggaguucaagaccagccuggguaauauagcaagaugccauuucuacuaaaaauaaaaaaacuagccaggcauggugaugcacaccuguggucccaggauacucaggauacugaaacgggaggaucacuugggucccaggguugaagcuacagugaacuaagaucgugccacuguacuccagccugggugagggaaugaaauaaauaaauaaaauaaauagaaacuaaaacaaaaaaugcaacaggaauaaauccacauugaaugaugaaauuuucacaaaauaucccuuguugacuuggagacccuaguggaacaguccgguaagccucaucagcugcucaaggcaaacacaguuguuaggggccaccgccauggcuagugaauuaugcagaaaacaaggacgccuugcagaaccucaucucccacuagaugcagcauuuuguuugaucagcaaaguaccaaaauuuaacagcugagccauacuaaugaaguaugggacugugucucuuagaaaagaaagagaauugggaaaauaugcuucucuuccagaauaauaaaaacgagaggcuguagcucaauuauuaggcuuugagaaguaaucaucaagaaagccagcaauuucaugcaaauagagaugugacugaauuacgguacucagccuacaaaauaugcagccuggucguuaaaaugggaaacucuugacaaagugaggaaacucaguagugaaauaugaauuucaauaauuaaacuggaaaagaagccauuuguugugucggaagggaggacugggaugcucccgcuccugagagcagguggacacagugcccacguacagaguuuggaggacaucuggacugacuuuuccaacuugauuuugucugggucacuaaugucuccuagacuggaggcaucugcucuaauagagugaucaggaucacucauuuuauuuauggugggggcacaccaaacuccucacacuacagacuucaccugcuaggaccugacuuugccauuagaguuggagagaaaguaucuuaacuuugaacauuagcuuguuagugucaucaauuuuaacuugugccucuuugcaggagcugcuuauuuagaacuucguacugggaauugcuuucuuggcugcuuaaauucuguucaccaccuuggccuucacagccauugcaccuaauuaugauucaggagauuaaauaaaugagaaauauccacucauuuggcaaucccugaccauggccucauuuuucuaagacaguucucgguugucuuuucauuuccuaccuugaguguugagugagcuuggggcuaccagggaugugugcuuuuugggauagccacuuguuuuguucagguuagcucagagcaccugucaagcucuggaaaguaggaaaccuucuaauucugauagacacauacuggagucccuaggaaccggcuaccccuuccugaugucaggcacauuccauggaagcaggguagagcagcuggguguguacggaacccugcuucuuuucaguugcccugcgaaguacacagcaucaucuaagacaucagaagcauaacucgguagcuuuuggggauguagcugccaucuaggagaguuuggcaacacggcugcacacucaaaugguuuauugcaugccaaaucugugcagauggucaggaguaccuguuggagccuuucguuuugaaauuccguaagagaaaggaacagacaguaguaucccguauucaaucugauguguccuguucaucaugaaaaauugauuuagagcaaacauaagaaaaagcuguaaccugcaagccuuguuuguuaaaaucauguuuuccuagaagcagaaagggcuugaaugccuauuccuaaccuuuggggauuuacucuuuaacuauuagagagacaugcucagggacuguuucagaauauauucuugaagaagccgucucagacaggaggugcucagguaaacagaaagacaggucuaauucacagcuccuaugaaauauaucuucauuacuuuucaggauguguucauucagccuuuaaaaugggguauuuuauaaucuaauugacaggaggguaucauguuuaccuuuuucuuugugggccauuucaguguuuuguuuuuuuauuucaggauuuccuaauggaaacauucaucauguuuaagaaccucauuggaaagaacguuuaccccuucgacugggugaucaugaacauggugcaaaauaaguaaguguggggaaaacggcucucaccuuuucuauggcucccaauucaugucugcugggaacagugguguugccuggagaccaagcuggcuucaauaaaaugcucugcaaacgcuguuccuaauucugugcugcagacaguucuagggagacagggacucugaguuuguggugacuuccuuaugacaacacagggcucuggcucuaagaacuugagcuccguccccuggagaaaaacagccugaagcuggaucuccccuagcugucaucaugggcacagggguucugcucgacgucgcucugcgcucucauguuacccacauauuuguaucagcccuaggcacugucagcuccaugcaagaggcuuuugcaaaguguugacauuucacauauuucaguuuuuuuaaucaugagcauuuucuucauacucauuaaauauugaacuugugccuuguuuauaaucuccagugagggcuguugguuaauuuucuagcacauuggguuuuaucauuucuguaagcacuaacaaugaccauagaauucucaaucacgugggauuuuuaaaaagaacuuucuguucaucucuguuuuucuuucucauugcaauuuuuauggagauaauuguggguucaugugcaguuguaggaagucauagagaucuuguguauaagggagucgaugaugcgauucacugaucuuacucagauuuccucaguuuaauuuguauucauuaguguuuguguugaguuguguaguuucagcacaugcauauacuguggacuccaccaccaccgugaagccacugaguguuuccaucaccacaaauguuccucuuguugcccaauuauacccacauauaccucuccccuccccacuccaccauccguaagcucucucgaccacucauucguucuucauuuguauaauugcuucauuucaaaaauguuacauaaguguaaucauacaguauauaagcuuucagcauggcuguuuucacuuugcuuaauucacuggagauccauuuagguuguugccuguaucaauagcuuauuccuuuuuauugcuggguagugucccaugguacgccuggaccaagugugaugaaccauuuuccuguugaaggacgucugggcuauccccaguuuguggcucuuacgaauaaagcugccaccagccuucgugcaucaguuuuugggugaacaugaguucgguucuguggcauaaaugccuuccuggacaaaugcuggcuuguuggguaauugcacauuucgugacguaggaaacugccaaucuauggcuguaccauuuuacguucccaccagccauguaagugauucgguugcuccgcauccagccuuugccguugacacuguuuuugcuuuuagccaugcugauagguguguaguguaucucccuaggauguuaaauugaauuuccugugauggcuuugccucucuuuaaugccuauuguccuucccuucgacaaauccaaagcagcacgaccuuuccuuuggccuccucuggguuuuucugcuuucuggggcagcagagacagauuggccuuguguaccguggcugcgggaguccuacaaaccuccccgagggguaagcaugagggagggagugauguucaccccgcgucagauguuacugagcuggaagucuccuuccacacaucaaagauggcaucugagaguagauggugaggaagccccggagacccuggcauugcuguagccuuagcucuggcccggggagcagagugggggucuugaccucugcuccuccucacucuuccaccugcugggugacuuuaaauuauuccuguggccuucucucagcuucucagucgucaucuagaaaaugguggacuuaauagaaagcacuggucuuuucccuuuuucucuguuaggaugaacuuuugugauugacagucuagauuuccucugaagagcucuagagcguugugucuuuaauggcuguauuuugcacauagugaaaacaagcaaacacaucagcaacaauaaucaaaaaccccgcuguccuggagccauagaucucaugacaucauuggccaggagcagagguguggcugagcaggcgccugagcacaggguguggaggcggcccguguggaugcugcucuccaccucuugacuccucuacguguagaccugaccuucugggucucccagcagagcagcacguccuggcucucaggcuguggauuccguggcccugggugagcacugcucugacaaaggucaggcgggaugggcucccugaaguugcauucaugucgcuccuacuccgagggucucccguuuaggagggaauagucaaaaucuacuuaguucaugauuuuuuuuuuuuuuuuuuauaauugagagccuguuuucaguuggaacaucauagccgcaucauucucucuuccuacuucacugucuuccuccugccgccaacccugcgcuacguaaggguugcugcagcacuggccgugaugcaaagccacacaguaaguggucuggggcucaacccugggagugcuaugguucugguuuccuucuccagagacccuguccagcuucuccugggauauucuguuguuucuggggugagcagguggcuugauccacauuccuuggaaucaugaauuugcugcaaaccaguggcaaccuucccuggccagcaccccuacucacuagagccccuucacaggguauggcgccugacagagguacccgcgcugcagcagcagguugguacaguggcauuuuggaccaaagccuuugcgucuuagaaaccgggaagagagucuuuuguuuugaggacagggaaacucuggggagaagccacagugcucaguguccucucagcaguugauuggaugagacuucugaggauaaagucuaccuuggugauaauaaaguccaccuuguucucuuguucaucguguacacggacugcagcuggaaagacgucuugacaagggaagcagccugaauguaaaaucccuacaguuuauuuucuguuuuacauaaaauguuauccugaaccuucuaaucaaggauuccaguacugugaggccaggucguugagcaguguuuccuccaugggagcuuccugcagagaagugaugugugccuguguguguacccaugcucaucuguguguguaccugcaugugugugcaugugggugugcguguguguacccgugcucaucugugugugucccugcaugugugugcauguggguguguguguacucgugcucaucuguguguccuugcaugugugugcgugugggugugcauguguguacccgugcucaucugugugugugcauguggguguguguguguacccgugcucaucugugugucccugcaugugugugcaugggugugcguguguguacccgugcucaucugugugugugcauguguguguguguguacccgugcucaucuguguaccugcacgugugugcauguggguguguguguguacccgugcucaucugugugugugcauguggguguguguguguguacccgugcucauguguguguaccugcaugugugugcaugugggugucuguauguguguacccgugcucaugugugugugcauguggguguguguguaccugugcucaucuguguguguaccugcaugugugugcaugugugugugccugcaugugugugcguguguacccgugcucaucugugugugucccugcaugugugugcaugcggguguguguguguaccugcaugugugugcaugugggugugcguguguguaccugcaugugugugcaugugggugugugugugugccugcaugugugugcaugugggugugugugugugugccugcaugugugugcaugugggugugcguguguguacccgugcucaucugugugugugcauguggguguguguguaccugcaugugugugcauguggguguguguguacccaugcucaucuguguguguaccugcaugugugugcgugugugugugccugcauguacccgugcucaucugugugugugcauguggguguguguguaccugcaugugugugcauguggguguguguguacccgugcucaucuguguguguaccugcaugugugugcaugugggugugugccugcauguacccgugcucaucugugugugugcauguguaccugcaugugugugcauguggguguguguguaccugcaugugugugcaugugggugugcguguaccugcaugugugugcaugugggugugcguguguguacccgugcucaucugugugugugcauguggguguguguguguguaccugcaugugugugcauguggguguggguguguaccugcauugugugcaugugggugugcguguguguaccugcaugugggugugcguguguguacccgugcucaucugugugugugcauguguguguguacccgugcucaucugugugcauguggguguguguguguguacccgugcuccucugugugcauguggguguguguguguacccaugcucaucuguuuguguaccugcaugugugugcauguguguguguguguguaccugugcucuucugugugugugcauguggguguguguguguacccgugcuccucugugugcauguggguguguguguguguacccgugcucgucuguguguguaccuguaugugugugcauguggguguguguguguguguacccgugcucaucugugugugugcguguguguguguguguacccgugcucaucuguguguguaccugcaugugugugcauguggcuguguguguguaccugugugcugagguguugguuucaaguaaagacacuuuuauuugcagagauucuuacucucagaagcucaaacaaacccauauuccuaucccaguugacacauucagcagaaacaagcucccaagcccacacagcacaagagucagccaccgaggaggcauuuuagguccugauuggaguuggucacugauaacuguaacuuuuauucccacauccuucugcccccauaugcugcccuuuguguugaauaaacaacaugaauguuuagaagcuggaucagguggguuuuugaagaagguuauugccuucaugugguaagauacuugaaacugucuggagacagcuuguugagagacccuuaaguauucuuugacaccuuugcuucaauaccagcuucaaaaugaaggguuugcaucacuuucccuguacauucccauucuuugugaggcauugcacguuugcguucuggagcugagagugagcuaacauugggcaugccucccagcaccaggcacugcuguggggaugucacgugccaucacguccuucauacccucagcagcccucugggacagcugcuguguuuaggcccacuuuacacaugggaaaauugaggcauggagguugggucacgugccaaaagacagagagcugggcgguguuagugccaaaauuuaaccccagagcauccaccccagagccgugccugagccaccuagcuacccugccucuuggucuuaaguaggucuccuauuucccaagagaguguuaggaguuuuuguuuugucuuuauucgaguguccauaaaacauaacaacuuuuccacaagguuuacugcuuacgugagugaauuuugaguguggaauucauuacauugcuacuuacuuucuucaccuuuagaaguguaugcaccauuuaucaauguguuuuauaagagcgaaucuuacugugcagucuagaaaaaucacgucucccuagcauugucauaaaguaauccucuuauggaaauugcagauaccauauucuaugucuuuaucuaccugccauauauguguauauauagauugccucuuacuagauuggugauauaacuuguaaaucaagaaucaaaauuacaggauuuaaugacuaucccaaaguacgguguucacuugguuauguccaagaugggaacugauaggcgauggccugacauuauagcugugcucuaggauaugagaguaccagauggcaagaugacauuuaagaugagcacagcacagaaacaguagaagugugcuuuugugcuagcacccagaagugcuuuauaaucuucccagaggggagcagcugcuaagguuucacugaagcucucagguucuguuggaagcacagaccuuucccuguuggcaccuacaugcugguauccauccuggaacucuuauuagcugacuugcucggauucacgcuuugugugugcagcauagucuaaauggccagcaaucauaccauggcuaucauagaauucuccuugguuguuaaugagaaugugaccacuugcuugaauuuuugugucucuucuagucuuaggguuugccuucgugcuccaguagggugcuugaguuuauguacuaauaaccccuacuagaauuuuaagugauaggaaugaccugguaggaagugagucugccagguaaaccgaaucccuuugucaccucgaagaaaccguuucuuauuaacugcuuuacuuuugcuugagaaaggcauuucuacaacauguggugggugagagagaggccaguacugaauguaauuuucccuauuuuggaauuagacuuucuuguucguauugacuacauagcguguaacaaaaccuuauccacaguugucagcuacugagacuuguaacggaauuuuuaaaaauucaacuacuccagcucacagcuucccuaguccucccugccuacuguacccucugcucucaggauaauaaagacaugaaaccagcauuugcauuuccucagagcuaguguaguuugcaacugugauuaucaaucgcuuccaggcauuccucucuguuggcauagguuuuguguuugagacuuccuguucuuuuucaggcuaggcugggaccuacgggaaauaaugauuaguguuuugaagcccacacacuuucauagaggacuugguaugucuugcaaguaaagguucauauaacaugaauauaaaauagaauauguaaaauuguagagaaaacgaugcuuucuagaaguugaaauacucaaagcugacugcaggauaaaacauaaaggcaaauaagacgguugccggguucucacugguuggugaaaaugauccuugccauuuaucacgggaagcuggcaguuuacaauguagauuuuuuuuuuuuccaagacagggucucacucuguuguccaggcuggagugcaguggcaggaucauggcucacugcagccuuuaacuacuggguucaagcaauccucccagcugagcuucccagguagcugggacuaccgacacauaccaccgugcccagcuaauuuuuuguggguuuauuuucuuggagagaugggguuucgccauauggcgcaggcuggucucgaacuccugggcucaagugauccacccgccuuguccucccaaagugcugggauuacaggcaugagccaccacacccggccaugauguagaucuuuauauaggagacacugaacaggagaagaucauagggaaggaaucaguugagaauucaaaauucugcccauagaaaacagaagagauuauucucucaguuaggaaaugcguaagauguuaccagucagcauguugguuauaacagugguugguuauaauuggacuugucugaaagacuagcucaucaaaugaaggggauuuagcugaccugauccauucagucuugucuagucguugaccauuucaacaucagagauugucagucaaaaacuauuguuugguuuuguucuaucugcaaucaauuaaucuuauacuuguccuuucaaacuuugaaauuucaucccgauuuggaguuugugagaucauguugcuauuuauuuccagugucuguguguuacacauuaaaaaaaaaaaaucauggccauauggagaccaucccaaacagaucaggaugaugcuugcagucugcaaaggauggaggauuuugaucucuugaccucauuuugacaaccaccuuggcucauuucucuguggccucuccuccucuccccaugauucauccuucuuucaaccaggaaguguuuuccucaauccauugacguagcauauuacauuuucaccagccugccauauaugaugucuauggacaccucauaaucacaugcagcuccuuucaugaggaaaaucguccaugcuuauuucuguaacuuaacaauuucucccuuuuuaaauagaaugcauuuccucacuuauaaguauuaucuaccagauguaucagaguccaggauggcaagcucucugcuauuucugccaaaauuaauuuggcuuauagucaggacaggaaagggccuuaagcccuagaaagggauuccaccuuggagaugccaguuccuuaaggauaagucguguuggugcucagaaggcaaauuugcaggguaggcuguuuguagguacuuugccauuugcuuucguugccgugaaggaauuugagucguugaccacacugagcugagggcuuggaucaggggaaaggcaccgcuugccuuaggaugggagagagggaaaaauuagugcccacgugcagggggccugcccccaggaccauggcaccaguggcaaccuguggauggccaagucaggaggacugcguguuuucuuuccuguucuaccuccguccagagaagcaccucugcaucccaauuaagggugcauaguugaauauucuuugugcagguugaaaucaugguuauaaagcauuuggggcuugagaaacucuuggauuauuacuucuuaacaucuuuuuuccuuucuuugaagccuggauuuuaguugauguugugacuucucauuuaauuuauuuuuaauauuuauuggcuuacuauugagguuuugcacagccaauggcuugaugauuuuaggcacacuuuagaauuauuuuuuuccuuugaaacaguauacagcaguuguugacagcaaaacacaacuagcuaaguaccaaaacacacacacacacacacacacacacauauauauagacuguacugacuauacauuuugcuuugcacugagagauguuucaugcauaaaauagagagggcacuuggcuuugguccucauaacaugaagugccuccucuggcauuaagugccaguggaauguggcauuaacgccagccaggugcucacgaugagaugugcauggucucugagaauuuggggugaaaaaaauagcaauugaaacucaguauagugaaaacauucuggaaugaagauuucccuagaguucuccauaccugcauuuuacuacagcucaugcacuuaauaauauugcucuuugagccuucuuccucuccaagaaaacuggccuaaccugagacauuucacagcccagaguccccaguuugcaggcaccagggccacaguucuccuuccuaggcugguuaacuugggcuguaccugagugcauuucuggcaagucacccagagaaacacaugagacuuuucugggggcuguguuggccauugugaugcaucaggauuucaagacagauacugacuuggauccaguaaugaugcucuggacccuccagcaggaaaaggaccccacuggggcuacauugcuaugucuaucauuuuaguuuuaucuccagagguugcuuuuagaggggacacagggacauuggcaguucucucucagcagcuuuugggccuagauaugguugcagaugguguaucagagcccacugcaccuugggauggaaacugaccuacgaccaaaugcuaccuguucgaguucuguucauucuuaaggccuagucauaaauuauuucagauacuuuccauaacaguuauucuauuucaugucugcuuuugcucuuugcuuaauaacuaaaacaaauaauuuccagaguuuuaccugguuguuuauaaccaauguauugcacauagccuagauauuuuaaacugugucgucuuauucagauugccuguuuuaaauuuuaauucagagaugaaaaaucaaccuacucucaaaggaguggcagugaugaagagcucucagcaggacucuuauuuagggaagcuugcuuuaaaggaaaguuugaaaagggcaaagucuguuuaagaauucucagagaucacgcgcaccucgucgggagugccuggcugguacugaugccgcaucccgcuggcacuuaaugccggaggaggcacuucauguuacgaggaccgaagccaagugcccucucuauuuuaugcaugaaacaucucuccgcacaaagcaaaauggaggagauacacuuuauuaugauccuccucccgguccucucaugcuaaguuuuaaccuccugugcuacugggacuuggaagaaggucugugcaguauaggacccucugguguggugcuuuuacgucuagaacaggaggaagaggcagccaagugaacugaguccucgcaggcuugccaggcugugucuuccgugucuuuuugauaguucucaaugaaggacaguuguuuccccuagaggaaaaucgacaauguccagacacguuguugucacaacuugggaagagagggcugcuggcauuuaguggguagaaaccagggaugcuacuaaacaucuuuucaugcacgagacagcccccugccgcaaagagucauuucauccauaaugucacuagugucuccaugugauagaugaaaaaacagaguccagagucucagugaugcucaguaacuguuagaaauacauagaaauaugugugcaguggcucaugccuguaaucccagcacuuugggaggccgagggaguucgagaccagccugaccaauauggugaaacccugucuguacuaaaaauacaaaaaaaaaucagccaggcaugguggcaugugcauguagccccagcuacucaggaggcugagacaggagaauuccuucaacccaggaggcggagguugcagugagccgagaucgugccacugcacuccauccagccugggugacagaccgagacuccaccucaaaaaaaaaaaaaaaaaaagaagaggaaagaaagaaagaaauauaugugauuuauugcagugacucucuucuccuuguuuccccauuucucagccacccuucucugccaugugaccucagccaaaccagcgcccucuagaacaaauaauagcagcuagcugcugaagauaggacuggucuucacuuauuagggggguguccgagaauuggaggugguuuccccaagucgcucugccaggggcuccagugucuuugcaggagauuuuugugggcuuugauuuggggugguguuugggagcaagauggcauuggaaucacagugacaugaauguacaugccagggcugccuccaguccugccuggcaugugggacacacguugaaaauauuagcaagagccuguucucagggugcuugggcugccagccucuacaccccaauucugccgagccuggggugaaagaguagccacaggccuuuccucucuaccucucccagccagaggccaccuucaguacaaggguuggaagcugagcccuggagucaguuugucaggucaaauccgugcuccaccacuuaugagcuuuguaaauuuaguguugggcagauuuaccccgugcuguaguuucuucacccguaaauuagagacagaagucaagccucgcuggaguguuuugggggaauaaaugagaaagcgcauguggggugcuuuguucagagccugaccuccagugaccuugcaacaagccaugucugugacccccuccauuuuuaugaagaugacaugauagugugucauugucccucugaaucugagaauugagcccacagguaagggugugaagcauagacauugcccuggagauucagagcacuuuguacauguauugagaaauuacauuauaaaaaaauacaauucuuugcuuucauagauucacucucuucuugugaggauauuuguauauauucaaauugcgguuucccuugauuuauagguaauuaagucaacccauuuugcuugcuguuuuccuagaagcagcauuugugaauugcuuuaugugacauggcugacacucugucaagcauaggucuugugcaguugucucuguucagaagccagucaccaaaauggugguccugucugcccuggcaucuuggaaggacagagcugcaguccccagagaggauccuguguugucccucaugugcagaugagguucugagauucagggggguugaaugaguggcuccgggcccccugugugaguagcaggagagacugcagaacugguugcucuuaagccacauccaaggccaggcacauaaaauguggacagugacgcccaccacccaugcaguccuugggaagccccguuggcauaacgagaauagagagcuugacgaggagguccucagugaaugaaugccagcuccugaccacgcucaguuuugguaacaguaaguggcacugucuacagagccucucaggaaccggggacuccaccugccuccucuccuucucccacccucagagccaaucauacacaggacccaguggauaggacuggaguuccggaagccagcuccccagcgccuccuccgagcugccauccuucucuccuguggcaggggugucuuccucugaaaucaguguccaucucaguccuggccgcaccuccacaggcucccgaugucuggcaagaaaagcuaagcagggacuuccaaacguguuugaacaaaacuccaaugaagaaaaacauuuccaaucacugcucgaugcacuucccacccccaucaagguguaacucagcgagaauuccuuacugugcagagcccuccgauguuuuuauucuguucuguucuguucuauuccaucccauccauucuaucccuuuucacuuaauaaguaaauaaauacaauuucacauucuucccauucuauugauuucgugcuccacugaaugaaucacagcugaugccagccugugccacccagcacagaaaaugccacauggcugacuuuccucccucccucccucccucucuuccuuccuuccuuccucuuucccaguguccuugccuguguguggcguggucauuauuuuucauuuuagccauucucauggaugugcagugguguguaggcaggggagcugugugucuucagcuucuguaggagcugccaacuuccuuuccaacaagacuucagagaaggcuucacugcuguccagaguuguucauucuaccuuuuuacacgucccugucccccaagcaguguucauguugcuaugcagccucagucauacuuuguaacaucagacugauuuuucuuuauccagucuggugguguguagugagauuguguuaaacucgccuuuccuuaauaucugauuagguugagcacauuuuuauuuuugagaaauuaucauuauuuucucuuguauucaagacucuugucccuuuuuucuaugcuuaacaaaaguuauauauguguguauguguguguguguguguauguauauauacacacacacacauauauaaauguaucuguguucuagauaagauccuugggucagguaucugugcuguagauaucuuucuccacucagugacugcaggauuuuuuuuuugucacuuaauaguguucuuuguuggaugacauuuaaaaugucuuuugaagacacuugcagaaagaaccugaauggacucaccugcuggugacugucuggguagcaaggcucagcaugcuugcuauguggaagcuucacgaaaugccguuuaaaaaauaaaauuaucuucaaaaccaaacaugcaauuccaccauucuuugucaagcuccugcuauuuuuucaacacgaaauuggaaauaaaguugaauaauauacuuucuccaucuucaagaaagccugacugugauauacuuaaauuuuuaaaaauucacuuauguaauacaucuucaggucuauaaaaaaaugauaauguuuaauuguaauuuuuccauggaaccgaaauguuaacagcauugugacauuuucuauacauuguuuuucaugcaagacccuucuguguggcacuuaauauuugucaugugcgauuuugugcauuugugcaugggucuuuggcacugggggggauaucucuucugaacauuucaguggcugcacuguacacugucccauuacccaacacacaguaggugcucaacaggcagugacuguguaacugcugggcugaaagaagguguaucccuaggaaauguucuaggaacaaagugaaccaauaaaauacaugaaauacuuuuguagcaguucauuuuggagaauaaaaggcaguuacucuuuuuauauuugaguccacaaagaaacaauugcagcuauaaauaugcagugaacaaauaccucuuauucucuuuaagaucuauuagccagagcuaauuccuuaauugaauguuguucuaaauuuaccaccaaaaugcaugagggcgaucuguguuuguacguuucagccaacugcaugacaucaguuccaucacaacugcaggaggauggaggaaggcugcugugcacgauuacuugcuguuuuguggucaaccuuucccauaagacuucagagaagguuuuuacuuaauacuguaccugucaaauucccagagcugcaaguaaauugaagauacaaauuauguuguaaagugaaauauuuuguguuauucgcguuauucugcaguuugguugauuuaggaagaaaaugaacucugacagcuugaucuuuucaguucaguggauucuaauguuucaaaacaaaagaccugcacugaagccucuuuccuccaugcuuuggcagagacaccacugugagcucuucuucaugcucaaaccucggcagcuaccggcuccaugucauggacacacagaguccuaggaagagauagauucugcuaaaugcuaauguuuguaaauauaaauauuaaccauaccccgaaagggaaggaguucuuuugcuggcugacugaauggguagcuuuuagcaccugccacuuuucucaacaugcaaucuauuuuuuauagacagaaaaaaucucuuuuucuagcuuuucugguuugcugcuguugccucagugauauugcuugggaugcagagguuuggcaaagagguuggaggagcaccccugcauuaguccguguucacgcugcugauaaagacauacuugagacugggcaauuuacaaaagaaagaguuuauuggacuuacaguucuauguggcuugggaggccucaccaucauggcagaaggugaagggcaugucucacacgguggcagacaagagaagagagcuugugcauggaaacucuucuuuuuaaaacccucagaucuugugagacauucacuaucaagaggaacagcacgaaagaccugcccccaugauucaauuacuucccaccaggucccucccacaacaugugggaauucaagaugagauuuggguggggacacaggucccucccacaacacgugggaauucaagaugagauuuggguggggacacagccaaaccauaucaaccaccuuuccucuucuguucugugguuaugcuagacggccucaccuucuuuucuuauucuuauucaggggaaaacacuaaagugaaguuuccugcaagagccagaaaauccuaaguuaacaaauugaauucugcaacugagaugcaguggguggauguagggcugggcuccuuggaccgaggcugaaccauaaauaccucccacuuugguauugcuuugaggagcuucccagcauucacccuucacccuuuugcugugugccuuccuuuaccuuagcuaaggaagucuaggcagcugugcaggauuugauagguggcagcuuuagcucagacucuggaaguucccugcucccugcuaacuccaagcuggcuccuugcagcuguccccagugucccuuggacuauggggccaggcaucugauuugauucuucaaacugaauguuacugcuucuacuuuauuuaaguaaauggccaucucauugccaucugaugcuguagcauacugugcgaaagguauuuugaauuagcuguuagcagcugggugcgguggcucacaccuguaaucccagcauuuugggaggcugagguggccagauugccugagcucagaagcuugagacaagccugggcaacacgacgcaaccccaucucuacuaaaaguaaaaaaaguuagccgggugcgauggcaggcaccuguaguccagcuacuugggaggcugagacaggagaauugcuucaaccugggucgcagagguugcagugagcggagauugcgccgcugcacuccagccuggguuacagaggagacugucucaaaaaaaaaaaaaaauagcuauuagccugcagaugauuuggauaugggaccuaaaaagcaagcugauuaauugauagauguauuuauuuaugauauucagccugagaauuaagcuggauuuagaauaaaguguuucuuaugagauacgcuuggggguaaacaugaucugcauguaauucacagguccuggcauuucagagcaguauucaaaugcaugucugccauggacugugagcucccaaaaaaagugcaugaugaagugaguuucgaauacugacagaaacgguagagaaagggcauguccugguccuggcuaccguugauauucugcuuggagcuuggauuugggguuguguuuuagcuuaaagaaaccauauauaccuccaaugagaaagagacuuuugggugaagagggacuggagggaacccauggaacagaacaaaggcugggcuuacggugauagcccgcauucauuuagagauggaaaguugcuggaaacuuuaaaacagagcacugcugucacugccugauguuuuucagggacuguuugggccacugugcagagcacagggaguaggagauuugugugcaaacuggagggccagcgagagcccuggggauaagcuacaccagcgauggccaugucuuuggcuaagguagucauugggaagagggaaacaaugagagauuuggggcauguuuugcaggccacaugaaccuguacaaacuagauguaagaagugaagaaaaaugaacaaucaaggaaaagucuuaauauuuuuggcuugagccaaaagugauugguggaaaguuuaaagauaaagaagcgggcuugcgaggugggaguguucccgagcucuguuuuggccuagcgcaguguuucucaacccuguuuauuuuuuuucccauuaugacccuccuaaggagagaaguaaauucacuuuaauuaagaagagaaauuuaaugcuaaggaauaagaauuugugggguagggugugcuuuggaggaccacaagcagaauaauaucuaaaauguucuuuacccuccucccaagaaucaauuucacccccuuaguggagauguuucccccaguguggauguguggccugguuaauucucaggugcccaggagguggcccaauagagaaguuuagcuagcaacuggaaauucuacacugacguucagaagaaagguaaggcuagaagguacaauuugggauuuagaugaugauauucaggccaccuggggggcagugucucuagggaagagaagccgacccaggcuaaugccucagggcucuuugauaucuagggguuuagcaguggaagauaagucagcaaaggagaccaagagcaggagucaguaauaggaagaaaaaaaaaaacacaggagagagaagacagugcugaauuucugagagagagcauagaaauuaacagagaaguaaccaaaggauuuggccacauaguggucacugcucccauggaccagagcugccucaguggaguggaguggcagaggaggaggccagccugcugugcggcauggaggaaggcauggaaggagguaggcacccuggcugugggcguucauuggguuuucauggcgcucagggucagacagauggugugucgggagcugugauaccaggagaguuuguaggaauuugcuguugauuuagggcauguugggaacacugguggagaugagcggaugaugggugaagguggaaacgcugggauggaggagguucaugagggcaaugaguucuagaugaaagggaugguacaggaggggcuggccuggagaggagcaaggucaggugauuuguugcaacaggagaggacagagggagguacaggugucaaccuguguguagauguagguggugguuggaugauggaaaaaaacccaugugacuucugcuuuccuacugcagaaugaagucagguaauuagugagaaggggugcagagaauagucaaauauuaugaucucuauaucucugugauggccauauuaauauuucaccuuucaccaauuuccccgcuaaugcccacgcauggcguacaggccgcguuggagaucccugcggcucaugcugccuuauuacguaaugcccuggagaggccucacaaguagaagagucuaaaacgauagauugcuuuaaauaacucaugcuaaaucauccuccugugaacauuucucgauggaucuugucuuuuaagcuucaacaaacccuauuagccaucaaaauccuccagucucucaaaauagcccucaucagacuugcucccacaugcuugcgucauggcuggguggccacuggagagguuggguggagaugcuggcuguguacauaggaaccagagccccuagagagaugacuugugucugagcaccauucuuaaagcuuuccaauacaugggcugucaguggcuguaugcaucuucucuguuugacuuggcuuagggauauuugggaggggacaggggggacaggcagcauuaagcauccuuuugcugguccucugucuuugagugcaguucugugauacucagaugucuuccagaacuaucggcuguuugauuguggaaauuccuggaagacaagggcuccuguuccuucucucgccacccgugcuuuuugucuuucucacccucuguuccuuuaagaccacaaagcagggacucggacacuggugacacggacauuucaggcucuagcugugggacgcuucaggcaggcagccugaucuuuuuuccauuuuguuuagagguauagauuguacaccucugcuccgagcuccuuuaucaggccccagaaaucauggaugcagcaaaaauuuugaaaaugaaauuuuuccuauauuaucccaauuacucuuuggucuccaugaagccauuguuuuuccaauuccucuauugcagaaugcaugcagggaauuuagaaaucacaugguaaacguuaugggccauuuccuauugcugacuuuaccuuccuaguuccucagagauguaagaugaaugucccuggugccagugagcagccagucagugugcacagagcuggaaaaacuaauagacuagaugcaucuuacugaucacguugauguggaggggccucaucucucugguccagcuggaaaugugauugcugccugggguggccaugacuaagggauuccugucucagcugccucuauauggagaacugagcugaacugguaaacgcucaguuucccuuucagaaaagaauguuacucucaagagcagcagugauucaaauggccuuuugacuuuaaaaaauucuccauuuaaaaauguagaagcauuuuauccuauacaauuauaaacauuauugguagcuaauaaaaaauuuugaugaggcagcagaucauuaagaaaauacauauagaccuugcacacuucauuuugacuuccaauagauaaauagauccauuucacaaagcaugugcauuugucagguugcuuuuucuugguuuuguuuuuuuauuugacuuaagauaggucuauagaugaguguuugccuucguuuucugugagccaguuuucauaccuuuaaaguugaauaagggcugggcaugguggcucacacuuguaaucccagcacuuugggaggccgaggcagguggaucaccugaggucaggaguucgagaccaggcugaccaauauggugaaaccucgucucuacuaaaaaauacaaaaaauuauuagcugggugugguggcgggcaccuguaaucacugcuacuggggaggcugaggcaggagaaucgcuugaaccugggacgcagagguugcaguaagccagaacuguaccacgguacuccagccugggugacagagcgagacuccaucucaaaaaaagaacugaagacaaucgaugaaacgauuugaacgcuuuuuagauuuagugagucuuuuaaguugucucucacccaucugacuugacagcaguuuuucaagugagucaucuuuuuaaucuuuucaaaucuuuagaauucguuuucauguaaaagucaacuuucuuuucauagcccuauuuuauauaauauuucauuaaaacaguuauaauaacagauuuauuugguauaaagcagguauggagcacgcacacagcuguguccacucacuaauccaugcgcacacgcuucccucuuagcuguagacaccacaugaucacaucacuaggggagcuauucaguggaaccccaugcuguccuuguuagguggauuuuuaaacacucuguuaaacuaaaaaaguauauucucacuggccaguguccaguguaagcaaauuugcacauggcugucccuugagucacuguaguuaccuuuuaaaaggaaagagagggaaacuccauuguguagaucuuuccccagccaagagaccguuagcaugcgguacaguaaggcagccacucauuaacuguuuguuuaccuggcaaagagggcagguuggugagcucccagguccucagaaaaugagacuaaguuuuauuaagaucugaggggaaaaaaauaaaccaagcagaacuagaauucacuggaccagaagguuuuguucucccuuuuccagcuaaucucucucauccaaucugagagaauuaagcaagggugagggaguugcagcuggcugaauucaggaaguuaccaaagaaggcugauuuaacugaaaagacauauauucuucccaaagcccaggcuauugagccagaguaccugaucacccagcaaagcaccacucaggcugugaggcuggccacgcacagggaggcaaagagaggaggagagaggaacuuaacuuuguuuuucuucaaaaagauguguuguuucuuggcaaaauguaaucaccauuguuagcaaacccaugagaugcucucagcaauguuuaucaaauagaaagagcuuccuucugugugacaagcaggggaucagagugacaguguuuagaucuguuacuuacaaggugauaggggcaaaaauuaauaccugcacaggcugacuccugaagucuucaucaccagaaaugccagcaugauguccaggcccuaaggugccuaccauguccccaugagagacacacagugccaugaacagucuggguuuuccagaaauacuugauuugguuaauugacaaauucuguuguuccuccuuuauaguuaauuaauaauuuuccaguguagcguuuccuaucagggggugugaauccacacacguggcuuuuucacaauaaaauagcauucauggugccuuaaaacagcuugaaaugccccaaauuacuagacuuguagguggauuucucacaaauuauuauuaaagguaaugaaaaucaaaaucaaagcauuucauauuuauugugucuuuagggcaggccauacuuuacaaguaccauuuuaagaaauccucucaauagccauaagagggcaggucauaugaucuuuauuuuucaguugaggaagcugaaggcaauacugauuuaguaucucacacaaggucacauggcuaauaaggcagagaagaaucagcuuugcuugacuccagaguccguguucuguauagacaaaggcaugaggucauccaauaagguaaucgcuuggagaaacauuuuucccuacuuguuuugauguagaacuucuguaccaauuguaacccucugccgguugaguaaauauuugggguuaaauauaaagcugaaauucaaauaaagaaacauguuacuguucucuacagggcugguccucaccuuuucacaacgcacuuuggaaaaccagcacagaacaaaggccccucccagccugguguauucagaccucagugcuuugccugggcugcagcucuguugggaaaagguggcaguucaguucccgaggcuggugcccucggcaagaaugggagagccugguaauuuauaaaggauuaucacaugcaaaggcaauguuuguuuuauuccaucaucucucauucuuucaaagcaguggcguuuucuuaguaucgccauguaauagaguucgagaaaagugaccuuaaaauugaggcaagugucacacuuugagaaugcauuaauuuuuuuaaagacauuuuagugguuuuaaaauuuuauuucauauauauauauauauauauauauaauuuuuuuuuuuuuuuuugagacggagucucgcucugucgcccaggcuggagugcagcggcgcgaucucggcucacugcaagcuccgccucccggguucacgccauucuccugccucagccucccgaguagcugggacuacaggcacccgccaccgcacccggcuaauuuuuuguauuuuuaguagagacgggguuucaccguuuuagccgggauggucuccaucuccugaccucgugauccgcccgccucggccucccaaagugcugggauuacaggcgugagccaccgcgcccggccuucauauauuuuuauguuguaaaaaggggaaaccuuuguucuuugaguaaaaugcccugguagugaacauuuuuuaagguuuuuuuuauuuugacagacauacccacauuucacgcagcaucaugcuuacccauucaccucaucuugcauucagagagcucucaggcacuugcaaaauugaaggccagaaugaagggagcucagucauccuugacaacugcuggggacaaaguuggcaauuuguucauuguucuugcaagcacuuagccucuugccgagcacuuuaacaucagagaauucugggcauagaucagaaaucaguggcugcagaggcaagcuacgugcagguaaguuaagggcuuacuauagaaaugcaaaaugccaccauucuucacuguguucugagagguuucauacuguugucgacaccugugcugguguagaauugcagaucucuuucugucuuuuuuuuguuguuuuucuccuuuucauuuuuucauuuuuuacuccacgcuaagaacaucggaauauuuucaacuuuaccauugguaaaauagugcaaaggaagugaagaucacgucagcccaugguccauauuuuauuccuugaguuagcaaaucaccaacacuauuuaguuuagcgaguuacuccuuuggaauuuacaguaaagccauauuuaauauauuuccauuuagcaaguauuuguuuuaaauaacagccuuggcuuccuuguuugguuugugagggagacuuugcuucuguguuuccaacguggcuggaaguggaggcuccagggcuuugccucacucauacaguuuuauuuuuaaauugaaaaguggauuuguuuaacauccuccaagaagcaaacucauaaagcucgggcuuuccuaaaaugcauugccaaaaucauaauugguagaaaguuagcaagaaagaaggauuagcucaucgagccguggccuagcaaauuguaaugggcucaaguaguuuuguggcuuguugagaaaaugauacagaguuuaggaagcagaaggacacagcaaugacacaggagagccucacaaacaacaaacacugccuuugccaggagaauugggaaugggaccauucuugaccuuccuggaagaacucagaaggacguuucacuccaggaggcaucaggagggaagucuuucauuguuuucaaggaaucuguugucccugggagugggucacaagugcugcacacacacuuggugucucugaaggagccucaccacauauuagagaugagguuccuccuugccucaggaccccaugccucauuggcauugcugcagggagaccccaggggcuuguggcagucagaggucagcagaagacacgcaggguugaucugugcucauggacucugaucucacaucaagagccagguuccuuuugaccgggaugauuugagaaauggugggagcagggcaguuaucaauucagaugaguagaugcugacuuagcucuguacagcucccuggcaccacccaugguacagggaggcagggauuaggagaaugcuggccucccuguaggucagugauguugcaucaguacugggauuaggcugggguguccaaucuuuuggcuucauguuggaaguauugucuugggccacacaauaaauaaauacacuaauacuacaauagcugguaaacuaauaaaaagaucugugcauaaaucucauguuuuaagaguuuacgaauuuguguugggcugcauucaaagccauccugggccacaugugaccuguggguugcggguuggacaagcuuggauuagaggacagaagaacuugcagcuuucagcuugguugguugcuuggguaagggugcacucuuguguucucucucucucuuucucucucucucucucugucugucucuuuucucucucucucucucucugucucucaucucucacucugaaagaaguccuguugggggagucccaaaagcuaaaccauuggccugggggagaaacgugugcuggauggaaaagaggacaaaggcauagacuuguugacuugcaucuccgagguccugugauguggccagguggccugcagcucaccugagagacacaggcaggauuuccucucgcuuuagaaauugagcagccugcuuggagcaggcuuguucucagauucauugacacuucugcccaucagggugaucugcaggaaugaaaagugguuagaauucuguugcaaagguuaauuuuaaaaggccagugaacacccacaagggggucaccagggcaaaaccacagcacacacccgccucuccguuuaacucacacuaguccaggugcucugccugcucuuaccugcuuuuccucuugguuggguaacaagcauucaguugacugcauauucuccucccucaguuucuucugacaucuucgugagaccugagagcaagcucugccuuggcgacaaccaguugucauuucuuaguggcagccuuuauuuuucaaaaaaugaagaaggauaggcagucucugcagagugauaguggggagcugccagaggggcagcaggguccugcguguauccuaccaacuguguuuccauucucuuuucucccaccacagaagaacaaguaagcguagagcugacagggaaaggucuccccaccagggcugucuguccugagaguuuagaaugugcugggagagcagagcauucuuuggggccuguuuggcgccaacaaggagcguuacguggucugugaccagcugcugcaccuccugcuuugcucuggaaggaggccuugaaggccaguuggaaguucugcucggcugccuugaauaaugaaccaucaauucuguuucccagcugugcuuccacacccucacucuuggaugggacugcuggguuccuugucugccacaagcagcaauugcuggaaguagcaggucagaaaugggaaaggaggccuggacugcauagccaggcaagccagugagguuggagcaaacccuugaacaggggcugggcccaccuuuguagucuugucaccaaggagguuacugaagccuccagaaggcacacugucugauccaacucacaugccagaggaacacugaauaguuuccuuccgaugcauuacauucauuaguuauagaaggaauaaagccauccuauaucuucucugaaaaaugaaggagugaaaagagcacaauguaauccuauuaugguugcaacucuucccaguuugguuuucugcagaucuauuuacaugcauacuuuauucuuucauaaucaugguguaauaucaucuguguacugcauuauuuuacuuaccauucuaucacaagcauuuuuccauguuacuccagcauuuucauugccaacuuucuuauuggcugcaugagagucuauccaguggguauaccauaacuugucaguacauuguaucauuuucauaaauuuagguugcucucaaguuguaucuguugcagauaacauuguagugagugucuucaugcauaugguuucuauauuuugcauuauuuccuaggacacauucccagaagucggauuacuggggcucgauacacauugucaaauugcuuuccaaaaggauuuuacugauuuuauugcacucucgccagaauucaauauugucuuuuaaaaaaauuguuaauguaauggcaaaauguuguuuuauuuuuacugaauuuucaugucuucagugauuugcaagauaaaacaguucccagccauuuucuuuccaaauguaguuucuguuuuuguaaacuauuuacauccuuugcucauuaaucuauugguuuuaguguuuuuucuugagaacugucuuaacauuguuauacuaugcucauaguaaccuauuucauauuuccaguuauuuuuucuguggugguguuugcccaucucauucgguuagguuuuuaaaaauuuguuuuuauuauuuuacauacaaauauuuaauuuauaucuuuccaucuuuuuuaaugauuucucuguaauagcacccucccucuauaaauuugauagaccauuuuagguuuuauuauuuuauauuaaacuuuuuguuugucuagaauuuaaugcuuuguauuaaaugcauguaaguugauuuuuuaaauugcaacuaguuauuacagcaccauuuauuaaauaauucuucauaguuuaaaagugguucuuccaguuaagguuuuaacauaauguuagggauaauuucugggcaauuuguugcuucaauaauaacauguuuggccaagcacaguggcucaugccuguaaucccaacacuuuggaaagccagagugggaagaucacuugagggcaggauuucgaaguuauggugagguauuaucaugucacugcacuccagccagggugaaaaagucagacccugucucuaaauaacaguaaucaucaucaucaccuuuuauucuuggguuaguaccacauuguuuuaauuaccauuucuuuaugguguguuuuagauauuuggcaucggccaggugcgguggcucacgcuuguaaucccagcacuuuaggaagcugagacagguggauugcuugagcccaaaaguucaaaacuagacugggcaauauagucagaccuugucucuacaaaaaaaaaauuuaaaaauuagcugggugagguggugugcccccuguaaucccagcuacucuggagggugaggcaggaggauugcuugagcccaggaggucgaggcugcagugagucgugaucgugccacugcacuccagccugggcgacagagugagaaccugucaacauaaauaauaaaucaauaucuggcagcccuucucuguuuuacuauucauuuucugauuuuucuucuguaguuuaaccuauuguucuaccaaauguaauuuaaaaucauucugugaaauccagcaaaaauagcuuuuuauuuuaauuuugauuagauuugcauuagagcucaguauuaaaacaugcacaccuuuuggugccagauuucauacucaacauacuuuguuccuuuugugcgaaggaaauuauguuuauuauggaaaacagugaaagaugagaaguaaauggcucauccuccauaaauggccaucgcugacuguuucauguagaacuuucuggccugugcccauaucuucucucuucaggcuuuggcaguggggcugauacuucacaggcuguuccaguaccacugcaccuucacucuggaggugggagugggacuccgugcugaggacccuagaugcacaucuguucccuuagcagggagccauguccagagagugaggcaugcagggaguggucauguggaaggugcggucagaccgccaaggucaugccaucuucugggcacugguagucccuauggagcugcugcuggccagugggaagauuuggaggauuugaggauacucuucagagugugcuuccacagucuaacccuccugcuugacgaccuguuaugugugagaugguggcuuugucacaggaaucaccugaaagaccucuaucugggcuccgugaaacuaccuaagcaggucagucuuucagugaacugaucugauaucauugggcuaucacgagccugaggcuggcuccccacuuucaaaucauccucaaaaggcagggcaaguguuuuccucugguuggugaugguguccuagcaugcccuuuuuccagcuggcuucccacugggcucagcccgaugcgucuacugcaaucccccuuuccuguguugcccucggauaacuccauguguaggccugaaucguguucauuuccaggaaaaguaaaugaugcauaucuuacuuuccaucuguggucauuuuuuuucugcuugagaaacaccugggucugcuuguuuuugaauucucuuuuuguuugucugaaaaagaaaucuauuuuauuucaaaaauucaauauugaaggauaauucagauuuagaauuugaggcuagcaguugauuucuuucagcacuucaaagauaauuauugcaccaucuuuuagcuuucauuguuucuguugaagguaacauaucuuuuucuccaguggagauauaaucucagugcuuuuucgucuuuguuuuuaaacuuuuuauuaucaaaacuuucauacauguacagaaguagaauaguaguuauacuauuacuauuauauuauguaguauauacuacagcucuguuuuaaccaucguucaccuuuaccacugucaaccauagcuaaguuucuuagauuuaucaucccagcuuugucuuucucaccauuauguugaagcaaaucuuaggcauuauaucaugucguucauaaauauuucaguugucauucaaaaauaucucuuaaaaauaagaauuuuuuaacaccucuauauuauuacuccuuagaaaauguuguuuuauacauaguuccuauaguuugcccaacuuaguaucuaaacaagguaaaaauauugccuuugguuguuauaucuaguaaguuuccgauaaucuuuagguugacaccccuacuuuuuuucuuuuuuuuuuucuuuuuguuuuuuuuugagagagagucuugcucugucgcccaggcuggagugcaguggcacaaucucggcucacugcaaguuccaccuccuggguucaugccguucuccugccucagccuccuggguucaugccguucuccugccucagccuccugaguggcugggacuacaagcaccugccaccaagcccagcuaauuuuuuguauuuuuaguagaggcugguuuucacuguguuagccaggauggucuugaucuccugaccucgugaucugccugccuuagccucccaaagugcugggauuacaggcaugagccacugcgccuggccuuuuuuuuuuuugaaguacaugaucucacucuguuguccaagcuggagugcagugaugugaucauagcucacugcagccucgaacucuugggcucaagcaauccuccugaauagcuaggacuauaggugugcaccaccaugcccagcuaauuuuuaguuuuuuuguauagcugcaaucucaccauguuggccaggcugcucuugaacuccuggcuucaagcgauccucccaccucagccucccaaaaugcuaggauuacaggaaugagccacugcaccaggcuccccauuuuuuuuccuuauaauuuauauugcaauguuuguucaaguucuguaggaaauuccacauucuggauuuugcagauugaauccacaugguguuauuuaacguguuccucugucugcuauacuuuuguaaacugauagaucuacagacucagugagauucagguuuuguuuguuuguauguuuguuguuguuuuuuagcaagaauaccugauaaguggugugguguucuucccauugcaucacaccagcaagcacaucauguuuuucugucucuuauaacgugaagauugauuaguggcaucaggugcugccagcauuuauccagauuccuucaauauacaguaguuuuucaccuaauuguuauggcagccaaugaugaucauugacuagacccauuauuccuuuggaguuaaaaaaauccuuacucuaauuauguuauucugucugcuuucauuagccagaauucuuucauaagauggaaacuuuuuucauaaaauagaugguacccugagaguguuuauuaaaggaaaggaaggauaaaugcuugucucuuucauuuuaauuaucuauuugcuaaauagugaauugguucccuggcauccuccaaggaugaccaguaaauuuuuuucuuuaauaccuucaugaauuuucaugugucuaaguccguuguaguuaugauucuuuuugcugaacaaauucuuccaucuuguuccacuaggagucuuuucagguggauuccuggguccuuaccacccugcuuaaguagucuuugauaauggcuuucuuuuugaugugacaaaauaucucagguugaucuuuuacauuuuccaucccaaaccuggaauaagccaagaauauauaguugcuuuuagugggaagugguauuuagaaaucauaaucuggacaacgagggugcucacugcaacugaguuacucauucuuuccaagccuuuuagugggcagagcuaggaaauacauuuucuuuuuuuuaauucucuuuucccugcaccaggauguaaaguaaggaaauacauuuuccauaggaaaaaaaaucaacaugaauucauacuauauuugcauuuccaauuuaggauuauggagauuuuaguuaccuucuuugauuuuauauguguaauuugucucuuacacugaaaauuugggucccuaaugacacaaacaugaugucuuguugcuuuguauguauauauaaaauauauaauaauuuguaauauacagcauaauauagaauacauaguauauacuauacuauguauauauuucacacacacacacacacacacacacacacacacauaaaauaguuucagaauaacaauaccaauuguuacuuuaaaaguuuguuuucuccuuaggauauauccugcagacauacacaaucaagucauguuucucaggcacuugagaugaauccuugcauguagcuaaacucaucaauuugauauuuaggauaauuuuauuuuguuuuugauuuuuagugauugcacuuuuuuauuuagaauaaugugucucagauauacuaagcaaguguuuucauaguauuuucacuucugccccuaccuuucccuacaggaaaccacuuuuauucauuuguuguuuauauauuguaacuuaacuuuuaauaucaguaaauacacaccacacaaacacgcacacacagaugcgugcaaacacauacuuguauucccaucccuuucuuauuaaaugggaacaucaauacugcuuuuuaaaucuaacuuuguauucuggagacuggcguguuguaguauauagagauauuucucaucacuuuuuaccacugugcagauuccauugcaugcauauucauauuuucuugcaccuguccucuaauaaugggcgugugaugguuuuucaucuuuuacuguuauagauggugcuucaucuauagccucaugcacacaacuuuacaugguuuugccagugugucuucaugauagauucuuugcaguggguugauguaauuggaaggcaaaugcauaugacaauuuugguaaauaauacucaauugaaugccauaagguuauugaauuguaacaucucaccagaaauaaacgagccugcuuauuucuccacaaccuuuccaaccuauuauguugccagacuuuuguaccuuugaaaauuuaucacaugagaaauggcaucugagugcaguuuuauagaucucaauguauguuuuuugguuuguuucuauacugcuuagaguuuauaauauuuuggaaaauucucagacaguaucuccguuaucauuacuucuaccucauucccuuucucuucuucuuuuggaacucaauuacagauuuguuagaccuuaggcccacaucacauacaugucuuaugcuuuuuuuuuuuuuacuuuauuuuucauucauuuucucucuguauuuuauucuagcuauauauuucugauauauuuuuuacuuuuguauuucuuucuucuguccuauaaucugcugguaaauucaugcauuuuuguucucuguuucuguuauggaguuuucauuugguuauuuuugcuaauuggaaacuaaaauuuccuauucagucuuuuggucccuuaaagacucuuggugguucuguuuccguggauguguuucuguugaguuuuuugggaagaagucagucuuguuuuaugaucacguccugguuucugguaugccuggauuuuccugaaaugaaugcuguagaucauauguaaaagauauacagacuuaauugaagguacgaugauguuaucuuacuccagauaguguuuauuuuuuuccauaauuuccuguguuuuuauguuguguauauuuguuuaauaccaugaaacuccuuuucugugauauucaaaaugaaggucgugguaguuuugaguggaaggcaguuuuguauuguguuuuuaaaacuuuauuuuccagcaauuaaagauguccacaguuaugagaaauaauacaaagagauccuguagcgccuucucucaguuuccucuagugguaauaucuggcauaacuguaauauaucacaaccaagaacuugugucacucuuuuauaggucaagccucuuuucuccuccucgcccuaccccguuucugacaaccacuaaugccuucuuuaucugcguaacuuuuucaccguaugaauguuacauaaaugggcucauacaguagguaaccuuuugagacuggcuucuuuuccacucagcauaauucccuugagguccauccagguuguuguauauagcaauaguuuguuccuuuuauuacugaguaguaucccauaauauggauauagcauaauuauuuucaaccauacaaggccauuuggguuguuucuaguuuuggguuauuuugcauaaagcugcuuugaacauuugugugcaguuuuuugugugugcacaaaaguuuuuauuucucugaguuaaaugcccaggagugcaguugcuagaucccaugguaauugcauguuuaguuuuguaaacgucugggaggcaggacuuuaagguugcuggggccucagggaugcauaggacagcuggggcuuugcauccucgacugcuucagcugaagacacagucuagagucuguguacucuggcuuagguugagauugggaagacaucccuuguucucacuuccagcccucucacuucagucaagacuuuugcuuacaaagggcagcacagaggcucaccgugcuuaagugucacguggauuuacuggacagaccauuugcacacaugugaggcaagugguaucgaauuuuaccugguagcaggugccagcuuccuuccugcaugcccuguccccuuuauccucaaagcaggcagagaauauggccacuuggcauucucagucucagcccccacaaccccacccccagacagagauguacacuagccccuucauuugaguuccagauguccuaaggcagaacucugaaugucccuuuggguccuaugucuaguucugucccugguggccagugccagagucuuacagcacagccccauguguugggagcgccagcuuugggguaauugucauagacaguagcgcccugucgggucaguuccgugugagaaccugagagggaaggagaguugcucacggucagacaggagcucucaucagcagcugagccugcauccccaggcguuugccuccuuccuuugguuuugcugauuucgcuuccuuguggggagacagagcucggccuuucugcucuccuguugcgcuggcuguguacuguuuauuauagccuacguagagagaauagagggacagacagcauuucuggugacagggcauauccagugaaaugcagacauaaaucaucuuuuaaacaaggguggguuugcgguaggaaggccugugugaggaaauaggcccucucugggcucccuccguccuucacagagugccuccugacccagggucgcaagccagguucugugccaggcaccacuccagagcagguaucuguggcuugacaaggaugcacagggcagccgauccuuggaaagucuguguguccaaagugccucugguuauauuucaaggaccugccugagcugagucacaguuagccucugacaauauuucuaauagaccacucuguuguuggacaguuuuuaccauuugcacuuccaguaugaccacuccaggucucugcauuaauuuuucuuuuuaaauccucuguuuuaauguuuucgggggagggggggcccacuucuaucugaaaaugcccauccagacacuguggguucugugccaaugccagggaaggaagcucaggguucugcccugggcccuaagaccuuagugacucaggcagcccugcuacugguugggagcgcucuccacuggccaccucugcugcaaagcucuuuucucuugcuucaugagaaguggaagagugugaaacaguacacggaggccuuucuggcuguuuacaagggagaugggccaccaguguuugucaccggagcuucaggguagcaugccuaggagaggagcaaacaggggccuuggggcuguggagucaugcugggaagaugaagaaaagacaguugguaacugacaaauugcaggugugaucauuacucucugugacucccuguuucucagaugcacuguugcuuacaucuuuguaugcuuuugcauuccugcugauugauucaaggugcaacgugccugcuugucagguaugcuguugaucacauuauuuaagaagaaauaaagucguucccgcagcuccaccugcagugaugggcuuuaauguuuugugcuucccgaggaaaaccugccgaugaugugaagugacauucaacccgccgagagcugauacuggcagacaaauuucauguccugucuccugaucaccaguuugcugccuccaaguuguuagggauauuaaaaacaggggugggaaguccccacuugacagguucaauuuguaaugugaaaggugcugagaaacaaagcaaggacccaggcagcuuucugccaaggcugcuggccccacacucagcaaggcaaagagaaaggggaucuaucugcuaguagcaugagugugggagaggagggggcuguuguagggugccguggaggacucauacaugauccugggaagagcgcugcugcuagcccagggccacaaagcgucaaggacguugagcuccugugcaugcuccuguagccuugugucaucugaagaagcacagaaguggcaggaauggccuuuucauagggcaugggaugcuguaacugaugugcaaucuguuaucucaaaggagaccuuagcacaagugggaaaggaaaaacugcccgaccauggagagaacacaagugggcugaguguagcugccucuccuuaccuguggcuggugccaugaaggagugcugcugucauuggacacuguggggccagcaccggguuuugugugucacuugcauucucccuugguacacagagcccagacugguuuccuggucccuucccagcgagcacugugauggcuuugccauugagguggauggagguccuugaccaaagcaugcuucccccugaccccaucccacccgcagguuggcagcucauccucuuccaccugcugugaaagggcugggucuggggacaugggaugagggcgacuugccugcccuaugaaccagaagaucaaccccucugaagccaggcagcagauucugcggcuagaucacccuuagauacagcacagggccuaacguguugguggcacccacuguguauuugugggaugcuugaggaaaucaaaaagaaaccaacacaaaagaaaagacucuucauuguaaaaagccugaugagaacagacaggauguggccucugccaaaaccaccauccacuuccccacccaacucucugccuccaguaugcccugagaacccgccuagucaucugaucugccuccaucaugcaggcguacugagcuccuucacuccucaggugaagccacccggagcacaccgcggauaugcagcuugagaaagccagugugugcucgcccacguuacccuccagggcaggugcaggugaccacuugucucagcccaccuggccccucaacucauuuuguguuacugacccucucucuuccauccucaugguacuugggguguccaguuuaaggccugucucagauauacuuauaaugcaauagaacagauuuuauuuaccaguugaacuuccuuuucucccagagaccauuauuugcacuaaaugugguuuuguuuugcuuuuuguugucguuuuuuguuuuguuuuguuuuguuuuuuguuuuuuguuuuagaugaauucucacucuuguugcccagccuggagugcaaugguaccaucuuggcucacugcaaccuccgccucccagguucaagcaauucuucugccucagccuccccacuagcugggauuacaggcacucgucaccacgccaggcugauuuuuguacuuuuaguagagaugggguuucaccaugaugaccaggcuggucuugaacuccugaccucaggugauccacccacccuggccucccaaagugcugagacuacaggcgugagccaccacacccagucaaauguaguguuucaugugaguuguccuauuuuuuuuuuuuuuuuaagauggagucuggcucuaucacccaggcuggagugcaacggcgugaucucggaucacugcaaccuccgccucccugguucaagugauuguccugccucagccucccaaguagcugggacuaaagaugcaugcccagcuaauuuuuguauuuuuuaguagagacgaguuuucgccacauuggccaggcugguuucgaacuccugaccucaguugauccgcccgccucagucucccaaagugucaggauuacaggcgugagccaccacaccuggccaaguuguccuauucuuaaauaaggauagcacauauagaauuauuauggggauucagguguaaccccagggcuuugggaggccuaggugggaggaucacuugaugccaggaauuuaaguuuucagccugggcaacaaagugaaaccccuucugugaguccauuuuguguugcucuagaggaauaccugaggcuggguaacuugauaaacaagagguuuauuuggcccauaguucugcaggcuguacaagcgugguaccagcaucugcucagcucucagaggccuuaggaaacuuuuacuccuggcagaaggcagaaggagagcagguaugacacauggcacgagcaggagcaagagagggagaggaggaggugccagcuuccuuugaacaaccagcuuucgugugaacuaucaaaccagaccucacucauugccacagggaaggcaccaaguuauucauaagguauccacucccaugacccaaacaccucccacuaugccccaucuccagcauugggggucacauuucaacaugagauuuggaggggacaaaacguccaaaccauaucgcccccucccuacaaaaaaaauuuagaaauaccuaggugugguugugugcaccuguacucuuagcuacuugaggggcugaggcgagaagauuguuugagcccaggaauuugagguuacagugagcugugauuauaccacugcaguccagugagacacugcccaccccaccccgauaaaaaaaaaaaaagaacugugauugggaggguuuggggccaagguugcuuaaacaaacacagcccacagcucugugccaauugagguuugggauuccugccucaccccuagauaaccaauaaaguagcuaugauacauuaaguuccuuuuguucuuaagagaaggugauggguguaacuagaguguugacaacaugaaaaaccuaaaaucagguuggagauaaauauuuaaaucuccucuauuggauacugauaaugaugcucuuaaguaaaaauaaauauagcaggggccuauuaggggagacaggcucuggcuuucuuacagcaugcuguugcugugugguuugggucacguuucuuaaccucucugggauuuccuuuccucuggucugaaaugagcaguuguuguacuugccguauaauuucugaggccucuucuuacucagaacuucugacuguuuuuaaaagauggagcauuaccucucuauaccugacugugccgcaugccauucgauuuuguuaucgaagcaggucagcccguuguuuuucacauagauucuuacaaugcaacaaagcaucacaguuacucacaagggaaggcaggggaggagggggaauguggugucagaagccagacccauccucacguaguggagcugcaccugcccaucucccagaaaguccuucaagccccuuucagcgccuccaccugcaggccuguucuuugcaagccuggcuguggucuguuuugcauaaaagaagauuauccagcagugggguuugcucuucucuuuuuacauggcugccauagcaagccaacaagaaaccugccguguggagugacggucaggaaccuugcaagaugccgucgaggcucugucuacaccaggcaaagaaucuuccagauuccugcucucuaacucagaugaaaguaguugcugcagaguguguuugcuucucugucugccucagggcugagcuucuaaacauaccuggucuaguggguugcacagcugauuccaggacaaugggaugagggaaggggaagauagaggcuggcagagguggcuuuuuguggcaugcaugggaaagcgguagggggugcucuucacaguugugggggaggcuuagccugaaucucagggcacagcugaagaaggagagcagccuggaaaugcguccuaaagagccgcucagccacggcagcugugagcuguggcccaucaguggcuggaggugggaccauuugagcuuuucacugagauagagccugugucaaguguucugaacaacuugcuguggccucaugugagcuuggcuguggaaucagggaggccagcacagagcguggggcagcuauucccaguucaucagcaucagccacggugugcagaggaggggugggagugagggauggucgagagggagaaccuguugauuugcccgcaagcuaguuguggaagacaagcacaggccaagaaauguggguggacaccauuaauggagauggaaggagguguuggaauggaggaacacggucauugacuuuuugcacaugcuuagucugagaugccuccagggcaguaggauaagcuaaccugugggaauguggagggacgaauccauagcucagaagcaagcgguaucugcaggaauggauuauacuggcuggaucauagggggucagugagucaugagaaugagcccuaauuguagagaguaggaugugugaugagagaaguggggacgcaucgucauggggaccaucuugauggagggagggagaaaagagaggagagauaggcagugagcacagaaggaggagaggagaaccaggcaggagcuaugccagugacaccaaggaagggugcguuugcugugauguguuuucaucacguuuucauaauuaaccaacagauuaauauuccucagaaauacaaagcaccucucaaucaugcuauaccuucuucccaacuuuacaguaauacauuucuuaacuuucuaguuauguuuuagcaccuuagaauauugaaaacauaaaccaaacccucauggcacgagcaugggaagcccuugugaugaaaaucagcucaaugagaggggaaaugcgggaagcauuuuuagcagaaagugaugacagcuuggagcaucccaaagcuaugcauuauucagacgugucggagcgagagugcccgauuucaccacccauuaccuauugggaugccuucuucucugcuugcuaaucugaauauuacucauuucaagguuuuguuuauauuaucuugaggggaaacaaacaguaccuaauuaaucccaccaaacauaauauuggaaaagcaauuauucccaccacguguaauaaaccaucuguagggaaaauaauccauuaagugugaaucagugugaauuuuaaaacuauuauuaagaucagauugguuccucguuaugagcaccauaauuuuaguauuuguucaugcauacuguguuaugccauguucuguaaccuuaaauccuuaauguccaaacaaauaauaucuauaugcuaauuagugucaaaaaucacaggucagccaaucagguguuucacagaugagccccuuuuuuggggguuagcucgaaucugugauuaauuagaaagugaguccccuauuuugaaauucuagugauaauuguagcagagggcugaauuuauuugcauuuucaguaaaucauccauuaacugaaaugaaaucuuuuuguuaaauuacugcuccugguucaguuaggagggaguuuucccuucauuuuuaaauguacuggaguauccuucaguucuccuugagugagaagcaaucgcuuugaccauugucaaccagaaagaauuuccccacagcauuucucucuuucccagcugggccauaaauugucucgugacugagguugcugucugcuccugagcaagcuggaagcaaugaugagcucagagcugggcuuuauuaaauccuaggaagacacauaaaaauuguuagcaguugauuucgcaggaaacaccuagcaaacuugucgggguuuauauuacaaagcccagggccugcaguuagcagaucaucuuuuuugaaaagcauuuggguaccuuugucagagcuuuucugcauuuugacguaggaggauaccugagggccaugguugugagaaaggagagaacccacccagguguccuggggauuguuuuauucauaaaguaauucggaugaucucgaggugguccagggagaugggauagagucagccaaggugucuauuguaagauagauugugaaccccucaaagauaggcugaaguccuuauuccugucaccugugauuguaaccuuauuuggaaauagggucuuugcagauauaaucagguugaggugggugcauguuggagaaggaugggcucuuuauuuuuuguuugagaccaugucuugcucugucacucaggcuggaguacaauagcaugaucucagcucgcugcaaccuccaccucccagguucaagugauucucgugccucagccucccgaguagcugggauuacaggcaugcgccaccacaccuggcuaauuuuuuugcauguauuuugguagauacaggguuucaccauguuggccaggcugguauugaacuccugaccucagaugauccaccugccucggcccuccaaagugcugggauuacaggcgugagccgccgcgcccggccaagaagggugggcucuuaauccaauggcuggucucuuauaaagaagagaagacacagacacacaggaaaaaugcugugugaccguggagguggaucagagugaaacaucugcaagucaaggagauugccagcaacaccagaaacuaagaggaaggcaugggacagagucuuccagacgggcuucagagggagcaucgccuugccagcaccuggauuugggacuucuggccucuugaacugcaagaauaacuuuauauugcuuuaagccccccagcuuguggucacuugucaugccagccccaggaaacugacaugucaucucuccgugugacugguuaagucuugaugugaucuccuagaccuacguacuuuggagcuagccaggguaugaucagcgagaggcuuaggacuugguuaguucaaccaagcuguuggagcccauucuugccucaaccuagugaaaucaaaccuugcauccuuuucucuugccuuucugaagauguggauuugaaaaaaagaaaaguauuccugcaaaguuccuuaucucaggcuccauggcauuucucagagcauccggccauugagaacugacuccguuucuccaaauucagccuucccaugugaguucuguccugagaugugauuggggauuggaagccaagcagacccagcaaagggaaggugaccaguggacuccaccugcucagcaaacacugaccuggcuuuuccuuucugggaaguuccgcaggccagcuggcauccuccccgauggcauuuccuggaguccucaccugaacucuugggaauugccgccuagagaccaccaugcaaagcaggauguugaagacagauuagaaggcuucuuucgcgcugccucuccugugcggcuucucuccguugucugucuccucucuugugcuuucuggaucucuucuaaagcuucuugggaaaagccaaacaggaaaugagccaccaagagacugggcuuagacaaugauggccaaguagaaaagauucuauguucuagcauuggggacugcagaggagacagcugccccuuuccaggaccugucgaaggacaaagucuaagguccguggggaucacccuucaggaagauggcaucaggccacaaaaauagaaaagagauaucgcccucccuuuuauagcacaaauguuaccagucaugcuaguaucaaaaauuauauuccaguuuacuuucugcuucccuuucaggccugagaugccugguugauccaucuucgaauacuuucagggagcuaguuuuucuugggccuuuuucccucuuaggggccaccacagaauggccuccccagccguuuucucucccuaauucuggagccuggccugccuguccucccgagagccccaccugacuuucuuugcuuugcuuugccucuguggcucagcuuguuucauccguuccuccuugccauuuugaaggcagugccagcacuggagaacccuaucagugcuugcaaccccaccacgaggccggcagccgggagggcugggcgcauccgcucacuguaaucuccagaacagauaccagcuuuuccuaacccccuagccuguucuaacccuugaacugcuugagagaugucaaaaucauaacucucuggggaagaggagucaguguuucuguccuagcagcacgcaucagugcaaucagagcucuguaaaagccaggauccaccaaggggaggauuugugaagcuuuuuccaguuacagugagaacugggcaggcaucgagucucaguuucagugccgcuugaauacagggugucagugucacuugagugcuaggcggaagugcagguuaggccuggaucggaggguuaaugauuagguuucucccgggcugcuuuucacaucagugcugugcaauaagcacuuuuacaagucaggcugcuuccuuuguuugagcugcuaacccuguguauugagccuagcuaaauaacuccgauauuaggauaauauacaaaugaauguguaaaacacacuucagugaguacugugcuaaccgcuucuuuugguggagggaggaaagaaggguguuuacaaaacggcuucgcuuugcuauugucaugaggagaacaggaauuucuccaggcuguguggucaccggugaauauaugcaucuagguuuuaguauuuauuuggaaaucaaauguauuaugggcaaggguauguaaugaaccagccauuuaaagaucccuggacauaaaaugcaagcuuuuggcugcgcgcuguggcucaugccuguaaucccagcacuuugagaggccgaggagggcagaucacuugaggucaggaguucgagaccagccuagccaauauggcaaaaccccaccucuacuaaaaguagaaaaauuagcugggcaugguggcgggugccuguagucccagcuacucgggaggcugaggcaggagaaucacuugaacccaggagguggagguugcagugagcugagaucgcaccacugcacuccagccugggugagagaacgagacuccaucucaaaaaaaaaaaaaaagaaaaaaaaaugcaagcuuucgacaaagccugccugccugcuuugugugugccuucccuuuuucuugcaguggcccuguggguuugcauggcccucuguggccagccucaggaucuaggguccucucugcuuguaguauaagcuuugaaugcuguggcccggagcuuuuccacagccuguguuuccugcuucuggucugcucuagagaaauucaagucagguuuggccuggcuuggccaacccgagcuugccauguaccugagucccaagggugucuguccccuaacucuagccaccuguuggggagguaggaaggucugggagggagaugcugaggagagcagagucgugugcagaccaggugggacuggacuacaggagagaccaggugggacuagacuacaggagagcccuggggggccacuccuggggccaggagcugcucccugagggaauucugaagcugguuugugauucugugucacagccaccugcaucccagugaaagcuaugguugcuuuccauagguaaaggcaauuugaggacagcaaacauauuuucccccacacaauccgucauugucuggugaugggcugucaguccaaaccguagccuagaaaucguagcucaggaaguagagugcugagaggaacaauucaaacaauuuuguuuccuaaauguauucuucaguugaagucuuugugguuaauguugauaguuuguaggcacaaucacuauucuaugcauagggacagcuuuuccuaacucuggaaaagaggggguguguguguguguguguguguguguguguguguguguguguguguauugucaaaaaccaauggaagagaaacacuucaaaaugggugagaacagagaacagcaugaaauauggacagcagacagcccuguaugcaaugaaaaugcaggugcauggucacuagaaaagaugccucauucuuugaauuuuuggcucuuugaaacaccugugugacauuaaauuuuuuacugaaaugugguauuauuaagucuugcguuuaaguuuauaaucagaaacaaaaacaccauguccuguuaaggaaagaguuauucugacaacgguuagcaggauaaagaagauuuuacucaggaguauugcaauaggugucaagauuccacagaagaggagagagaucagucucaacucgaaauacaguacaaaacuugggauuuauagccaacaaccuggguggggcaggugacagucaguggauggaaaauuacuaagaggacaccucaaggauaggaggugucuugcuaaaugaaccuaauaggauucuuccugaaaacaggccaaugacuuagacagcaaagguggaggaugaguaauuugaucucaugucaaggguguggauucacuccaaacucucuuagcaggauagagccaaagucaaugccuaguugagaagagagcucagaggagccuggcuaacauuuagucaaaaagagucucugucagugcucgauuuaguuuuauuacucaacacugauacuuucugagcuaggcacuggguuaaacacuuaaaaaaaagaaaaaaaaagguuggccaggcauggguggcucacaccuguaaucccaacacuuugggaggcccacaccuguaaucccaacacuuugggaggccacaguaagagcaucauuugagcucuggagugcaaggccagcuugggcagcauagugagacccuaucucuacaaaaaauuuuuaaaaauuagccggaucauggugugugcccguagucccagcuacuuggaaggcugaggugggaggauagcuugagcuugagagguugaggcugcagugagcugugaucccaccacuguacuccagccugggcaacagagugagauccugucucagaaagaaauaguuuaguggcaggugagagagcaucauguaaucgcgauguguaaaaacgugcaagaauggaauugugcagaaaacccagugcgggcuuaucaacccgaagaauucccucugggccccagggaacauucagcaaagaagcuaccuuggggauuguucuuagauuuuaacaauuugcugggaugagaguauuugagaguggaaagagcacugggcugagggaacagcacgugccaagcgauggggaacacaagagccggguucuguggcugcucagggggcagagcuccagccaggccuacaaggcacacaggaugggggugggggccggagcugaggcugcggagcagucggggaaccucuuccaucauugacaagugagcccaaaccaugccauuccaggaguguuacccuagccgcuuguuaugaagcccucuguuacuugggaugaucugaguggccuuccacgcacuucagaaaauaaauuccuuuuuuauggugagcgaaauucuaauauauauuuguauuuucacuaaccuuaccaaagagaaaaaugucagcccuuuuccugaaguuucuuuuguccacuugugacuuucaauuaaauuuuaaaaccuccagaguaggaggaaucccccacagagacaauaaguuagcugauuaauugaaaacguggaagcuauuuuuaugauuaccacauaccuuguauuuuauuuuuacugaaaacacauaagugaggucagguguguuggcucaugccuguaaucuuagcauuuugggaggugaggugagaggcuugcuugagcccagguguuugagaccagccugggcaacauagggagaccucaucucuacaaaaaauaaaauuagcuuggugugguggugcaugccuguggucccagcuacucaggaggcugaagugggagagucacuugagcccaagaguucaagauugcagagagccaugaucauaccacugcacuccaaccugggugacagagugagacuuugucugaaaaaaaacaaaacaacaacaacaaaaaaacucacauaaguguaccuuaggcuuuuuuuguuuuuuguuuguuuguuuugcuuaccuuuuauguaaguccaaugcuucuuuuugaacgugguuccacugaugagcuucuauaaugccucaucaacaguucugccuacaauuuuuuaaaguggaguuagucacauuuuucagguuuuccaguugucucaccccagucuaauuuugcauauuuuuuuuagcucuuuaccuuuauuauagccuuuguaaagcauuccauuuaguuuuccaaaacugguucuuuuucauggcacuaauaauucauuuucucaugucacauuuauuugaauuacguaauuauaguagcaaggagaauugguauuaaguaaguuuuaggugaaacccaucgacuuugggauugugcacucugaugagucgggcagaagaguccagguguucuaggggagccugucacuggucaguggucaguguaucccgaggcauugcaaauccucgcuuaucugaaggacuugcuucccuggaaaucuugucugaggauuuuuguguuccucgagugcccaacacacauugcuggaccuuaaggggacacuuggauauacaugaucugguccagccauaagggcacacagugugggagacaaggggccauucugggaacaguaaagaaaugagaugugcccucagggagcucagacaaggagcugcuggagaccagcagggaggaacagugacuguacucaagccucaacacagauccucaggaacaucguguuggguucauuggacucuguauacagucagaaaagaauccagaggaagcacagcuaagagaauugagacagcaauuugcuguggcaucuccgcacagagguagaaguuuauugauuuguuuccucugauuucagaaguaguuuuucguuuuguuuuuucaguuucuguucaugucauagaccagcgaccccugcuccuccaugccccuuagucugcuggguugaccagauggcuggcacccagcacuguggcaucuaugcauuuaaauauuauuauuagaggcugaggguuuuauaugguuagcucaaguacguuuuaugcauuuuuuuuccugguuuuuuuuuuuuuuuuuugagacggagucucgcucugucacccaagcugcagugcaguggugcgaucucagcuuacugcaaccuccgccucccagguucaagcaauucuuuugccucagccucucaaguagcugggauuacgggugcccaacaccaugcccagcuauuuuuuguauuuuuaguagagaugggguuucaccauguuugucaggcuggucucaaacuccugacuucaggugauccgccugccuuggccuuccagagugcugggauuacaggugugagccaccgugaccggcccauuuuaugcauauuugauuuggaguuggugaaucaacucgaaaaccucaaaagggggcugugagaacacugggcuuuuuagggauagguuuccacguucaccgauuucaucugaauggacuguugaugcuuggugcuguggccaugcccuuggcuccugcauuuaggagcagugaauguggcguccaucugcagacguggcucagcaucauacguuacaagcacagcuuuugguacaggagcucucgggucgcugggagauugaggauuaugagaacuuccuucuuucacacagggguuuauccccuauucagcauuacaucagcuuucucugacuuuggcaugguguuaggaauuuaucagggaaauacguucuguuuauacugacuacauuacgggaagcuuggauaacuguaugggggacuuuaaaauuuaucucucugugauaguuuuucagcuauuaugaaacuaaaccaaacgaaggcagugggggccauuauaaaggaaguuugagaaucugaaagucuugauuucuuaaaaggaauuuuaccauaaucucucucucgauaagaauuaagaaaaauacuuacauguauuaugugcaaaguguacccguuaaauucaccauaauugaaagaugcaauacucugucaauaguuugggaauuguuuuaggauuaaaagugagauccauuuguaagaaaauguuuucauuuuaguaauguuaauuugauaacuucauuauauuacuucucaauauauuacuuugagagcagguaaaaagaguuuuccagagccuacuggaacuaugcuaaucagauuuaugguaccucuuauuuuccuggccuuucauuuuguuuuuguauuuaagucuucuguguugacagcugucauuugaugugagacaggugaagcuccuuccugcuuuggcccacaguugggcagcauuguccccggccugggcuggccucaucaagugaaacaucaugcugccauguuucgacauuuuaccuuuucagguucugcacuuuuucugugggaccauccccucuuccccgccugcccucuucucucugggguguuuuagauuuuaacccagccucuaacacuggacacacaaguccucaguggaguucugucguucaguccgcugucuuggcaaacagugcccaaucaagaaacaaacgugcucugcuggcugcaggcugccucauuucuccccgauccgaggaggugucacauagucaugauccuucccgggccuggccuggggcagaacaggauggcaaacaccucugcaaccucuggguuuccaguccugcccugggugggccuggcuucgccucaugaaaccccgaguacuguuugacucccugccauagcugagugccugccccaaccccacucugaguucagcgcacauccuggugugaacgccaccaucucagggacauccugcugcaaagcuccucucugucuccuuggucucuugccaccuacagucuuucucaugggagccccaccccucagaaggcuccccgucucuccuguccgugaguuuuccuggaauugucacaaugcagagaaugaguucuguggggaggguggggaauguagcccuguggcugucccagcaaguggccccugugggcugguggcuggcuccauuugagacugccuugaaccauggggucuccuggggaggggcuggagcugucaggcuucuuucugcuggaugacguugcuguuucuggcagcaccauuggcugcaucucagacugugucccuuccuucaauucuguugaugucucaguuuguggaaauucggaaaccacaugccuuucucucuaggggugacagcauuguuggccuccauccuccugucaguccuuacgagugucuucaugccagguggugccgucauggcauguguugggcagcuaaccagucccuucaguguggggccuggccuccuccuugccaccucguugguggaggugaccugggaugcuggacccacucuuguuuggacucaguguaggauucucuaccucuuucucccaguuacacagccuugaccaagcuucuuuauuccucugaucuuuuuuguuuguuuguuuuuacuuuaaguuccuggauacaaguucagaaggugcagguuuguuacauagguauacauuugccauggagguuugcuguaccuaucaacccaucaucuagguuuuaagccccacaugcauuagcuauuuguccuaaugcucucccuccccuugcugccaacccccugacaggcccugguacgcguuguucuccucccugugcccauguguucucauuguucaacucccacuuaugagugagaacauggaguguuugguuuuuuguuccuguaugaguuugcugaggaugauggcuuccagcuucauccaugucccugcaaaggacaugaacucauucuuuuuuuauggcuacauaguauuccgugguguauaugugccacauuuucuuuauucagucuaucauugaugggcuuuuggguugguuccaugucuuugcuauuguaaauagugucgcaauaaacauacgugugcaugugucuuugcaguagaaucauuuauauuccuuuagguauauacccaguaaugggauggcugggucaaaugguauuucugguucuagauccuugaggaaucaccacagugucuuccaugaugguugaacaaauuuauauucccaccaacaguguaaaagucuuccuauuucuccacagccucgccaguaucuguuguuucuugacuuuuuaauaaucgcccuucugacuggcgugagaugcugucucguugugguuuugauuugcauuucucuaaugaucagugauguugagcuuuuuuuuuucacauuuguuggcaccaugaaugccuucuuuugagaaaugucuguucauauccuuugcccacuuuuugaugggguuguucauuuuuuucuuguaaauuugcuuaacuuccuugcagauucuggauaucagaccuuugucagauggguagauugcaaaaauuuucucccauucuguagguugccuguucacucugaugauaguuucuuuugcugugcagaagcucuuuaguuuaauuaaaucccgguugucaauuuuuugcuuuuguugcaguugcuuuuggcauuuugaucaugaagucuuugcccaugccuguguccugagugguauagccuagguuuucuucuaggguuuuuaucauuuuggguuuuacauguaagucuuuaauccaucuugaguuaauuuuuguauaagguguaaggaagggauccaguuuccguuuucugcauauggcuagccaguucucucagcaccauuuauuaaauagggaaugcuuuccccauugcuuggcuuguugaagaucccucugaucauuuuuaaggcugguugagaccagcccuguggaggacuuccuuaauuuucaguggcaauguuuuuaaucagugagaugacucacaacacuaaacaauuccccauauaucuuguguguuagguuaagggaauaccauguucuuuuuuuuuuuuuuugagacacagucucacucuacuacccaggcuggagugcaguggcacgaccucagcucacugcagccuccaccucccagguucaagcaauucuugugccucagccucccaaguagcugggacuacaagcacgugccaccacacccagcaauuuuuguacuuuuaguagagacaggguuucaccauguuagccaggcuggucucgaacucccaaccucaagugauccgccugccuuagccucccaaaguguugggauuauaagcgugagccacugcgcccggccugcuuuacacuuuuuacauagauccuggugagaaucggaccugggauuuuucuaugaaugagagccuguuguaugccauacccccaccccacccccuuacccccaccccuacagccuuccuaauauaaggaagaaaugaagcagccgagccaucauuaagcagaucaccucugaaaaugaaggaaauuggaugaaagcucugccccggcagcugagugcuaaauuagggagaaucacgggaggccaagggcauggccgggcuuugucgcugccuuauuauggauuugauaagaaacaacuuuuuugacuguuuacauuauggaaaugugauaacccguuuguauuacuuaaacugugcauuuuguaaguguugucaaagggagggaguaauuuguaacagaagcagaguauguagaaacuguucucguaaaagcguucucuaaauugcuuugcuugcagcuguggagguugccauaaagaaugauuucucauauuggauuuucaaagccgcaggaguggccacagagcaggcaacggacagcccaaugauuuaagauuauuuaaugccccaguugucgugaaauagaaggaaauaaacuccagugggcugcuagaacacauuacuacaaucucuuaaugccccaaacuaggagacugauuuaucuccuguuaugucuuauuaagugacauucagaagaagaaaagaaaaaaaaggacagccaaagcugauggcugaaaauuacccugaaaugagugugaugcaggcaggcuuguaucguucuuaaguucaagaacccaaacuugaacucaacacuuuuucaguguguuuuauuuguuaguacagagauauuugaagaugacagauugggcauaagaauaggccaaaaggcugucugccccagugcuucccagacuucauugagcacacgaaucgccuggggcucuuuuaaaauguagauuccaauccagaaggucugggaaggagccugcaacugcauuucuaccaagcuccuccaugcuuccaaggcagcuguuccuggggccaugcuuugaaggagcaaaguucucauucauccugcagaaggaaccugcagaaauucucauucauccuauagaaggaaccugcagaaauucucauucauccuguagaagggaccugcagaaauucuuacucauccugcagaaggaacauccuccaggcagaaccaaaaacagcucauugucuuccuuuaugcaguacacuuagggcaucccuauuccaaacauccgaaauccaaacuguuccagugagcauuuccugugaauguuaugucagugcucaaaaaguuucagguuuuggaguauuuuggaauuuuggauguucagauuagggauguucagccuauaagcauuccaaaauccccgcaaaagaaugaaaucugaaacacuucugguuuuaagcauuucagaucagggauacucagccuguuguucuuuauuucacagucguccuuucguccuuuacauaacuguugucccugucucugcacagcugauugugagugaucggauuugaacucccuacacccucuaucuaacccauuccccucuugccucauccucagugaggacaaagaagguugcucugggcugcuuaaauugacuccuacaugcucaguauauauccugcauguaccuguuuuuuauuuuuuuuauuuuuauuuuuuuugagauggagucucacucugucacccaggcuggagugcaguggggcgaucucaucucauugcaaccuccgucuccugaguucaagugauucuccugccucagccuccugaguagcugggauuacaggcccacgcuaccacaccuggccaauuuuuguauuuuuaguggagacgggguuucaccauguuggccaggcugacaacauauauucucgugguucaaaugguggcuuuuguuuucauggcauucugucaugaacccagagcucuugaugccuaagagcugccuaaggcagacccauuacugccuaagaagaagagaauuggggcuauuaaacuugcagguuugcagguaucccagccagcacucuugagaggcaguguccauagaaauagcggugaugaucaccaggcucuccaguacggauuccuaggacggggcagcagagccaugcacuccccagugcacuggcugguacuggggcccucaaugccccucugggggcugcaaacacaagagaucugggcucccaggcccuaugcacuucugcagggcacaggcugcuucuugcauucuuaaguccccauggauaggaaagcccaaugaauugggauggucuccagugagggcuucacacuuccuuuauaacaugcagcauuuuagguuggugacuggugugcacugggccaaggguccacucugucucuguccuuacccccgggcuugaggacuagccccugccaaaugucuuacgggcucaucccagugggcuuguugagugggcugcugaguuugcaaugccugucccuccucuauuuaccaaaagcaauguuuucucucuucacuugcuaggguuucccauucucccugugccuccacccccauccuccuggcagccagauggucuucccccucacagccaucacucccucccuccuucccuccuucucucccucccuuccacugaacaacucaccugcuggucucuggaccuccugccacauaaaccauuuuccacacugagaccacuucucucuccugcuggaaaccuuucaaggauugccauuuaggagagauguuaaguccacuccccuagccuggccauugaggccuuggcucccuggccccucccaguccugggcugcaaacaaacugaagcucugggcucccuugacccucagccauugcccgugccauccucucugcuagacaucaugacucagccagaccucagcugugugacccacuccaaacaccagcuacucuaugaagucuucccaccuggaugcaagcaccagacccucgucuuccucuauuuccaugaggcaccaugggcaccccucaccuccccucagagugccacccauaugcgaugcaaucacucucaauagcccugacacacacaagcagggacaauguccuaagcaucuuuacaucccaggacaagcucacgaguaggcaugcaaugacggaauggaagaguggguaaauggacaauagauaucacugcuugguaccuuccacuacaagcacuggacuuuuagggaacagcauuuaagccauagcgagaaaauagcuaaugggauuucugaaauccacaaugaaaugucaaguaaaauguuuccuccuugggucaaucaaugagcugauuucuuauucucugauauuguugugggcuugcuuuagaccuaaccguacccuucagggggcuuacugcaggugcacauuuucagaaggauggaguccugagagaaggcccucguuccugguccucacccauccuccaccccucucgacccgcagcagacacccccaggucuccucuuuuccccccgccucccugguuucccuuuggaggugcuuucaggauaugcugccuaaugcugguuccuguuagacagguucgccugagggcugagggauuucaucuagaacuacagccccucgaggggacuccaagaacucuuggcucuuuggcucccaucuggcucccagcuugcucguauuuguuugauccgggccuguguguguuacauuuuuauaggaucucccuccgaugugcacaucgauuuguucuguucagaugcuuuguguggaacguauuuuauguggugguuuuuggaguguugcacccucuagagaaaaugaccuuucaugcccgugaauaaugaggcuggaaauauuucucuuaacucagaagcaucugcacgcacuuguuuucacacuugaguugaugagccugcucauggcaugacuuuccuccaaagaccuggggauccgaauaaugccuauuuuuagugccuccugaaaacaggaaagggcagaccauggaaauguuuccuuugugggaguauuuagcuucaaguuuagcacugggcaggaguguguguguguuuauaaguaugauuugauagaucauuuuucucaacuacacacugaagaaggggaaaaugaaucauaaaggacuaccuggagaccaguaguggcuccagcaguggguucugggcaagcuguggcugcgcagugccugccggccuccagaugagcaucccauucaugcuggggagaagccgggacagcuugagcaacuuccaguguaaaugggcuucauucacugugaguuauuuugaaugcccucuuggcccuguagggaguugcagacgguaauguaugcauguacauagaggcaaaaccucauagauccuguuuuguuuuuguugaaacacuagguuuuuguugaaaauuagaggucacaaugugacaaaaucccucuguucuuaaaguaagaagagccacccaaucccagaagcauauucaugggaagccaguuuucauagucuucccagacuucuucagaaaguagcuguuggaaagaacccugucugucagugucuggaagcucauugccaugugugugcugaccucgcacccuccuaggggaggcagggggcugagaccaucugaagccaccagcauuguaacacacaguagcagugguguguucagaaagcacuuggacuccaagaucaagguuucugccacucacaugggcagacagauaucuagaaacaaccaugacuguaauaacagcagcuggucaccacggagcaggggagugccugcaggggaaggagcagccccugggaaaagcaaauccgcuccuccuggcccagggccugaaaccugggaggcuccucgucauagggugggcuaagccagcucuuucuuccuaaugucagugagguuaugcacuuggcauggcggagagcugcccccuccuccgugagaguggguuagaagaugguggugguguuaacaaggaaaaauaacaccuaauguacacagagcuauauccacgggaaccuguucuguggacuauuaaaaauccaaaauucauguugagguccuaccucucaguaccuuagaaugugacuguauuugcagauaggacccuuaaaaagguaauuaagguuaaagaagaucauuaagauauggccucaucccaucugacuggugucuuuauagcaagaagagacuaggacacagacacacacagaggagaggccauuugaggacacggggggaagaugacccucuaccagccaaggagagaggccucagaaugaaaccaacacaucucacaccuugaucuugaacuucagccuccagaacugugugaaaagaaguuucuguuguuuaagccccacuaccuguggccuuuuguuagggcagccccaacgaacuaauacggaguccuauuaccaaucuuuguuaugagagcugccccugaagucacaucaguugcauuuccggauuccaaauaccuuuuccacauagcuggguuggggucucucucugucgcccaggcugcaguggcgcaaucucggcucacugcaaccuccgcccuccuggguugaagugauucuccugccucagccuaccgaguagcugggauuacaggugccugcccccaugccgggccaauuuuuauauuuuuaguagagacgggguuucaccauguugcccaggcuggucucaaacuccugaccucaagugauccacccaccucagccucccaaaguacugggauuacaggugugagccacugcaccccgcuggggacaggcuuuugaauccuuacucuuuaaaaagaaaaaaaaaagguguauauuuaaggccuacaaugggauguguugauacacguagugaagugauggcuaccuuccaguaaauucacguauccaucaucucacauaguuaccuuucaguuuuuauuuuuuguggucagagcaccuaaaauuuacucacguagcaaauuuccagcauaugauacaauauuauuaacucuggucccgugcuguaccuaagagcucuugacuuguucauggacagacugcaacuuucuaccguuuaacuuauaucugcccauuuuccccacucaccccgccuuuauuuagaaugugggggaaacagagacugaugcacuguaucuaugugacgauaaaacuccaucauauuaguuagaagggaggagaguaacguugcuuuuuuauuucuggaaaucagaaaucauauugagacaaaguuagaaaaagccaucuguguuuuguuuggccuuguauuggauucauucugaaucgacuacuaaaaacaaaaggcuuugcuucauuucuucuuuccuuuuuauauuugaaagcacuguuuggguugugauuuuugugaugccuuuauuuuauuuucugggacugugggugauuuuggcaaagauguaugacccuuaacucaaaagggcgcgguuuacaggcuaacugaggguggguuuaugagcagcauuauucugcaggaacacagaacuguacagacaaggcggaccacagaguggggccugaagcagcaaccugucagccuccccuugcugcaaacaccugcucugccccacuggaucccagguacacucguggccaugugugugggugggcuugaacauugccacucccccuccaagaacaaacacccccucuccaacacuaagaaaaauaucagcauggaacauaaacguuccccucagauaaucaaauaauucaccccaaacuguccacugugccgucacuggcuaaagcgagcugacuuuucuguauacacgccauaucauuuuccuggauuauuucccaaaacuugacagaccuuaggaaagcuauuuuugagacuuugcugacaguuuuucuggacccacaguauguauuucagacauuucaguaauaacucugugaccucauuauaugcguauuuuuguaugauccuguggguauuggugugaggacacaccuuguauucuuauuuaaaaaucccaaguuaaaaacagcccuggccuuuucgagucacguccguacaucugaguuuggacuaggagagugacuuaguucacuacaacauuuuaccaaaagauauugaagcaauguuuuuuccaaaauauggcauaacacagaauucuuggauuugcugaaauccuacagauuuuucuguguucguuuguuugccauauucaugcaggugauuugcaggugugcaaccuggaguccagcugucuugcucuucaugcugggcacuguuuguucucugcucgcccagcacaauuuauauuacagaacucacagcgagguggagagaagacacaguguccggagucaggagcucuggauucgagugcacauucacccauugauaauacugagcaggcaauucaccaaaaccaccuugugcugcacccucuugaauagcaacuuaauacauguccgggagccgccucauauaguuggguuaguugagauaaugaacuuggccagcuuugaaacaggaaguuuuugaaacuugccggugugccugcauguucugugugugccacucucaugcugcuagcagugccuugccuguucuugguguucuuggaagauaccugagcucuuacuuugacuccucaagguguuugguucgcauucauugacaacagugcaguuuguacccagaggcucugacuucacucuguugaagguuaaagaagauaguggccuuaggggagucaucaggccauucuacugaagguggguggcaucuuuaaugcagcuggcagccugucuggggcaugguccuugcucaggacuuauuucccuucuuuuuucucaccuuuaaguagaaauguacauaaggacacaacuagauauugauuugcuaaguucagugauauucaaagugaaaaugauacauauacuucuggauuauuuucguugcaaaauuuguucauucuuucccuauucggugugcauugagugccugcuaagggcugggcagagugcuagaagacgggaacugugugagccagcacagguguggagccuguuuucugggagcugagaaguuggggguggagaggaggcacacuggacauugcuugagcagccaaaugagaugacaggugugaucccagcacacugaaggagaggcacacgguucucuaagagugugugaggagacgaguagggcugggauggcugggagcugugacauuggaaggacuuaaccaugugugcaggaggcaguagccuccuggggagaggcagcagcaugugcaaggaugggggcccagcacuggguucauccuacaagcauguguccgggccucaaggccacucugaugacugcuuucccucccugagccuccugcagugagagugaagcucacgaaugcuuuggguguggcauggcaguguggucucauuguguaagguguuuugauuauguguggacuuuugcgccaggacuauuuuaaaugcuggggaugucgugcugaauaagccugaccaagccucugccuucguggaguuugccuucuacuuaggcaggggcucagauaguaauccagcaaaccuauaacugggcccugcaaugucagagacuaugaguguuaugaauagaaauagauacaguuuaacaaggggccagaggggccugaaaggcugcauugcugugggcagggaggucugggaaaggcuuuggagugugggugcuggggcugucccuugaccagagacuggaaugaugaagccagccuugccaaaggguccccucugugacuugcucugacacccuaauggcagggaucugccuccuugccuccucucuaccacacaaaacugauugccuuccccaaggacaacaaaggagaagaaaagaaaacgaagaaaucagaaaggauaaaaccaagagagaucaccaaaggcgcguggugcaaauacugaucacaucaguaagaaaacuguuuccaucccugauuugcuuuucuuuuaaauaggauauucagucauagcuucacuauaaaauugauuuauuguguugaaauaauuuccguagcaggggaacuaauuggauuguguagcauaaagaaaauguaugugggacaauggggaagaauugagccaaaaugaauccaauauauuuuaaucucugcaauacagauuauauuuucaauuaagaagcuuaacuugcauguguucggcgggcgggagcuucccagagcacuucccgcauguguuuauggguaauaaaucacuuagcauuaagaagguagacgaucauuagcccaugaucacucaguugccuccuguuaauagcaaagucaaugcacaccaucacuguggccauauucgggugguaaaauguggaguuacauggaaaguggaacuguuauauuggugaauacgauuuacuagacggaacaaggaaaaccugaauuccauccccugugggccauggaaagcccauauucacagucaagugugaaaguggcuuuugggccacccgugcccugucugaaagcagagcaucauguggccacgugucugcucggcucugccuuacuaauuguguuuaaccugagcucugcuacagacagacuuuggucuuugcuccaugcgugcuucuggcaugaccuaggaguugcuugccagugaugggcagagggcgagggcaagacgcuggcuagccuuuguccagugguccacuugucugggaucgcauuucaucuuaaagcaacccaugagguggaggaaccaugaucaucauauuauauaggccauggaaucugccucgugggcugucguagcagagcagucaacaaguuagaagccagagcccuugugcacucaucggugcccacaauaacucauuagguuuuuuccuuuucuuccucucagucccaguagccgucuaagagcagaagcuucuggggccuggccuugcagacacugaccuuugacucaccucuuuaugauuaagacaagagcauggaagaaauaaaggggucauuaaaaaaaaagaaaaggaaucuggcaggaaaagcagaggcagauguggagcugguuuaaaaaucuauuucaagucuuuccaguggcuggcuggguaggcaggggccgccaacacgcaggggccaaugcagccaaggagcaguugcguaaguccuugcguaaguagaaugagaugcccagggcucccuugagcgcggccacguggcugggaaccugucagguuuuauagcauccaaucagacaccgugcaccaggauggagagcccggaaagaggucagagcuggggaaggcaggugggggcuguaaacccaacagcagugugaggaaugggcucaaggcggauggagugagcagaggugucccagggacaguggcgagccugaaacuagacauggggagagaagagacagagacaagaauaacaaugguaguaagguggcagauccucaguuuaaaaucuggccacgaugccauucacuuaggcacuugcuuguucuagaaauauuuauuaagcacuagguguggcagguguagaauggauuugcccccaggaaacccuggaucuggggcuccgagucaucugucuacguccucuggagccuuccuugucgauugucccuucaccuccagauucuucuacugcagggaagcucccuugaccucacccucacccucacuguggacaccucuguuuuguccuucacagccagaccacacagagugguccccuagguccccagccuucacucacucuucaucuccccaugaggcuaaugaaaucuguucuacugcaguuaucaaugguguccucaucaauaagcccacauuaccgcccuccccagucucagacacuguugauggcgcccuugcuguuaagugcucuuguccaguagcuuccaugaccccgcgucuugcgcuguuucccucuggcaugucucauuccuucucucccucucgcucuaucucucucccucuccucuccuccccuccccuccccguccucccccucucucuccuccccucuccuccccucggcccuauccuccccuccccucuccucucuucccucccuuccucccuucuuuccuuccucuauccucccuucucucgcucucucucuagcucauuuuuuuuuucuucugcccggaagaaauacuggcauucuccaaggcucuuuucucagccuucuuuuuuagguucuuauucuaaaaucucucuucagugcucucucauugauuuccaaggauuucuuuauaaguggacugagauugaguacaaaauguaccuucaacucuugaccuucaccugaucccagaccccacuuucaccuggguccccaaggcugagcacaggucccuccuauccccaaggaggugcucugaacccacuccccauggcuguggauggcuccccaaccuucugcaugagguagacacccaguuaccucugcagcguccuucccuucagccaaaccccuccccccgccgccccugcuaaauuuacuuugucacccuuucuagaccaggucaguuccagacaugaccuggaugcuccuucuccuuaaagagugaaugagcaagaggcugggcgcaguggcucacaccuguaaucccagcacuuugggaggccaaggcgggccaaucaccugaggucagggguacaagaccauccuggucaacauggugaaacccugucccuacaaaaaauacaaaaaucagccagaugugguggcacacacuuguaaucccaguuacuugggaggcugaggcacgaggaucacuugaacucaggagguggaaguugcagugagccgagaucaugccacugcacucuaguaugggagacagagcgagacucugucucagaaaaagaaaaaaaaagagaaugaauaaugagcaagaaugauaggccauggcagauuggcacacacauaauuuuauaauuucccuuuuuuuuuuuuuuuuccuggagacagagucuuacucugcugcccaggcuagagugcaguggugugaucucggcucacugcaaccucuguuuccaggguucaagugauccucccgccuuagccuccuaaguagcugggauuacaagcaugugccaccaugccuggauaauuuuuguauuuuuaguagugaugggguuuccccauguuagccaggcugaucucaaacuccugaccucaagugaaccacccaucucagccucccaaagugcuggauuacaggaaugagccacugcacccagcuggcacacacauaauuuucuaaaccagggguugacaagcuguaacugaugacccaauccagcccuccaucuguaguguguaugcaugugugugucccacaagcuaggaauagauuuuauguuuuuaaaggauugaaaaaaggcaagaauacuauuuuauaacagaugaaaauuauaugaauuuaaauuuugcugucuauacauaaaguuuuauuggcacauagucauacccauucacuuuuuguauugucaguggcugcuuuugcgcuguuauaauagcagagucuauuagugaaugcagaagagaccauauggccugcaaggccugacuucuuuacugucugaucauuuacagaagaaguguacugaucccuugacuagacugucaagaauggaaagugcacuguuaagaaugggcacaucuuauucacagacugcaaucaauaaucaauaaucaaucacucugauguaaccugagaacauacuguguagaaagcaugcuguagaggauagcgugugcuuccccuugugcuccccagucuguuucacaaguucuggaugauugaucaaugcucgaucaaugcgagcucccuucuccaucaugggaagaaugggaagccugccccuccccuguggugcaucuggcauccgagcugguguucaucgcuucccucucugcugggugaggaccucgugggugaggacuuccacauaaaaaugagggguaaggcgcaaacaucagaccagagucacaggagacauuaucuuccccguggccgcccugccuggugaguuuacugauuugccuaaggguggugcuggugugugucuugcaccaugccucccuccagccucucagauauguccuguccgguggggacgucucuccuguguauauuuuugguggcugagcaaagugcuugugguuccuuucagccaauugugcugaggcaaaggcgggccacuuaaauugcaguuucucugauguaucuucuaaaagccaaaggucguuauccacaaaggguacuuuuguguaacaccaggcacucgaguagaucuguggggucuucccucugugggugaugagucuggguuucagcaucccgcuuccccagaccacauggccacugauccguggggugcacagaaggacaggcagucacaugccugcuucuuugaguucugccaccuacgagcugaguaaccugggcaaguggugaaccucauggauucuuuguugccaccagcaaauuggggagaguaauugagagggcauuucugagcuccuggcucagcagguagcauguuagagcugcuugaucaaugcgagcccccuucuccuucaugggaagaacaggaagccugcuccuccccugugcugcauuuggcaucugagcugguguucagugcuucccucacugcugugugguugccaaagccuccuguggaguaaggcccugcacugcuucauccuccugggagagcaggcaguggagcaggaugcugcauacagagcugguucuugguucuugaggagggggagcgguggcucugccagcucagcugugaguggucccaggaugaaggaacagcaggaaacaaagauacucucaaggccauggagaagaagugugagguagaugcuggcgcaggagcccacggugggggagaauccgcuucugaugucuuccacccuggaccucaagugucaaacagcaagagaugggcugagcaaagaucacccgucucaaauucaguugacaaucagcaccagccacgucuccugggaaacaugaaguggccuuaaccgucaccugccugucaucucaggcuugccauuagucaggcauucguuaaagaauucugucaauaauagaaaucagaaaugccuggaaaguagauuucuugcagggcagauggagaagacagccucugggucuccaaaccccuuuggcucucacuggggcuucugggcaggacuggggacccauguacaugucaucucagggcagcuuucuuucuaaacccauuuugcagauguggcggcugaggucucauccagcacccagucacgccucucuugggggagagccccaccguugggagcugagcaaaggcaauauuucgguuuuuuuuuuaaaagauacugugaguuggucaucacuagacuuggguguaaguuaacuguuaucucaccacuuugcuaccagguuauaaucaaagaaagucuuagaucaaagucagccacacacacagacauuuaugaaaaauaguuuugcacaaucagugcauacugucuguucuuaggcuucauaaaacccccuucccugucauuugaggugcucugccugagccuugauaaaugauucaucagaagcaaaugagaaaguauucuggaggcaagauucaauuugcauggauagucaucuuagggaaccagcauccuccagacccacagcuucuugccacuagaacacaggguccagcguugggcacuguccuucaacacugggcuuccuacacacacacauccaauccacgcacagcccgggagagucccugaaacauuuuagcucauccacauaccuugcaugguguggaauucaacaaggagaacccauuucucuuaaucauuacacucauuaagaaaacacgaagcucacaacagaaaauaauuucuaacuauuauuauucugugguuucugcuuuugaucaagauaagaauagccgaagcacccacccaggucacucucauggaaugggguuuucugauuaaagauuggcaagcaacugacaagcuuguagcacauccuuuaagcuggcacucgcuguuugaguacuugagaguuauuugcagacuuccuaagucuuucguuuugcuaacugugugucaggaacuguucugggcacucuaugcaaugugagcuuauuuaaugguuaccaccuaggaggcugaugugcucuugacacccauuucacagaugcagaaucuaaggaaaucugcucaguguuuacacagccaacuggucagugguacagccuggauuucaucucuggguguuuauuccuggagucccugcuuuaaccaccauauuaaccugcuucugaacaccaaccaaagcuugaauccagccuuccaaaucucaagccugggcuuuuguuaaggaggacgcucaggguuucuugauagccgaacuccuguauguccaggaaagaauaaagaccagauggucuugauaugaaaaggcagcagauuuuaacuacaaaaugggaaaugaguaauucguuuacgaggacaaaguagugaaaacuguucuuaggcuuaggguaggugauuauaucuuaacucuuugaauguucagucaaagcuauauauucaagauauuguggguucccuaccagaccaccacgaaaaagugaaguuugcaauaaagcaagucacacagauuuuuugguuucccagugcauauauguuauguuuacacuauaaaguauuuuauuaagugugaaaaguaugucuuaaaaaaacaguguauauaccuuaauagaaauacuuuauuguuaaacaaugcuaacaauuaucugaggcuucagcaaaucuaaaucuuucugcugauagagagucuugcgucaauguugauggcugcugacugaucaggauggugguugcugagggcugagguggcuaugacaguuuuuuaaaauaaggcaacagugaaauuugccacaucauuugaugcuuccuuucacucaagauuucucuguagccugugaugcuguuugguagcauuuuacacacacuaaaacuucuuuucacaugggagucaaucuucucaaacucggccaacugcuuuggcaacuaacuuuauguaauauucuaaauccuuugucauuucaacaauguuaucagaaucuucaccaggaguagauucaucucaagaaaccacuuucuuugcucacaagcaugagugggaacuccuuauccauccaaguuguaucaugagauugcagcaauucagucacaucuucagaguccacuucuaauucuaguucucugcuauuuccacuacaucugaauuuacuucuuccucugaagucuugaaccggucaaagucaaccaugaagaucagaauccacuucuuccaaacuccaguuaauguugauauuuugaccuccucccaugaaucaugacucuucuaaauggcuuuuagaaugcugaauuuuuuccagaaaguuuucaauuuacuuuggucagauccauuagagaaaucacuaucucuggcagcuauagccuuauaaaauauauuucuuaaauaauaagacuugaaagucaaaauugcucgugauuaauggacuguggaauggauguuguguuagcaggcaugaaaacaacauucaccuccuuguacaucuccaucagagcucuggguugaccaggugcauugucaaugagcaguaauauuuuugaaaggcaucuuguuucugaguaucaggucuuaacagugggcuuaaaacauucaguaaaccaugcuccaaacagaugugcugucauccaggcucucuucuugcauuuauagagcauaugcagaguagauuuagcauaauucuuaagggcgcuaggauguucagaauaacaaauaagcauuggcuucaacuuaaagucgccagcugccuuagcccccggcuauagagucagccuguccuuugaaguuuugaagccaggaauugacuucuucucccuaaauaugaaaguccuagaugacauauuccaauauaaggugguuucauuuacauugaaagucugcuuuuuaguguagccacccucaucaauggucuauccuaggucuucuggagaacuugcugcagcuucuccaucagcacuuucuguucaccuugcacuuuuauguuauggagauggcuucuuuccuuaagaaucaaccucugguagcuucaaacuuuuccccugcagcuuccucaccucucucagccuucccagaauugaacagaguuuagggccuugcucucaguuaggcuuuggcuugagggaauguuguggcugguuggaucuucuauucacaccacugaaacuuucuccguaaaaaaguuucaccacuaaacuuugcccacugcaagcugagaagauccuucggagaccucuuuggaaacacauagcaaagaaaaugacagaagccgccaucucuuguaucuuuaccaugcuuucaacaguagcuaccaauuauugaacagcugguaggacccagccucucuauagacacugaggcuucuaaucuccuucuucucaagaccucaauaaggaaaaugaguucagagcuguuauuaacuugaggaagguugcacagccuauaagugacaggacaugaaucaauaugaccugucacuuauagaucacuuaugaccuugaggcuccugcucuuucuaguucuucauuucuuuguguguuuccuguagcucuucuccaagggcacaccccacauagagagacccaccaggccuggcuugagugaaacuaaaugcguagugaguagaaguugccaagcaccagugagaaugggaaaauguggacaacgucaccaccugccagguagcaagcaccuaggcuccuacaaaugggcaaaaaaaaaaaaaaaaaaaaaaaucggucucaguuuucagccuauggcaaaugagccuucagcaaaugacaugagcaugcuaaaugauugcaguguccauagcaggucuugaaaaugaacccggauaaauuuuaagcaucacugguguaugcugagcgugaaauaccuugaaagcagcauucucuuuuguaaggauccuauuuucucuuaagcauuucugccuugaaccguaugguuugcucaaggccucugacuacuuccuuuuuuucugggcugacuaggauucauuuacacuguuuuuguaaggaugcguugcuggaugcuguggggaauaaagauucugcacagauggacccucacuguauuguuguagaccaggggccauugccugcagggaccucuguccugggugguguuuggugaucagaggcuugccagggauggcagggacgccagggacagcaaggacggcagggacgccagggacggcagggaugcgagggacggcagggacgagagggauggcagggauggcagggaggcgaggucucugguugucgugauugggcgucuggguguguguuuguuuaugcuuguuuauuaaugccccaccuacuuccagagagaucugguucucugggaagugaagguuagagauucuuauucccggguuguuuugauuuauuuuuuaaucaugaaacugagucacaccaaugguacagauaugaacagaaaaauuaugagucccaugccugcaguuucugaaacaugcccucuuuccuucuuguguuuuuucuuuuuuauugugauuuuauauauauaaauaaauauuauauauauguaaccacaauagaaaagaaaaaauacauacauuacaaaguuugccauuuaaccguuuauaaguguaucauucaauggcauaauuacauccacaguguugcucaguuaucacuacuguugauuuccagaauguuuguucaccccaagcagaaacucucaacucccuguucccaucccccauguauauggaacuaggaaaagacuccaguggcagcugaugacacacauuccuacaccccggcaagcagagcauccaggacaaccuguccugugcccgagggguggggcacggucacccugaccuccccugcuuccccugcccauccauggcuguccuucacucacccaauuagugaucauaggacaacaggaggagccugggagaggaaggaggaggccugagggauggacacuggggugcugaggcggaggucucuggggugagcagacacuggggugcuagggcagggucucuggggugcugugguggggaucccuggggugaacggacacuggggugcuggggcagaggucucuggggugagcagacacuggggugcuggggcgagcagacacuggggugcuggggcggggacucuggggcgacccaagacccuucuuuauuugccgggauggagucuuacagucaggcuuugcccucucucgcggccucccccagcaguagagacuucucacuuccugauguucgcugcuggacauuucugauguguuugucuuggagaugguuuuuucauuacccaagcugcugcuaaauccgucaacauuuauuuugugaaguugaaauagguggacgaggcaggauugggaggagguagaggcgaauaagaaggaccaaguaguggagaguagagggagaguggguggccuuaugauauugaaaacacaauccugaaauuagacuguuagugaugacaggcuuggugcucuggaggugaagcugaggguaccugccuaccuugauuuccagacugguuuaucccaacacuugcuaacuccacguuagggcucuuaguggcuaauugucucuaagcuugauuuccagacugguuuauccuaacacuugcuaacuccgcguuggggcuccuaguggcuaaucggcuccaagcuuuggagggagcauuuuaaggucuuuucaaucaacacauuuuauuuucugaugaccuagaaacaggugugaacucuccgacuccccaccaaaagaaaguagaugaagaacucuucaaaauuuguagagaggacauaucagaauugaaucacaacuuuucaggccuuggcaaaauuuucuuuaaagaaccaacacaggcacaccuacucagcacugcuaguguaguggggaaauggcuggcuaaucccuacuaaaagaguuuugcuguguucuaauaaaacuuuauuuaaaccaccucacaccgauuaggauggcuacaucagaaaaaaaaaaaaacagggaaauaacaaguguugaugaggguguggagaaauuggaacccuuguguacuguugcugggaauguaaaauggcacagccacuauggaaaauaguaggaugguuccucuaaaacuuuaaaauagaauuaccagaugaucuggcaauuccacuucuggguaucaucaacugaagaaucauaagguacauaaauuuggaaagcagagcuuuauuucucauaaaggguugcagccugcaggccagccauuccgcagaccaggaagcguagccuccagcuucugccaagagcaagcacuuccagggaggaggaaugagacaggaauuuaugcugaguggguuggcuaaguauacauaaucaauaagcuauagaagaagucaugaauauuaaugaaggagaaacacacacaugugugauugagccaugccucuucgugggucccguguucaaaaaaauaccagcauuaggaugacccaaggguggagguuuuggcccucugaugucaaaaguucaaacagaggccacgaaaacccucacugcacauccuccuucgacuggccagagccacccugcaguugguagccucucagcaggagggcaugcagugucaaacuggcaagcugucacguggaaacugcaaagagggagggggaguccacuuauggcucagacaaguggcuaaaggugauauaggaaugaguugucugcuucuuguuuucuagagccaguuucugcuuccuccuuaggagagaauucugguuaaaggcuauuaaggaaaggguauacugaagcggguccaaccucccaucucuucauggucaugggcugacucaguuuuuguuguuguuguuguuuuuguuuuuuuuuguuguuguuuuuagacagagucuugcucuuguuacccaggcuggagugcagcggcgcgauccagcucucugcaacuucugccucccagguucaagcgauucuccugcuucagccucccgaguaguugggauuacagacgccugccaccaugcccggguaauuuuuguauuuuuaguagagaugggguuucaccauguuggccagauuggucuugaacuccuggccucuggugauccacccaccuuggccucccaaagugcugggauuacaggcgugagccacggcgcccggcccggauucaguuuuuaagucuucucuggggucccuuuggccaagaaggagucuguucaguccauugggaaacuuaggauuuuauuuuuauuucucaauauuuauccaaaauaauugaacauaaggacuugaagagagaucuguacacugauguucauagcaacauuuuucacaguugcgaaaagguagaaguacucaaguguccaucaacagauaaaugggugguauacacgauguggcauaugcaucccaaagccuccauuuccucauuuguaaaauauugugugauucauaccccgcaagacuugugagcaugaaauaacaugaucugugugaaagcaaugacagugucuggaacuuagggggugcucaccaaaugccuagcagcaaagcagcagaaacuagagguggucgugugggagaggauggaggaaccgguggcugggaacugccuacuuucaggauuucuuaccuuuggcccacgacaauuccuuggccaggaaugcuguuuugguggaaacugggaugguaugcauccagcacgucacucuguuuauuaggcaucagacugguagacaagggcccaguaaucucggcucauggagacccaaguggggaugacacggccucaggcuagagcagacgcacccugggaauccucuguauucuuguuggcaucacagcccaagccuguguccagcagggcugaccagaagaaaggucuggggcauuuuagguuuuaguuaagaguuugauggaggcuuaagcuuuuauugauuugaaaaagaaaagaaagggaaucuuggaaaaaaguaacucgcuguagugcagacaggaaauaauagcaaugaaaucuuuuggcuucccugcuccugaccccagaggucccuuccucgcuuuaaaauccucaggcacccccuccaccccuguugcccacaagcaaauaugcagacuccagagccccacauccccgucucucacggucuggcccaguugaucucucucaccucauuccgaaaacuuucuagugacauuggucuucccaccguuucccaaaucccaaagacacgaggcagaucccacccagucccccagcuuugcauuacuuugcccuugugauacugggggacguucuuagaagucacuucuuuccacauauaugguuuuuguuucccagucaaggucccaagguaggaaguuucuggccaugugagucaccaccuggaugaaggagccacccugccaaguguggggaggugccaggagacggagcggcugagaugaagcauucauuaucucuccuucccauggaacugaagugacauucucugcaucucuauuaucacuucaccucaacuugccucuucccagcaucccugaauuaugcagaaaucauuugaaggcaaauucccagcuacuguugcuagacucauuuuucugcagggauggaggaauguguugcuagacucauuuuucugcagggauggaggaaugugucacuuuuaauuuguuuccuuuuuucccacccauuuuggguaaaacauuguguuaaaagauacaucgucuccacccccaaagcagccugucuucaugcccaagggauuuaaaugcccucauauugaaguguacaagcuaauuauguaacuuaaaguaaguuuagggaaggaauuuaaauacccccacagcuucacaaugugagaaauggggcugugcaagccccuggaaguucccugccuuucuccacauucucccucuguaguaaugaggcuccucaucuuucuguuuuauuggcagcaaacacuggguaacaggggugcuagaagggccugagggucugucauaagcaagggccuauaauugugccaggagccuggaauaguuaaauugguuccugauuacuuuucacucgcuaaguuccccucagcucaauuaacauauaauuauuuaggacuaugcuacuuuuguuacuggcacauggcuuuccaaauaggcagcuuugggggaugaucucccucuggagcccacgcacugcauccauccacccgcccuuuuuguucaagaacaaaagcaaggcuggcgggaccuccuccagaaccuucaugcugcagagaggcuuggaccuuggcaggugccuccugcaggcagagccucgccggccacaccagccugucucccaaagacgcgcagaacugcagaauucacagggcuugucuuucucuuuuaccaaaugcgacuuuacauuuuguaaggugucaguggagaucauaucaguguucagauaacuuuguaucauguggugaugccucuuccuuaccuuuaaucucaaaaauaaaaaaacaaaaccuguagguucaaaguuccagggagcuuagaggcacugggguugagugcuuucauuugucaguggagaagaugagggucucgaaaacuugagcaacauuuuuuuuguuuuaacauuuuuaaaauucuauuguaaauugacaaauaauaauuguguauguguaugguaugcagucgauguugugauacaugcauucauuguggaaugauuaaaucaaaugaauuaacaugucuguucccucacauacuucucauuucuuggugguguugaacaacguuccgaaggucagguagcuccacguuuaaauggacaugaagccauugauagauagauagacauacuugaauuaagacuuuaauuguacaaauguguguauguguaggcuacaauuaaacucauauuugacacugucaagaauuaguaguuuuuguugcuaaugggguuaaauguccaggauaggaaagcuuacugguuuguuguugcuuuaauugcauuggcuugggagugaacccaucucccuuucuuauugaccucacauuuuuuuaaguggauaauguuaugacaaguuugauaaaaaugaugcuucugacuuucuggagacaggaaucaauuaccaagaagagauaacauuucucuccauugagccauuaaaaauaaaauucacaggcuucuagaccuuacggcuuuuugaaucuuuuuagguugacauaauuugccugugauucuuucuggauuauuuauuuguauguuugguuuuaucuccugaauuuuagauuacaaauaauccuuccuuagauuuugaccauuuuuaggacagcauuccugaaagcauuuaauucucacagcauuuguuauuguuuuuuagaaauuaauuaauuaauucuccuggcucagaauaagacauaauuugugugguucacaaggugguugaucccuucccccugaguuucuggcauuucugguggaaucccuaaugagaaguuugcauaagaagaaccugaagagagcugaaucccaccgcagaaaaccuacacgguuuucugcaaggacucagggagagccaggggcaaccaaauacucuagccucccugaggccucucauuugggccagagccugaccuucugagccagcucuuucauccauucauucauucacuuacucuuccauccacuuauucauucauuccugugucaguuaccuagugagcauauacuguguaccaaaugcugacuuggcacugaggacacuuaggugaacaagcagguguugccacugccuucgagauaccuaugcuuuacucacaaucuggagggcuucucuuaccuaaacccaacuccagcaguguccagcacagauagaguugucaggaugcagagucaggcgcauucauaccccacacgcccucgaauugccugcugggcaaaggacuaugauccugcacuguguggagccccucauuucauuuggcaaggcauccucccauccaaacacuuggcuuagcuugcaauccuucucauauuccucuguaacagaaagcggauugguaugcaaaagcuucuaauaugauuuucuuauuuucccuacuuucacauuuauuagaaauaacuuaugaauuacaguaacuaauagauuuuuuuuuuuuuugagauggagucuugcucugucacccaggcuggagugcaguggugcagucucggcucacugcaaccucugccucccggguuccagugauucuccugccucagccuccugaguagcugggauuacaggugcacaccaccaggcccagcuaauuuuuuuuuuuuuuucuugagauggagucucacucugucgccuaggcuggagugcaguggugcaaucucggcucauugcaagcuccaccucccagguucaugccauucuccugccucagccucccgaguagcugggacuacgggcaccuaccaccaugcccggcuaauuuuuuuguauuuuuuaguagagacgggguuucaccauguuagccaggaugguuucgaucuccugaccuugugauccgccugccuuggccucccaaagugcugggauuacaggugugagccaccaugcccagccuguaauuuuuuuuuuuuaguacagacgggguuucaccauguuggccaggcuggucuugaacuccugaccucaggugaucugcccgccucagccucccacaccacacucggccgacuaauagauuuucuuaccuaaaaguuagucucugguuauguuucuccuugccucauugggugauuggcccggggcauagcuguguuuccgucccgucaggugugggcuguaggauaucauuuaugcauguccuggaaguuucugugcaagugacgcagcccuugaugcauugagcccaagcaucaucugaucuuuguuuacugcacugauuaugguuuuauuugaucuuuccuucagcuuuccucaugcuacuugaauuuccacguuguuuuugucccggcauuuaaaaaaauuuauagggaaucugaauuacagaaucuaccucucagcccugcacuuucucagucgucaguuucuuaaaagguuuuuguucagccuucacauuauuuuagcaugacauacauaguuuuuuuuuuuuuuuuuuaauuugagacaagucucacucugucacccaggcuggagugcaguggcgcaauccuggcucacugcaagcuccgccucccagguucgcaccauucuccugccucagccucccaaguagcugggacugcaggugcccgccaccacacccagcuaauuuuuuguauuuuuaguagaaacgggguuucacuguguuagccaggauggucucaaucuccugaccucgugauucacccaccuuggccucccaaagugcugggauuacaggcgugagccaccgcgcccagcugacauauuucuuuaagucauuuugagaacugucuuuauuuaacuagcugcaguugucccagagcuuaauucgaagcagcauauugcaacuguuugggugcuaucuugaggcacaauaauuacccuauaauaauaauguguguuuuaguaaacuggucauuauugucauagagggcuggaaagagugucuucuuaaagcucauaaggacccuaggguacucugcaaauagcagaguucuaaaccugaaggaaaaaauuaaggggaaaaaaaauuguguuaguggucagaagccccguguccuuaugcaucacggcacagcccacccuguaaugacaagaagguguuguauuccacugacacuugggggcuuuucugugaucucugggguugcugcauguacauccucagaggcucucucaacacaguuaccaagggucagguggguuacuuagaccaucucucuagcucauacuuuguacuucugggggcugaaggugacaggacagaccccaucccaagacuggggggcugauuagaguugccaggcaucccguauaugcaaagcauguccugaauuuugcaacuuuuguccuggauccuuuauuaauuugucaggaugcucuaaauguccuguauuccgcuuuuuuuuucuaaucaauuacagaauucagcaauaagagcuuuauucaaauuuaacugggcauccuauauuugcaaaaucuggcaacccugcggcugaggaauguugcugcccagccuguguucuugguuaauggacaaggcagcaaugccugcgucccuccauuaauagucacuuagaaacacuaauuccuccuuucugguuauauuuuaauguccccggggaagaagucaaauaacuccaccugcaguuuucuuuagugaccaaaauugcaaacucugucacaggcccuuugucacagcuguuuuggucccagagcuagccgauagguuucuugaugaaauaaugucugcgaaucccuuucucagagcggcacgcagugugagcgugagagaaucugcagugacagcgggugaugggcgggagguggugguggcagguggcgauggagaccuccuuaaaaccccagguggugaauuucuucuucccuccucccuggcucacugccuuuuagcggcugugacauggccagggcguggggagcuucuccaggcacgcuuggcugaagagauaaugcugucagaggacagcaguuacuaguaaguaaccuacauuucccuucuacucuggcugcuccuugcugucuaaauagagaaaguggaauuagguuuaucaucugugaccuaauacuaauuccucuuacauccugccuuugugcaaagggaaaagggccauuuaaaaaguaguggacgaagcuuuaguauuguaagcacuuucaagcguuauaaaacaaaucuguugaaugaacaagcaugugagaguugguauucuagagucacgugugaucgcccaaauuguauauuucauuacaaaaaguauauaaagucaugguauuauagaguguuaaaauuauacuuuaucaaugaaucaagaaauuaaaauuucugagaaaauucuugucaaaucacuuucaugucuacuaaagcuuuuaacuucuucucuaguaaaauaguggucaaaauuagcauguggaaaguaggccaaugauacugaagucguaagccaugcuuccaagccuggagauauugcagcaaccucuuccaagccugacagcuccuugcgaagagugcuuucaacuggguagcuugaaaaagccagcuaagcaaagaucaguggaaucauagaacauuaagacauggcaacuugagaaaacgauuuaauuugcaccuuuuuuuuucuuuuuuuuaauuagauuuuguuuuaagucauacuuuucaaauguuacuuucagaagcuguuauuuuggucuguuucuuucauccugcaugugcuaauuuccuugauuaauuuggagaacaucugcauauaauuccgugaucuuuucguuggcaaaaccucacagcuuugcgcaagacuuggagaguucacauuccagacagucugggauuguaucuaauugaaaugccaaaccuaccgaagugccagagcguaaguguguaauuauguaauuuucucuugaucuuucagagucuuccugcgagcaauuaaucaguaugcagauaugcugaacaaaaaauuucuggaucaagccaacuuugagcuacagguaagagaagagguagacacgaccuuuguggagaaaucauguuaaaacaaauugcugguccgagccaguaucuuacaguauuucuaauccuugaacuuaauuggucucccauccaagaugcggaaacggaauuuguaguauguacuauuggaaccugaggagugaaaauuauacuuuuggaguauucgcuuaauuuagcaaggaaagagauagaguuguuucagagagaagcuauugaaucagagugacaagaagggacucuucaagcagggaggccaccaagucccgguguguguaucugccaagauugucucagcccaucuuacuguggagggaggaucagcagaggaggagacccaggucugcaccucgagcucagcuugcuuuuauaacucuguguucccuccauauccucucucggccuugugcuacuagcaguggcuuuuaccaggccagagacccugccccccagaccccaugguccucagaaaugcuccuuuggugaaugcagugugugagagagagagagaguguguguguuugugugugugugugugugugugugcgcgcgcgcaugcaugcuguaaggauugauuuugccuggccugauuugugugugugugugugugugugugugugugugugugugugcaugcuguaaggauugauuuugccuggccugauuucuuacugugcauccaaaauguguggcucucacuuccauuguacucuggauguguuucugcuaauaaugauuuuaucugucauuauuauuacuuaguuuauuuuaguaaaguauacaaauuuuugaaaagcaugcagauacaaauggcauguuuauuuccugggcaagaugauucacucucucaaaaggaacccgaaggauuuuuguucacccauugggugauccaaccccaaaauaaguuacccaauagcaaauaauaaguuuacccaaugcucuuucauuugcauugcccuuauuuuuauaauuuuuuaauuuuaaguguuuguuguauuggcauuacaggauauaauuagauaauaauauaucaggugccauauaucuaaacauguuacuuguuuauaaaauuuuuuaucauuuucucugcugaaugccuguuuucauaugucauaauaacauacuuucucuuuauacaauauauaugugcugaauaucaguuuagcagguaaaauaggaaacauuccuuccuaacccuuugcugccucucacugccccucugcagggauaacuuuuaacucauuguucugaauucuuugucacgcuuucagcauuuauaugggccuguguguguuuuuuuucagccuuuaacaugaacuggaucauacccuguguuuuucagcucugucauauuccacgauaugaauguaccaacauuuauucagccauuucugcacugauaaccuagaggcuguuuccagguguuuacaaucacaggcugugcuaccgugagggcugugauacaugugucucuuaguacacgcauugcuauggaaaagguugaucucuaggccaaaugauaugacauuuuaaguuugauggaaaaugaucaauuuccuuccuaacaugauuuuagcaauuugccaccccaccaaccuugagagcagccacuuucuaucuagaaucuucuucaacacugauuuaaaaugauugauuuuuguuuuuauugucauuuuucugaugauuauuuaggcuaagaauacuuaguggccauguggguuucugcugugaauucucugaucauuucuucuccuaacauucguauuuggcugucuuuuuuauaaguuggaauucuugauauaggcuaggcauggguuuaggcuuaucauauagaaauauuucauuuuucuguagugaaaucuguuauuucuuuuacagcuaucugguuucauguuuuacuuggcaaaucucuccuugccuuaauauuauauacuucuaaauuuuacuguuuuguguuaguuaggaucugcuaauaccugugugguuuuguguuuuuguuuuuaucuuucagguguuuaauccauuugggauuucuguaguuaguauagggguaaggaucuaacuucacuuuuucccacgucauuucaugaauagaugacucuuuccccaaugauuggaaaugcuacaauuaacauaauuauaaauguauguguguauaaauuccauuuucuguguuauuauccuagaggcuuaauccuuauaccuuuguacccagcuagcagagucgcuacuuuuccacucguuuucuacugcagaauuaucuuggcuguuuuugugcauuuccuguuccauuuggaguuuaaaaucagauagcugaguuucucuuuuaaaaacauacugcuuggauuuuagcuggaaucccauugaauugauaaauaaauuuggaguaaguuuaugguauuugagggaauacuuugcaguauuuuuuuccccaucucauacuagacuauuuaaguauuuguuuugccauuuuucugguuuuuuucuaggucaggucucacacaugacuugcuggguagauucccguguguuuuaguuguggcugcucuggugggggagccuguuucucaacauguugguucucccuggcuuucguccuguuucaugaggauggccccuuggacucucaccgugagcccgcacaccuuacaagccacgugcuucagggcccacaucgagcgucgccccuuggcaggugugacacacauauuuauuguuguuugaggaggguuuagcaggaaucgcugccugcugucggcugcauucugagagucacagucaggggcccaucuagcauacgacccaugucugcauguacccagcacagaucuuaauuuaaacaccaccgucaccaccaugagugcucuggcucaaaggcagcccugguccuauguaggaaaagaaagaauuaggaguuggugaagcugucauuuaaaaagaagcauucguguuuuguuguuguugcugcugcuguugcuguugcuguuguuguugcugcugcugcugcugcuguuguuguuaaagggagcagguagaaaugaagaucuauugugaguccucgcaggcauggguccuauucuggcugagccccugaccaugauucucagaauacagguggcugcagccagugauuccugccggugcuguggcaaggcugaaaucggugggaggugucagucccaaaaacaaaaggaacgacuuguauuuuauugacuggcacuccccuuucuuuauaaagggggcuaaaaaaaagagagccccauugugggcucugagguugggggugccuggcucagacccccauucugcuucauguguuaccuguagcuuugggcuggucucuaaaucucagcucugcaauggggauaacagcaccuacuugguuauucuguggugaucaaaugagcugguguauuacuauagaaagugugcuguucaugggaaguguuggauaaaugcaagcccaacagacuuuucucaaauccuacaaaugcucuuaaauuuccccuuacuucucagguaauuaaaaauagagucaauauaauguucacacuuuauuuuuauagaacucuuugcagcuaucuccuuugauauaauacauauuaucccugguuuguaaaugagaaaacugagaccuacaacuuucuucuucuaaaggccguugucuuuuaaaccgcauauauguaguccauaaacccuugaaauauggguuuauugaaagaagaaauguuugaucucuuuacauuuguuuuccuugucuaguguaugugugauuuggggguaaagaguccuaaauuauggaaaucuauacuauucuuaagugaggagcuucauaauuacauuaauaaaaguuaacauuggccaggcaugguggcucacacuuguaaucccagcacuuugggaggcugagggagguggaucacuugaggucaggaguucaagaccagccuggccaacauggugaaaccccaucucuacuaaaaauacaaaaauuauccaggcaugguggugcacaccuguagucccagcuacucaggaggcugaggcaggagaauugcuugaacccagaaggcagagguugcagugagccaagaucaugccacugcauuccagccugggcaacagagggagacuccaucucaauaaaaaagagcuaacauugaugaagugcuuacacaugcucuguaccgccuuaaauucugugcauauauuuacuucuuugaucuucugagcacuccuauaagauagauacucuugaaauucacauuuuauccaugaggaaacugaggcagagagagguuagagucugaguaaauggcagacccgggauuugaauaugugcaccgugaccucugagcccacacgcuaaggccugaauuacaccguggguggcugguuagcaacauguauagagugaguguggguuuuuuuuuuaacuuuucagaagugugugcugagcaaaugauaaaugucugagagcauuguugagauccuauaucaagcuguucaacaacuuagcaucuccuccuuuuugguuuucagcuguggaacaacuacuuucaccuggcuguugcuuuccuuacucaagagucccugcaacuggagaauuuuucaagugccaagagagccaaaauccuuaacaaguaaguucucaucuagcucugaaacugcaggcaggagccuccaacucuaaucgcauaauuuucaugucauuucuaagccaacuugauacaaauugagauguaaucacgguguaaugaaagggugguuuuaaaucaccaaucagguauugccuuuucuaacccaugaaucaagaucuaaaauugcaggacucauccuggaagguuccaggucaguguaauccaagacuauuagugcaacacagaauuucagcuuccggagauaauuccuuuugcuaugcacuauucugaugucauuucacaugugguugacuuuauugcuuaauucuucaauucgaaaggagcuucugaugaaagcucuuggcucuauugggauuguugaacagcucacuggggaguuagagcuaucgggguuccuucuuggcagcagauaaccccugucuucuuccgggcaggagcuuugaauggacugaagcggcaccuucuaucauuguaaauaaaccucuccaaagcuccaugaaagccgagauccuugccggccccuccagcucuguaaccccaguuugcaucaugcaccgcucaugacucaguaucaagaagcaccauuguugcauggguuuccuuccccuguuuggacacccggagggucuugcuucgucucuuucugccuccguuucacuaauuucucacugcugucgguguuccuuucauaaguccuuuugagaagaguucugaaauugcauugguguugccacgucaucagucucuguuugucauuuuauaaauaccucugcaauaucucgacuguucuaaggcuuggccaacuccaugcugcuagcugagguuagagauuccagaaagaguuucagaagguggcagcugcucuuauauccugugagucuguaucucacuuucaaggcaaauccaaagcacaucaucucuggagaguaagaauuauagucauaagcugggcucuggugcucagccaguagugguaauaccagcuacuuaggaggcugaggcaggaagaucacuugagcccaggaggucaaggcugcagugcaccacgaucauaccugugaauugccaugcacuccagccugggcaacauggcaagacccccuuucaaaaaaaaagagaagaaagaaagaauuauagucacguacugcauaaccacagacuacaugcuguauuuuuacuguaacuuuucuuuguuuagauacacaaauacucaccauuguguuacauuugccugugguauuuauuguagucacaugguacauuacaaacauguuguacggguuuguagacuaguaacaguaggcuauaccguauggccgauguguguaguaggcuguaguaucucaguuuguguaaguucacucagcagcguucacacgacgacaaaaucacccagugacauauuucucagaacauaucccugucauuaagcaaagcaugaguauauuucagcaaaucauuuacucagccuguacuuuaugucagugacuuucuaagcauuucaugugcauuuuucuucuauaaucauuaaaaagcaaaaccauuccuuaggcccucguaucugcccuaguuucuagaugaggaaggucacacacagugaccgagccacuuggccagucccacaccuagaauguggcaaagcagcauucuaaucuaggcgauucagggcccacgauuuucaccugggcugcuuuuagaaccuucgagcuuuuggucugcaccuaucuaaguaaagaucaccuuucaccuggccaucuuuccuucaggccuccucagcugggugauuccugccugacagccaucuguguaaacagugaucauuguucagaaacaagaaaugcacuugcugagccaagcacugagaaugguguaggcagagugggugcucgccugugacuaccgaagcggcacgcagcagcugcagcccaccaccuuggggccugcacaggugucugucgcucguccuggcuuccagcaucaagagacagacuucuccaggcugcaucuucuggagacuggcucagcaggggcgcaggcuccugcuuuguggaaugcacgcucccucagggcccaggggaagggagggauggugcuuuguaauuguugcuguucuuguugauuugccuuugugcugggaauuguagugcagacgguagugaccaacacacacaaagcacagugcggcacaacgcacuucaacgcacuguaauccaccaggugcggacacaccuccuucagcacgcgccccuuguugucccguccagcaaaaggacagcucggccacagcaggugaagccaccugcccaaguguccagcgcccgcuauugggugaagcugggacccgagcccagccacagcuccuggccucggagaugccugcgggagaagagaggugaauuuaaacuggaaaucugccucaaaagagcuggcaucuucuuagugguggggccgagcaccccgcaagccccagcagggcagcugugugcugggcccuuccuucuguuggugugagcguuaagagccuaaggcaacaucaagacaugcacuaacagcggugcgguggcucauaccuguaaucccagcacuuuggaaggccaagaugggaggaucacuugaguccaggaguuugagaccagccuggacaacacaacaacaccccuuucuccacaaaaaauacaaaaauuagccaggugugguggcgcgcaccuguggugccagcuacucaggaggcugaagugggaggauuucuugagcccagggggucggggcugcagugagccaugaucacacgacugcgcuccagccuggcugacagagugagaccgucugucucaaaaaccaaaacgaaaagaaaaaaaaacauuaaccucgaagggccuuggcuacuaaagaaaacguuugcuucccacguaguggcguggauucagaaucuucaaagccacggaaaauuacacacagccagcuggugucgcccccucaggagccacccagggccucugccuagggcuuucguauucucuuugucacaacgauagcaacaggagacucuggauuucccccaggaaaguccccaggcaguucagaaguugucuuugcaagacacuggcaggacagccucagggcuuugugcugucugaggggccucuccaggggcaugaguucugcuccgcuuguggaggugacaggagauccaggacaaagcccccggagccugagauaagacugccuugaccuucaggccacgcggcacacacguguggagggucagcccuauuuguuguagucuucaugccacuugauaagccuucagcccuucauaguccauuugcaaauuuuauuucuaaauagcaaaaccugcauaagaaauacaugacgauguccuaccccaaugcuuaaauuuucucaggcacauacagugccuagaaaugugauuuguuuaaaauuguccgcauaaaagggauucagugcccacucugugcucagucgggccauggucccggugccggggacaaagacacagaccucgugacgaagaaggucauggucuagugggguaaauggagaagcaaaaaucaugaguggaguggggcacgcaugcaguggugacggagggccuuggcagcccggagacggcccguggggcucagccgugggagacagaggccuccuggcagcuugggcuucccggcuggguggugaaggcagcugagagguuugccacgggacaucgagugccaaagggcauggcgccaucuacauaugagcagagacaugaucuggguugucgaaguguaagggagcagcuuggagcuuggggcggggugugggggcucguggucugggagucaaccucacacucugggcaaacgaugggcgcugacuuggagccccguggagcuugaugcaugcaccugucuguuucucgggggaaaggcaugugguauaaagguggagccaugacacacccacuuaguaggcucagcacugccuccaucuggggccugucucuuacucuagggcuugugaauccaaccuaaggcaucugagggagcauccccaaccccucagccuucccuucccuucccuucccuucccuucccuucccuucccuucccuucccaucccuucccuucccccuugcuaagcccuugcagcuccucacaucugcuugguccacagcuuuguggcucaaaacaauagaaauuccagcaucaggaaaccugccugcuccauccuccuaaugacugagguuggggagauaauuaggauuuucauucuaaagacauuccccaaagugcaugggaguaaauaaaagaaugggccauaccacgcagagaacugauuaugucagacccaaauugaguaugagauucgccaguguaccacaaaauaaauaaccccuaggaaucaaguccauaauaugaaaauuuaacuggcucaaccuucagacauccuuggugcuagugacucccaaggaaggacagagaugucaacagaauucuaagccugaccagcagcucuuccucccaucccagcccccuagccuuuuuuacauuauuggggugcaggaaauaugucuaaaauguaaaaggaaugacuuuugauuagcagccagcuugauaauuuuguuauguaagacacgugcauccuggugugggacaguguguugaaugacugcaaaggagcuucuguguucaggaccggaagaggaacaggguucaugaauugggccucccacauaucuaagcauaaaaugcucacuuaaaauuucagcgcaagagguuaaguuugauggcaaaguccagcucagugcagagagaccauccacaaagaccuccccaccuggucccuaggcuguuuucaguuuuggcgggguggguggguuguuuuuguuuuuguuuuuuuguaauuauagaagucugcaguguucuaagaggauagguuucacaaugggaccaaaauauccccaucugaccaaacacuggguucugcagaaucuucuccagaagauuaugucaaacucuagauacuaccuuuaaggaaacuaacaggaaauaaacaugccaugcaugccguuuugcagcgugaccuaaucagaagcugcaauuguauauuccugauuauaacaggagauacgaucaauuuaauuugugucugugcucauuuuuuucaagagacugaaauuauucaaaauuaaauucacuuauuagaaggagacucagggaguuagacuuaacaaguggugaccugugccaacuucaagucagaaaagcucacugugucccacaugcaccggugguguuguuuuugaugucccacccccucucaccucuuuaggaacccaccagucuuucccaugaaguuaaaaaugccucaccccagccaugagcucccuccagcuuccuuuagguccaucucagcccuuuccuugucuccuuuccccaccucccacccacuccgaugcuggcucugggcacugcauugccccagaaccucagccagguccuggcugcccccaagcagauggaggguauucagcucccuagauguucuccccacauccucaacauguuucuucuuucccuccaucucagaacaugcuuuucuucgcucucaggacucuccugagcuuuucuccaagcuuuuuggugucugcucucucuugucagauuccuaccccugcaccccagcaucaaguggcgguggggguuccgcacaccuuggucuuaggccuucacacucuauucucuuuccuuaggaaagcauuuuucaaacugcaggucucaaccuuugauugggucagaauauucacuuaaagggccaucauauccauuuccuaggcuggucugccauaacagugaacacaaaccggguggcuugaauugauugucucacaguuauggagggcagaauucccaaaucaaggugugggcaguguugguuccuucuggagguucugagggagaagcuauucccugccucucuccuggcuuccgguggcugccccggucuuuggcauuccguggcuuguggcuguuuuacuccaaucccugccccaucuuccuguggccuucuucuuugugucuuccuaugugucugugucucucaaucucccucuccuuauaaggacagaggucacuggaucuagaggccacucuacuccaguaugacuucaucuuaccuugaguacaucugcaaagacucuauuuccaaauaaggucacagucauggauaccaggguuuaggacuucaacauagcuuuaaaggggagacaauccaacccacacuagucaugaccaauagacuuuucuuuucuuuuuucagugaaauagaaucuaggaaaaaauaucagcauucauugcaggcaguaagguuaagcaucauuucauaaaacuuuauacacaugcauguauauuaauauaugugcugguuaauacauguauuuuuuaugucagaaaaguuuaugaaacuuaaaaaaaaaguggcggcagcggggacgcuuuaaaaaaaaccugccuccugcagccucugcucacggugcaccccucacccccuggucucucaaacaggagccagcucuguguucuguagccccacccaccaggcacuccccuacucccucccugccauggggccuuggcgccugcugguccuccugcccagaaugcucuucccuacccucuucguccagauuucgucucuccuucaaaucucagagcaaauauuauuguccuagagaacuccugccagagccaagcugagcccacuguuacauuuucucacaguucccauguuuucccuauaaagccaugauccuggcuuuugcagaaacaauuccucuauguaucuauccguguuuaucuugugugauuauuuuauuaauguucgucucuccuaccaugcucauagcccacugugguuugugagucuugucuguucuccauaucauaguaauauuaauauuccaauaugaauauucauauuuccacauuagcuuugugucuggcccaagugcucaauaaauguucacuaaaugaaucgaucuaaaugaccauugcaaccaugagaggaauauugugcccagccugagauuuuaaaggaaggaccuagaguggcuccagugcuugccagauagacagggacaucaucacucucuuguuguucacaaaagccuaggauugagcaccaugcaccauucuggcagcacuacagaugaggagacugagggucagaguggucaaguaaauugcccggugugcuuagauucaggcucaggcuggccuuacccccaagccugagcuaucacucggggguauguuucuuggagugaaggugcaagaaaccaggugcuaagauuaggccacagggaccaaauucacacgauuuuauguccggguuacagccuggaugugggaucccagaucucccuggacgauaggaagugugccuccuaagcguagguucuccugcucacucacaccgugggugggcucagguaagaagcucugggcagagcacggugaccccagcucuaggccauccuggcucgguggagucgggcauguguguuccccacugugaaucucagcucuuauugagaaaaugggcacagaaaugucagcuugcucagcucauagucuuauuccaaaaucaagugaaaggaaagcacuuugaaagaugugacgcugugucgugcuguggaggcauggaaagucccuguccugggggugcgugcugugggugugggagucugaggacuuggauucucuacucuccuucccggugaggauggccaugucauuuugcuucucuccuguaugacuagugcaguccccuuggcuguuuauugcuagagaggaacuuaguuaugguccccaggacugccaccagcccgggguucugcuuccaggcaauaagcuuuauuagcccuacgcucucaauuauccuuuuuuccuccuccaugggaagaacuaagaaauggcuugggaagcccccuugaggucuggugacagcugugacuuuauuuggggauuacucuggggcauguauagauucaucaaagcucccuucuuauuaaaaccaaggaaaagaucccucucacugccagggaccuccagccggcccuuccccucacagcuccccacucuuccucacugcugcugcucccuuguccuauuugacaauuaaaaccgcaucuuuagcaccuugaugcccgcaggcccggcucuccugaggggugggcucuuguauccuugcuaaucccccaguucucaaauacuaccagcaacugucaucuuccaccuacaggacaguaaagucuaucugagaauggaaaucccucaccccucagccuccuucaccacccaagggagaagcacugugcagggaggcggggagggguggggagcaucggggagggguggggaggagcagcauccgggagagguggggagcaucggggagggguggggagggguggggagaaguggggagcaucggggagggguggggaggggugggaagcaucggggaggggugaagaggagcggggagggguggggaggggcaaagaggauggggaggagcggaugcaccuggccucccaaauccagauuguggugccagcucuggaaacacagcaagucacuccugaauuacccaaaccgcaaguggaaaauccacugcagcugaguaucauguacuuuaggaugucugaacuuuaggauuucccugggaucauuaucauucuaaucauucugggaccugagagaaguaacugagucgggggccagcaaggcacagacacugaugaaguucagccuagcaguggccaguuuuuuuuucuugauacagagucuuucucugucgcccaggcuggagugcaguggcgagaucucagcucgcuacaaccuccgccgcccagguucaagcaauucuucugccucagacucccaaguagcugggauuacagacaugugccaccacgcccagcuaauuuuuguauuuuuaguggagacgggguuucaccauguuggccaggcuggucuugacuuccugaccucaggugauccaccugccucggccucccaaagugcugggauuacagacgugagccaccgcaccuggccugggccuuccuauuuugagggaaucaucccagaaugagaagaacucuguguagcugggaugugagaagcaugugcagagcuugagugggucaguacaugcuaggccgaucccacugugagcauuucaccucugcugggggacaugggcgcaggggguguuuguguucaggggggccaccucuuucugaugccacuuuccugggcuuguccaaccccugcuuggcuggaaggggacucacccaccugcacaucgagaaccucaccaaccucagaggaaagauuagaacagggcuucaccacaguuuugcuuucugugugucccaccccugggaaaugcugcaaggacgucagccugccaggucacccugcagccaacugcauccuuucccagcccuggccgcagcagcugcugggaucccuuugucauuagugcaggagcaaaaugggaaugggggagccagcacuacaagccuccaagcaguguucaggucguguguuuccugggcaauuggggggcgugaguuaugcagggcgcuuuccucucucccacccacccaaguccaguagcuuugcugccugcgugcuuuccccaaccauggacgggccucuccuaccauggccucaaugcugggccgucuccccagcugagaugcccccuccuuaaccgagucugccugcaucagugcucaccugguuuagggcugcgcuuagagcuagcguguccugguagggaguggccuaggcuccaguuccuuuucuucaccagcacugugggccaaggcgcauggccucccacgcaccacagcagagcugccaggugagauugaucuucugugguugagaugaucacucuuggcuguagcccacucaugccgugagugacagacaggugcuuagggcaccagagucuucucuaauaagguggcagcuggccgcgguuguugauuuaccggccaggaucuucgccucaagaaccacagugcgcucuucuguaaucagugcuuuccuucucacaucuccugacacgaggaugagcagagcaggcucgaugacacagcugcucaacuguaauccuguaugauaauuuugcaaauuauuauuuuuaauaucagcuuuuuccuuaggcaauaaaagaaaaaguuaaauugcucacaaacuaauaaagguuuaucuucuggagcaucaaauucuguuuacucaugaaacacacaccuccucuaugcacccaucgagaggaaaauuagcauuuauuuucccugauaaacaaaaacaguggaagauuuguuggcaucuuuugguguuaagcccuuccuuacauuuaaaaugacauagaggaaugcaagaacuuuggaagaggucugcccugacucuggauuuaauuuuaacuuuggaaagcaaccuguugugugcaguaggauguuauguggugucugcagugccuagacgcuaacgacaugcauggaaccaagcucccccuugggcccaggagccaagagauugaagaaagggaaaugcuuucaugacucuccacaaguuccuccacguucccaccggggggaagauguuguguaacccucagugaugagaaagugagauuucccccagcuagauuccuccuccuuugauucauuuugguggcaagagaaguugaagcuuugacacucucuuuauuugccucagugcuagaaggcuuuaauugcacuuaaaaauaauuccaguccgauuuucaaaugccuuccggagugauucagcguuuuucuuuucccugauuuccagguacggagauaugaggagacagauuggcuuugaaaucagagacaugugguacaaccuuggugaguagccuggaugugggggcauagugaauaucuugcaucccuggugggucauggcacuggccguguucaucaguguugggaugucuuaagaucuuaauggcuucuguuccuuggacagcaguugcuacucuuuguaguaacuguuuucaggaauuaagagauagaagaccaaaggcaaggaaagaaaaucucacggguggggcaaaaagaaaaauccacagagcacccucuuguguuguguggacacguggcuuggagcuccucccucccugguguugccucccucccucaguugccucaguuccuucugcgucaaauaggaagcucauccugcugugacauuugccaucacuuaccauauucaguuuuacagacucugccuucuaaaggguuaauuccccuccucaaaaccagaucuaccugguggcagccuaacaugcuccugcacucaaagcagugaagggucuguguguguauaugaaauuaauaggaguuuauuuguaaauuaaguaauuuuuuccaacuacuuuuaucaugaacaguaagaauaaauucucuauuaaaauuuuaaccaaugugacauguaauucuuauagauaagccccuucaagaaaucaaugacugacaauaacuugguaucuucccagcaucuuuacacuacccucuaggaaucuggccucacuccucguugagaugaagcucucucuggcuccugccgucagcccucgggcuugcuuugugccgagguguccuaggccauggggugcugguggccuugccucaguccugagcaaagcaucaguugcuuuucugccccaggaucuccaggccucugcuuccuuccuucaaauggacacgagaagccugcauuggccuguugcaagaaacccuccacucuccccucuaccucagagaaucuuuuccuacuagaaggaggcaggggucuguccgcaucacucuguuagccucguagcauuaggguuucacuuguugcaccaggguugggacaacuuagcugcaccccagccugcuuacuucccaagcagcugugacucccugcaguggcuggagagcauggcaagaaagaagcagaacccagcgagccacgcuucacuucuagcucacuguuugcuuuugcaucuuccuugccauucuuugguuugacaugaggcccaguuagguucucaggaauggaaagccacagcagaugcuccuggguggggaugaagagcgggucagaguggcccugucugccugugcccucccaguacaaagagaaccugcaccauugcauccuuucugcgugucaguccuggagucaguggaggacuccucgaggaagcucugugcuaggucucugcacaugauuuugcugcaguagcuccuauguccagaaucugaguacugggucucagcugucaaagggccugcugaucucugcaacaugauaccuaccaggcaccauccuguccuuggccuuccugccaucccagggaggaagguaggggcucuaggcucagagucaagagagaugauaagucccaccuugaaguuuucauccucucccacuccugccuccccgugaggccugauucacauggcucagucuuucugggccguuagauaaagugguuggacugaauuuuucaagagccuuccaauuccaaaacucaauaauucuaugacauauauauacgaugaucucaguaauaacgugcuaaggcuuuuagaacagggaggaggaccauccgugauucauuccaauugaucucucuguguucuuuguuaaaauccugcucugacagaugcaucugucauuugcucuguuaggccagacggcaggccccacaccaggcagggacccaguguggucccaugagagagagagagaggcaggagacgggggagggcuuucacagcaauggcauggaggggggcuguucucuguuggaacucagugaguccaggacuuuuauaggcaccaacguucaugaaggaggugauaugagcuccaccugccacaguugggcucucagggcagaccccagaccucuucucuggacacaggcucucucugaggccaucuuuuacccuggccccuccuaaaagagugaguccauuuucuucuguguuguuccauuucaacucuaaaguauagacagggaauugccuauuucccccaagaggacacuugcacauauacuuucaaaugaagguucucauucuggaauggcucgguaacauuucacaucauuuaugauaauuagagacaccacccuagcggagggucugaugggucauuacauacugaaaugcuuccuucuccccguacacaacugcagccaccauuugacucacccuggccccugagcacccccaggauccuccacugcucuccaugugccaaggucauugccuagcaccaagggagccucuaaaacucagcucgagccacagcuggccagaggucacccugacugaugggugcuccugccuuucuaguuuucugauuugggauuguuuuuguuuuuguuugcaaguauaguuaaugucaccucuguagucccugagauugaucaccacugaaaguggcuccauuucaauuugugcuacgugccaugauaacaaugaaggaaggaaaggcgggcccagaaagggugaguuucuccgcgugcccucuccaagugcuugggcaggccuggccuucugaggauacacuugggucugacacagagcacuugguucucuugacguuaucugucaugcuccagauaggccaagucaagcgacaggagacuuuugauuuggaaaagguugcagugaagugagcaagcuccccccuucccuccuaucaguggcugauuugaauauggugauuaaugcaugagguguguguuuugcagcuuuuuagccaggaacacugacuguggccugagaagcggccaagaggucaaaaguaaaccaaagccaauuagggucagggacuuggaaacaacaagaaguaacagucagccaccagacuuggguuccuugcugguaaaauaaguuaucuuucaaagugagggaggugaucuuaaaagcaccugcagcccacaggauccuccccaagcagccccucaggauggcuaaggauagcaccacgggguggccuccuuccugccauggugccaggugccugagugucuuugccaaggcugucacacuccaaauuuaugacagcacaucucaguuucccaggauguauacaaccuacuuucuacauaguuuuuuuuuuuuuauuuuaauuuuacuuuuuguaaaugggugcagguuugggaacauauuggcaggaugauagcaccgacucugccaagaaaauagaaauggaaaucagaucuauuuaucugcuuacaauuaauaaacugucacuugagcagaccuucagcugaaugcuccaugagucuccuccuucagucuuuccaauaguaugcauggcccauagagaggagcaucucagcucuugccuccuccuugcccagccucagagcaaggaucuggggucuguuuugcucaauuuaaugcaagggcaaacauggcacugccccaugggacagagugauguguuucuuucccucccaaaccugucauauuuugagucugaaaggggaaaucaaaagcaggcucucucucaaaagaaaaaaggggggaaaaugugcuuauuuacccagcuccugaguuauuuaucaaagcgcacucugugcagcagccugccggagcaccugaucuccuugccugugccgccucaauuuacauuuuguuuauuacauccagcacacuggagcgagcacuagaccccagccagccagaacgaaugugcuuggagcaagaucuuuauccaccgcguuggguuugggauauuuuucaugcagggauucccuucauggguguuuuuuggcgacugggcaaauugugugcuuuucauuaaaacccguauacauuguggccuaauggguguggccaggugguggaagcuuuugcucugccugcucuuguguauacagagauuuuucugggauaagucuauguuuaaugucccagauuuuugaacaccagugauugcaaagagauaauuuaaacacccacagggaggcuucugacuagggaggccuuggcuucgugagaaaacaagauguuguucccaggggaaagagcuccacguucuguaacuaaaauagacucuagaugggcuaugagaccggcaaggacuggaaguaaaauauucuccucgucaccuuccuuuggcucaaaaguguguccucuuuuucuuuaagucuacacugcaggagucaccuugguccucauugguuccaaaccugaguucaucauuaaauuugagcaagauaugcuccaggggaaaucuauaaugcaaaugucaaaaaaaaaaaagguggcuaccagagaacauuccccacccacuccugcucaccuuggggaccacugguuuacgaagagucagugcccagggcugucacuauccauagaacccaguaccagcuccaggccagugugucuucuguacuaauaaggagggugauaauaaaagguuaagcuacugucguuuugguagcuucuuuuuccaaucccugcuucuacaaccacuugugacugcuuucuauguuuuucccagcuuggaacaauaaaaccuguuggugacagacagaacuuuaugacgcugaaauugugguugaugaacaacucgcugucaccaucaucuguuuucugaaacauuggcucugacauuuuuuaggcauaauacaaggaaagugucaccugagagauggaauauaauagcauuuucaagagaaugcuuugcagcaguuacaggacuuucagaaacauuaagcauuugggaaaguggugagaaucacacaaugauagccuuagucaaaauauuaauuauuuaguaaaaguugaaaauaagauguuaauuacauuuuguguguauguccacccaauaaaaaguaauucagucuaauuaugaggauuacguauucucuuaaguaucguuauaguagccacauuucuuuaaugauucucuuuacagaaauguauauucacugaguugcaaagaaaacuaaagaauuugguuuccugauuguguagaaauauuaauaagauugguuaauucgggauacauugcugguguuaaaauacugcacauauuuuauucaaacauuuaauuucucaggcauucuucuguuauauguuggaaaugaaaugguuuuaguugcaguggggugaaaugaaaacaaaaucaagauuucugaaagacaagagggucagcuuuuaaaagaucaccuuuuugauaggaccugccucugaguuucauuaugucaccuuaacuaagguucgcagccccauuuuuagaaaggagucuuccaggagcuucauuccagaggugcaguguccaggcagugaaagaagcuuggcaguugcugugguuuccucccucucccaucucucugaacuugccugguucacuucaagcucuuuaggagcucacccugauccucaggaguaccgcagccacgcacccacaggauaugggguccccggcuggggugagcacaauggcggccaacccacaacuagcaggagggggaggggcuggccaccacaucaggcccagcugccagcugcucugcccagucgccagauuuccugauggugauccugcgcuagcaucuuucuaagucagcgacagagacccaggaagguaugauaccaagauuuccaacaaaaaccauugaaauuaaaaacauaaauugagugcuugugagaagccagucucuaccuucugggggcuuauuuagcauugugaugucucaacagugagggauaaaacgauggaaaaugacagaucacugaccucucuguucauuuugcaauuaggggggacaaauaagggaguggacagcucaaacgauuucucuuucagagagucggguaggguccgagugccaugcaaagauccugagacaagcaaacagggaaggaauuuguaaaaugagggucacagcuaagccuucauaaucucagacccagguucaaauccugcuucuccacuucucugaacagcucacagaacagcuuuggguacagcccacuuuccucgucuguuuaacagguuaagaagguaaccaucucguaagguuaccgugaaaauucagugagaugaugcuuuaucuugagcuugucauguaaauuguaaaugcuaacuaauaugaucauauucaguauuauucacauuugaaaaacuuuugagaaacauuuuucugaguucuuuaaaaaucauaucuggaacaagauaggugaaaugagauuaauaaaguaguucuuuuuuuuuuuuuuuuuuuuuuuuugagacagagucuugcucugucgcccaggcuggagugcacuggcgugaucuuggcucacugcgaccucuuccucccagguucacgccauucuccugccucagccucccagguagcugggacuacaggcgcccgcuaccacgcccagcugauuuuuuuguauuuuuaguagagacggugucucaccguguuagccaggauggucucgaucuccugaccucgugaucugcccgccuuggccucccaaagugcugggauuacaggcgugagccaccacacccggccuaaaguaguuauuuaaauaagcauuuuccuaucaaacaauagcucgaaaagguagaaucacugcuguuuuuaggguuucagccucagauuccggcgccuugauuuacuuugauuggagucguuuggcauguugcagaaaucacccugcauuauuuacagaggugucagauagcaaacucaucuucauaagaugugggagauaaagaggacucaagagacuaucugcucucucucauuugucggcuccuguuccugucgcugugcacagaguuagaggcugagacccccgacucgcagccccugcucuauucagaauugggaauuagcugcauguguucugaaucugugugauggaacuggcuacuuauaaaacaguguucaucuucucugacagagaagucaugauuacaggcuuauaccgcgcggaucuuugaagagcuucacuuauaacauguggaauacaggccacuucuuauacuaauggcugggaaaguucaaaaucaucaucugcagacgcgaaauggaugcacauuuucgggauccugcugcucaaagucacagugaucuguguuguguuguuuuauccauuuaagcccauuuuagaauucuauuuuucuuuauuucugaauauuguaccucuuuuuuccaaggucaacacaagauaaaguucauuccagaaauggugggcccaauauuagaaaugacauuaauucccgagacggagcugcgcaaagccaccauccccaucuucuuugauaugaugcagugugaauuccauucgacccgaagcuuccaaaugguaaggacguagaugugcagcgaguggccgggggacaugagggaggcaaaccugaaaaccuucaaagaaaccuguagacaguucuagaguuaaaggugccaacguggaaaacacauuuuccuacagcuugagagagaaaaagccuaugauuuuccuuauugaagaagcuuaucaucccuugcacucaauuuuugggaggauuauucucaauuuuuagcucuuacuuacuucuuuuaaucuggguuuacuuacacauugcacccuggauaaaagucucuugcucccacuucuugguacgugcucuuguagagcguuuaaucaaauguuauguguuacauucucucagaccggcugcuuauugcagaauugugguauuuugaaagcuaaagucuuugcuuuuauucucuuaagugugugucuuguucuuuugccugugcaauggaacugaugaaaauucucuaagaaaguguauauaaagugcucaaaacauacugugacaaacagcaugagggacaaacucugcugcauaacuuaugcucaagaaguaacaaaaucuccuucuggaucccaagaaaauaaguauacuguuuauguauucuuggguuggcacccacacccacacauacacacacacacacacauguacauccccacacacacacauacacauccccacacacacacacauguacaucuccacacacacauauacacaugcacauccccccacacacauacacaugugcauccccacauacacauacacauacacauccccccccacacacacacgcacauccccacacacacacacacaugcaccuccccccacacacacacacguacauccccacauauacacauaugugcacacauacacacacaugcacaugcuaugacuuucuccuuaguguacuaaugguuuggccaugaugcuuugcaggagaccugggagaagcccaaguacuagggaguccucugaauugaaagauaccuuuuaaaaaucauuauacuggaccggaugugguugcccacgccuguaauccuagcacuuugagaggccaaggcaggcagaucacuugagcucaggaguucgagaccagccugggaaacauggugagacuccgucucuacaaaaaauacaaaaauuagugaggcaugguggugcacaccuguggucagggaagucaaggcugcagugagcugugaucacgccacugcacucccgccuaggugacagagccagacccugucucuaaauaaauaaauaaauaaauauuaaaaauuauuauagcaauucaaguaagucaacauacuaagcauuuuacauagauuuuagaggaauuuggagaaaaauuccuauaaugaaaggaaaucaaaacuucaucaaucaagauagcuuaauguuggugagaucuaauauuaaaggguauauuauccuuacccaccucuacaguuuaucauuuaagggagcuuugaguaguuuauagauuuucauuggucaucuucaucauaucacaugaaggcgguauccacgaagaaugauuuugcuguuuccuagaacagaaaagagagauacgaaaccaaaacagucuccacacugugaguugaguuuagauacugagggcagggagacugagauucacaggcuuagccagguauuaucuggguccucagcaaaucacucaacaucuuuuaagucuccaauucaagcuuguaacauuggcaugaaauagaaucuaccagaaaggcguguugugagaaugaaauaaaaucagaccuguacaaucccuagcacggugccuggcacuauaaaagguggcuguggaugcuucucuucucucaaggccggaaccucccuuggucuggguguuuguggagugcagggggcagccugcagggugagcccccagugucugcaggaccauggggcccaacgcugcauacaaaccugggcauggccauuucgucaggguuguuccggaagccggggaggagcacacaggagaugaacagagucugacugcuggagccguuuccuuuaaccucuacacacccacagcugugcuugaaaacccauugcagaggagccuaacaccuggcucggagaucauuauuuguuuuuugcacuuugcuccacuaggcaguuuuuuaauuuuuuuuuuauuuuuuugagacggagucucgcucuguugccaggcaggaaugcagugacgcgaucucagcucacuacagccuccacaucccggguucaagugauucuccugccucagccucugaguagcugggauuacaggugcgugccaccacgccuggcuaauuuuuguauuuuuaguagagacgguguuucaccacguuggccaggaugaucuugaucucuugaccucaugauccacucgccucagccucccaaagugcugugauuacaggcgugagccaccgugcccagcccuaggcaguuuuuuauaaggugacuggugacuguuauuuucacauuauuccaaccguggacaguagagagggcuuuaguuuaacuuccccaguguaaugucaguuggacuggaaugagugguguuaguaccuccucccuucuuccuuccucccucccucccuuucuuccuucuuuccucccuuccuucuuuccucccguucucucucuuuuuuuccaugauagcagaaggucucccuguauuuauuuuuaauaauauuaaagauaauucauuuuugaaagaacagcuguuuuuguuucucuggcucacugucagucuguguauauacaaagucuuuguauaaagacuguacuaauacaacauuguaaauauuauaccuagauuuuuuuuauuaauguucuuucuguuugauaauauaucaaggagcuuucccuuaauuacaacauagcaaccaugauauuaaugauggcauaaaauuaacuaucacuuucuuauccaucgccuauaaaugggcauguaaguuguuugcagauuuucacugcugugaauaacugugcagugaacacauucaugcauauagcuugaauuuauuuugaaaauuuucccaguauacauucuuauaaauguaauuacggauuucaaauauuuuuguaacuuuugaaauuauugccaaaugguuugauguuaauacgauaagauuugccccaucuccauugcugcuggcacuauaucauggccccaguuucacugccaacucauuggaacuacaaauuauaauuuaaaugcuuuuuccuaggcagaaaauucauuugacuuuuugaauuuuauauaaaucuagcccaaagaaggacuuugugaaaaauugcuauuaaagaaucagguuaagggggaaaguguauuuauauagauaaaugucacuggcacagaaaacuaaggucaaaaguguuuaaaacaucauucuauuugucauuuuuuaaucagucuuugggucaaaauaaggucaagggcaguuagaauaaagaagaaugagaguuugguuucugaauuguuccccuuuucccucacauucuuuugucucauggcugccuugugguaguuuaaaaaaucuuacaacaaucuucugaggaagugcuucauuuucuccaguuugcaggggccccagguuugcuaggaaaugguccgaaguuaacgagagccacagaauuugugccaccauuuuaaacaccgccuucccauuggggcuucaacauugacccagcgucaggagacaucuuuccagaaaaccaaauuguuuuugaguaauaucaugaaguaauuggcacauuuaguuccaucucauaaacaacaaacuauuucacuagcaugaaacaugccgugcuuggauguauguaaauccaagcauaagccugaagacacagauucacccacaagaaggacccacugucaggcugagcguggucagcuaccugaacuguugguucagagucaccuguuucucuguguugucaucugcuugaaccucugcagacgagggauagcguacauuaaagaucuuuaaaaugagggcagaaaaacuaacccuuguuuuaaaaaaaucccucuuguauguuaaucugcuucuguaauugggaaaagaucaguuuucuucuguuugaugugcccaccucagcuucccagcuggaaucucccaagccugcagcaucauccccuuuucugccagucuccuugucacuggguuuuccggcugcgggucaugcuggacuggccuuugcuugcuccccuggccuccguggcagucgguugugaagcuucaucaguccucccucugucucaucugcagccuccguccucugcgcaaucaccauugcacuaguccaggauuauuccugggccacaguauuugucucuugacuugcucuaucuauguuuucuaaguccuuucugacuccaguuccaccugucccucucagcuggucuuccuaaagcacaagggauggccccuauugucggugaugugggcgaauguguagaguggacauguguguggcacauuggugcaggguuggccccaccugcuucuccauccacgagcuucugggauggggauggucggcugcugccuaacuccucugccauaagcccaguuaccucaccuuauuagucacgucagcaggggcuuaaguuuuuuuuauagcuuuuauagcagaugugcaaacccuacuggaguagggggaagauauuagggggauuuguuuuuacaacacuuuaguguuuugaacccgugauagagcuuauguuuuaaagguugcugugucuuuuggaguagagcugucaauaugcuacuguuuauggaauaugaaauaauauauauguccagguguauuuuacucuuacaauuggaguagagaggagaccugcuggauucagaagaaaaaccugcuauuuuacucaggauuaaacugcaccaaaccauuacuggaauuuuaaaagcauguguuacaaauuggcuuuucuaacguugcccggaguuucugcucuugugcucgugcucuucagccgcaguggcgggcauuucauuagaacguucuuucccuuacaccuccccaagagccuacuccuuuccugucuccacuugugcaagaaagagcacaaauguuccuucggaauaggcucagccuugcccuuauccugcuucuccaggguccauguguugaaugggcucucuugguggcgggaugggguggcauggaguuauccuuucaugggccauguccuccuuguggccugggacucucuguccagcgcugcagugagugccuuaggucagcuugacagcacucgcucuggggagguggcgaugaagcuccacaaaaggcuccaggcugaaggucccugaugcuaguggaagccugcugugaagugucguguucugcaggagcugggccagacagaagccugugagaugggaggccccagaugugcacagcggccuugaauucuuuuuagaagucccuccuaccuucaaagucauaugcuucacugugggcuggguccauagccauagagcuccgguccguugacaggaaggcguucccagcgacuggacgcugcaugacgcucuugcaaucucacaccucucugccaucccaucccuguuuguguacggccaggaggcugcugccugugggguuucuuuuccuccuagugcuugcaguguggauacuccaagccaggggagguggggauacaugugggaagccccaguggaugcccacugcagccaugccccugggguggcccccagcccuguggccacugucagccacccccuccaucacugggcacucuugugccacuucccugcccuguccauacucaaggccacuguggacaucuggggccuccuaucucauaggcaucugucuggccaagcuccugccagaacauggcccuucacaggggaaguuccauuagcaucagagaccuuccgucuggaggccuuggcagagcuucaucaccaccuccccagagccagcucugucaagcugaccuaaggcacucacugcagcuccucaacaaaaacccauuucuuauuucuucugccucuuuugucucugggugcuccagcugucuguggucauccuggcucuuccagcacuuucuaugaaucuuuuaugauccggaugccccagccauucuccuaaaucauccuccccugcugcuucuuccuguccuggugccuaagggcacauucucugcccccuuuccuuacagcuggccaacuccucgagacaccaccacagcugcguucaucccacccccucgcccugugcccaccccaauccagagaguagcaugcuuaccccuaaacucaggacucuaggaaucuccauuuguuugaaaggagagguccuacuugggaagauuucaggacugauaagcuggcaggggaaauguggagaggcauuggggucuucgcgccccuuaucccauccaccuggaugagccugcccuuggucacaggagaugagcccucuccuggccuuaagcugacucucccugccucaccaagaacccugcccucccguggaccgcacuccaagucucacccucauacuggauuuugcuucauaauaaaaagcauacuuuuaaauucccuccuggcaucuuuuuaaagaauuccauuuguuacgccuuuggaaaauacagaacuaacagcugagaauugcagcaaaugaccauaugggccauagaccauuaauaaaaauggaauggaaaaagcugcccagcaaaaauaauauuuucaaucauggagcuauuuucugucaucuuugugaggcucaguaaaaugcugcacaacuuccagaaauucccauuuaguuguaacaguauuagaacaugaauaaucuuugugucaucaguguugccgagcuccuguuugaauaaucucuucacacugcccaugccaguaaccggaagccaguaauugaauagccgggugaaugucagcggcucugccacuugguggaaaggccaauguauuuuccacuguaauaugaaugugaaugaguuugguagcaauucuaucuuguguauucuuuaauucauuaggauuuuauuuguugguuuguuuauuuuugcuuucaaugucaaaauaauucuugccuaaagaggaaauauggcacaagaggcuucuguuucauugaauccagacccaaagauggucugagaggccauggaaaccaagauccuugacuccaggagcugcgauuauauugaauuucauucuuaaaagcccuccagcaaagagauucuuccauaauccccuuuaaccagauuaaacaggacuaauuuugaggccauguucccagaguccucuggaauugcaugcagcccuaaagucacucuuuaaucugugucauguagacauaaggagccgcugcaccugucucaggcaucagcaaggugucauggccugcgaugcagccaugcauccccagccaggcagcuccaagugaguggcucuggguccuccaggcucaugaguguuucacaggagcuccaaggucagcaagccccuugcuugacggacguaggaggauguggagguuuuugaaugugggaugaagugccaccgauuaauuaguguguaauuaaguuuccagagcaguuaggcaagaggaaugcucuauacauaaagauaugaaugugucugagcacagguacucaaggcugagugauggaucgggagggaccagucacuuguaggaugucagcaugggcgccuagagccccaaggguugugcggugucacacuucucucugcugaaccuugccuguuucaucuucuuaaccauguuuuccacccagauacaguccagcaacuuucucccacccaccucccccugcacaugcucaggggguaaggugugguugcgcaguuucaucagauuggccccgacccagggagagaaggcagagagagucugauuccuuggugcccucugccugcaguaucuucugagcauuucuucuuuaaauacaggagaaacuagagcacucugggcaaagagcagcauuguacuaagguuuauuuuuaaagggucaaauaagcccuucugcuaauguacuuagcagaucauguccauagauuucagaucucacccggcucuugauaaccucggagcccuccaucaaggcggugaguggucugugcaaaccuuuccacccuggcccagccuccugcugcgcucccacagaacccuagagcucuucugguauauaaagcaugguccuggaugucuggcaagugcaggcugauuuuauacauuacagauguauaaaauuauagaugcauuagaguaagaauaguaaaucucacccaaaacaaaaauuaugcguuccaaaccaaauauaauuggcuuuuggauuagcuacuacugggauccuucucuccaugaucuuucaaauaggugccaauagccuaugguuagcuguggcagugagugguaaaagcaguguuuccuuuuuaaguuaauugaauuaacaagacgucaauaucgcuucgagcacagcccccugacuccgucacgucaauuuaacagcaacuuuccgaaaggccuucuauucauaaguguucucuuguuucauguucucagagggcugcugguaucagacacugagagacucucuguucaguauuuucaguuggacacccugugaauauuuuuggagcaauauuagugauucagaaaagagaagaaaauauaaugguuuugcuuauuacgugagugagccucugccaccuuuugagcaacacaguaaacccuugcuaauuuuaucccagccauagagaaccuuguugcaaaucaccagacaaugugcauuuaugaggaagauaauaagcaugauuuugauaaaaccagcucugcucuaucagcaaauguacuaucuccaauuuagugggacaggaucauuuaauucugauuauaguaacaguucauagcacacuagcgaaucaauucgaguguauucuauaaaaaugaacgaggauccuggaauuagaggcuaguuguggaucucugguacugaauccuugcuaauaaacagaucaggguggccagguguuuguguaaauuacuuaguuuggacuaggguuaguaaaauuagaaucagcuguguugugauuuacuuaccacucauccaccuuuguuggaaaucauuaaguucaucagucagaauuugaucagcagcauaccuagguagcuguagcuuccucauugccuguguuugugacagcuagauuuacauggaagcagagaaaacaugccguuuucauaaccuacacucuguguucagaucccuuuggcuugaccauugaugggcauuuuaaaugccuguauguuugcccaugucaggagaaggcacauuucucugcauucucuguaccuuucuuguugucuguacucauuaaacauacaugaaauugaaucauguuuugauuaaauuuaauuuaauuuugugucucuauuauuuguccugaagcaucagcccucaucaaacauuuaaucuuugaagucugucuggaucauggcaccaucugggagauggcacugccuugaaaugccaacuuuugggcuacuaccaagcgaucucccuuguaugugauuccaaaaagaacuaccuuuugcagaauucuuuucuguaaagggcaggauagcagugguuaguaucaaaagguuguuauuuuacaguaaaaaucguuaaugugagauuucaggagaaaaaaaaucuaaagcaauucauuccuccuucuucaauagaaccaucugucugugcugcuaaaauccuugaacuucuuaggccagacagaaucaaaaagaaguguuuauuugggggaggagaccauggagaagaucaagaagaaaauuggagagauucacuaagguccggguucuggggauguugcugaguccuugaugucaggcaagaaucaguacuucucuccagcccugaaagccuuuguuucaucuguagcuguggcuuugggcaguguguacugaucgaggacaggcagggcgucuguguccauuuggaggccccuccuuggguuucaccguuccuugcuaauugcuucucagggguccacagucagcugcuccugcaggggcauccccaagucucuggugcccacagugucugucacaggcacucuggaugagcaguuuucacgacugggcuuggccuggccaagaaugcagguugugauuuaucaacccucuagaccgcuccuuugcugacauauuaagcccucuccagcuuuauccagucuaagcacuuuaauccaaucuaaguuggucuaagaccaacuguauucaguaguuuaugugcacacagcacauucauuccauuagagcaucaaaggcacuguuugagguuuuggggcuggcuagagcaaugaccaaagaaaaauucuuccucucacucagcuuaaauuccacugggauccuaauaacagcaggcggcuugagaauuguugccugagaaaguaggugauugaacauggcuuuagagagauccuggagacccuugcauacaugcccauggcguacuugcuuucugaacccuggauucagcuuucuucaauucuuccuuuguccaucuuccuucaguuuagagugugcaugucucaucuuuaugggaaugaacaaucucacagccccuccuugcuacuggcacaaguugaugguaaccucagggcccccugcagcauggcuagucaccaggccggagucccaguacucagauggcuaugaacucugccagagauggggaacugggcagugaggauggggaaaacauguccauuguuaucgagguuuuuuucagccugaucagacacuugaagacauuuuagagauuuccaccccccagaauuuagaguuuuucuaaaagcauggaucugagacauaauuagcugguacuggcgacccuucugcacccugauucccaggaaauuuaaucagaagcuuuggggauggaggauaggcuggagauggaccuucuugaggugccugcuggucugucuuuagggacauugcuccucuugcucuuuagaacauuuuuucagccagagugagguauuucacuaggaucuaucaaggaauggcagcuaaguggccccuaggauguuuucagauugccgagaacucuucacuggcaggggaaacaccaucuguucauuucaggaaccaacaagcuauuuuagauguuacguguuuguagagaugaaguuugagacuuuuuuucaugcugcgcuuugauuuuuuuuucccccuaugguuuccuugucuuucuuccccugguucuugcuccugcuaucaggacgugcagguucaggcuccauuaaccagaaaaggaaaugagaggucccccuauggcaagggaucaucagaaaccuccagggguucuguguuggcaacucuuaaaugaggcuucaaaggcagaggguagccaucuaugaugaucucucuugccgauuuauguucuauugacacucaagucauaaaaugaaauacucgccaugcugauuauuuacgcuuccucuguuuaauuauaguuugaaaaugagaucaucaccaagcuggaucaugaagucgaaggaggcagaggagacgaacaguacaaaguguuauuugauaaaauguaaguguugauuagcagugggauuuaugucugagagauacagagacagagagaccguaauuagacuacaaugaacuuuguaacccagaaauaauuaaaauguguuaauaauggaaaauaguuaaaauugcaccucuguugaguuucuuuuucugagugugauuaacaagguguguauaauuauuuuucagccuucuggaacacugcaggaagcacaaauaccucgccaaaacaggagaaacuuuuguaaaacucguugugcgcuuaauggaaaggcuuuuggauuauagaaccaucaugcacgacgagaacaaagaaaaccgcaugagcugcaccgucaaugugcuggugagugaaagcuuaaucacguuuuuucaguuuucacagcacaccagaaacugaagcggggauugccccagcccuuaucuaugacagucagccacgaagcuuuccaccgcagaacaaucuccuucgcuuguuuccucaucugcugcagggaaggaaucaugaagucguccacucugaauaagucuguaaaauugucccaucucuggacguuuuaaugucgcucuccuugucguugugaaugaugacucaccguaucuugcagccaggguagugccucauggauuacggccuuaaggcuuugugauuaggagaccauaaacgcgugcuauguaguacauaggcugaaugguggccucaaagguagagcaauaccccaguccuuagaaccugugaaugagaccuuauuuggaaacaagaggcccugcaaauauaauuaaaaagaaucucagaugggauuauccuggauuaccugcaaggggaggggagagguacuaacuccaaugacagguguccucauaagagacaaaagagaagacacagaaacaggcuagaccuugugaagauggaggcagagauuggagggacccagucucaagccaaggaaugccuggagccaccagaagccugcggaggccaggaaggaucccccccuagagcuuucuaggggaacguuguccuacucacaccuugauuucagauucuggccucuggaacugugagaagaaacauaucuguuguuuuagguuuaugguaauuuguuacagcagccacaggaaaccagaucugggcaccauggagaacagacgccugggcgaccuuggcugcugccaucugucugccuuuugcauuccugcuguugcccugauacagcuggguucuguggacacccccuuccugaugucauuguggucccuaauccaggaaauccauuaguaccaaugagcuuuugggaagcuuuaccacaagcucagaucccggccagccucauggcucucagcagcguugugauucccacagccuggcuccagagcucucugcuucucccuuugcugcuucucuuauaaagaaacacaagggcugacucguggccauaguagggcuuuccucaaguuuccuugccugucccauggcaagaaugcaagaaaacacuacuccugcuuugcucuacuuaccucccuucucugcccagccacuggccucaggauuucagagucgccaacaacauguggauacauaguccucacugccacauccaccccuuguguggacuugugggugcuuuaugcucauggaaauggacuuucaugccaggaggaacaugacacaucauucacucuuuaaaaagccagaguuguguggauuaaaaagauaaacgaaaaggaaugcuuucacuuuucaucgacuaugguaucagugcuggaucugugcuuugccaugaggaacuucacagcugaaagcucaugagcagucuucgccccuucauugcauggcuggacagcuuguuuaggcuaaugauaaacauuucuguaacaaguuuucuuuuccuuaaaaaucuaaauauaggggaccaguuuuugguccagcauguaaagagcuugcaaauugucacuccuguccucacaacaagaaaaaagcugaacaaauugaaaacaaucaacaauuauuaguuccgucuucuuagaucuguagauaaacuucugaccccaaagucaaagaaacaggaggauacagagaaccacagaguggaagcccaaacagaaaccaccacuggagccaguacuagauuccuuuuacccaguccaucauauucacuuucaacgcauuaguacaaugcacgcuaaagacaaaaacacagugaaggggcagagcaggcauuagaaccagacucugauacggcagagguuuugaaaucaucagaccugcaauuuaaaacagcugugaugaauauccuaagggcucuaaugggaaaaguagauaaaacauaaaagaagguggguaaacuacguagaaacucacagaaaucaucaagaagaaauucuggaaaucuaaaacacuguaacagugugaagaaugccucugauggucucaucaaucaacuggacacagaaucuguggacuugaaaaaucugaauguuugcagaugcaucaugugucuuaggcuacuguagaaauuacuggucucugaugucuggcccugaggucugggcuguggcuguguuugucuuuauauucaccuggagacugaccaagugguacagcagcaagcucugccccaggucaguuggucugaucuuacagacagaaaagaaccuggcgcuuacuucacugucuucuugcauucugaccaacguucaaaguaauuuguugucauggugccaaugugauugacgugaaauaggaacuauuauuuuucuaugggaaagaaauggagaacuuuacaaaauccuucccuacuauggacauaacuuuauaguguuccuucuaauccuuaaggggaucuaagaggcugauaagugcccagaaggaagaauuaucaauaaguuuauuagucuuccaacuuugaugauugagacuuuuauuuguuuuaagcaagaucucuuaugcucaccaggacaugaaacaguggagaaaugguggugugcucugaauaugggcucuuacuaccugaaucuagggucaggaaacaaacucuuguaauaaaaccuacaaucacgguuucuaaugugaaccuguguuccucuuuaauucagagccagacucagugcccacguacuuuuacuguggucagcacuugcucaguuuuaacuaagaaacacacccuggguucucaagguuaucugacauuauuaacuuucuucaaaugggaacguccugaaucauuugaugaaaaaucaaauguucugcucuuaaccauuuccuggggaugauaaaauggaucccaacugucacaguuuuuucauuuagaaaauaaaucuguggaauaaagggaaacaagaaaccagaguuuuaaagauagguagauagguguccuaaccauagauacucacugcccagcucaauuuccuggucaguuuuucccuuuucuccugguacuuuuauuacagaaacagaguguaauagagauggguauguauaaccaucucuaaaugaauauagauguauacauauuggagauguauaaaauauacucuguuagucacuaagaagaaaugaagccuaaaguuaaaaaauuaaauuaauaaaauaaagaacauagaauuuaccaaugcucuguaagucuguugccaaguuuccuuuagaaccagcuucgugguuucuuacaaaacacaguuaguggaacauuguaaguuguguaggcuccuucauguccuauuuucuugcccuuaaaaaaacaaaaauagguccgggugugguggcucacgccuguugcacuuugggaggccaaggagggaggaucacuugaggucaggaguuugauaccagccuggccaacaugguaaaaccccaucucuacuaaaaauacaaaaauuagcugggcaugguguugggugccuguaaucccagguacucgggaggcugaggcaacagaauagcuugaacucgggaggcggagguugcagugagccuagaucacaccacugcacuccagccugggcaacagagguagacucugucucaaaaaaaaaaaaaaaaaagaagaaagaaaaugaaaaaguaagagacgcagcagucacucugcuuggccaccuaaguccccaggacaucuccugcaaggaugucugcauguauguuggaacuuggauguauauuuguaauucuuuaacuagaauuucacugacagcucauaaucgagcaucuuuaauuauuggucacuaauguugcugagugucacuuagugcuucugugcagucauccacacgucccaucucugugacugguaggcgcaucauuacuuugcacaugccaguuacuucucuucauagccccuuggcaaggcuaauuaaaugcagagugggguccaguauuuuuaaaaucuugguaucuguuuuaguccaaaauggaaauauaaugcagaugucugcguucuaaaagaucaaugccuagcgguggauuggaguuggggggccggucccaaugggguuccucugggagcugagcugcaagcuuggcacagaugucagucagcgcugguguggggggacuugagagacaaggcugcccgcggagcccaggaggagugggagcaccgcgugaaccuuuacguaagaaacacaaagguuuuauauagaaauugggauuggagaugaguguacuucgguuguggagagguuuugaaguccuaggaagggaacaggacucagcacaggcagaaaauagaagacauuucguaucuccgagagaggaaugaaggucgcaugauauucccguugugaaauuguaaagaaaaaugaucaaaaccuuagaaaggauuaaaaauaugaguacaaaaggggauggugugaaaccguagcuuguaaauacuggcaacuuugaguuggaaaugaagggcuuauccucugccuuugaugcagauucucuuuguugcgacagugaguugucagcugaaaauauccucauuacugagccgugucauaugaacuggaggacaguaaagugucagaggcaacagaacuugaaaaucuuggugcauuuuucuaaaugugcccccgcuuauuuucuagacuuaguuaucauuucuuuucagagacaucaauuguagaagcaaugcuggguuuugcucaugaaauuaaagagccuaugccauuucuuggauaauuguaugucucuguaauggugauauucacuaguuacuucaggcuccgauucuagagggcuaacaucauuuuuaggugcuaaauuucacauugaaagugacucugauguuuccuuaccuuaggccuugugaggugacuucugugccucucugguggcuccugugugaaaaagauuuuaaaguguuuauggagauguucaccuuaagaaauauaauuuugauagaaauguuauugcucaaccagacgauauuuuccaguaaauauguagaaauaauccauugguuuuaaucuacuaauuaagcuuucuccaucaguguuuauacacagggggcuuuuucagaggcagcccucuuuuuuuaacugugguuuggaagguuugccugucuggaacagugcuaucuaccagaaaguucugggauaauggaaaugucuuguguagacuguuugauacaguagacuagccgcauguggcuguuaagcgcuccaaguguggcaagugcagcuggggaagugaauuauuuauucaauguuaguuaaauuuacuuuaccuuuuaauauauguggcuacuggcuaguguauugcauaacucaggucuguauuaucauauugucuuuguagcucuugcugaggcugggcccagaaagcuuuaaaucauguugaugaugcuuauuugcuuauucccaaauuugggauauuuauuuauguauucauuuauucugaugagauuacuauggcuaagauaucaugucuucaugucuuuuugggcaauaccuuguuuuaauugaagacaagugacuuucaagugacagaaguugauuuuagucaucacaguguucaguguagaaauguaauuguguuugacuagcaaaaaaaaaagugaagaacuguguaagaugguuuugcaauuuaugugaauuuaugguucugauccaaagagcuggguccauuuggcuguguuugacacaagaugaaguaucuugaauuuuuauugugcaugugauaccuuuuguggaacagauuucuuaaaacaguauuaugguuuaacuuuucagaauuucuacaaagaaauugaaagagaagaaauguauauaagguauguaugcaucacgcuugucugcauguuaauuauaaauaauaauauauguuguauguuuacguaugcuaagaaauguguuauagccgcaaagguuuauuuuguagaaaauugugaaacguauaagguagaguuugguggagcucccagauacauucucagcucuugcauagcuuguccacaccagugcagaguucuugguggucaccauuagccaacucaaaagcaaaacuacaaauaauuguuucacagcguuuuguaccuguugaccaacucauguggcccuuuugcaaaaagauaagcacauaaauuuuaauguuucacaguaaguuauaugauccagugagaaauccaguuauaacuuuaccagacauaggggaguuauaauuuuucagucugcucuuaguuaacugacgccauagucccguguuuuuuaugucuuucuuccaugaagaagagaaacauuuugcauugccugcuggauuuugcuucccuacucgccuugcucccuggagugagggacugugauugagcccuucucucuugguuacuucuaaagucucgugucaaauaauuagcaagauuaccacucuggagacuaggagaaggauguaaccuacacagcaugaguuuuuagugauguguuuauuacacugagggugauugucuaauuuucuauuucuaagauuguuuuuacuucuccuuuuuaagaacauacuaugugaauuuaauaacucaguuaccuuuauuucuuuauggcaaagaaauucuuucgaucacauugacuguaaucauuggagcucuuuauucugauggauuuguauuuuuacggauuuuuuugugcauuuggacucaguagaaaugcagaaaaucacaaucaaguauugugugucucauuaaaaauguuuaagggaaaaugaaaaggaaugaaaaauuugaaggaaaauucuaccuuuguguaucaucuuuauuuuuuuccugaguuuuucuuagugcuuucuguaccaaaaguuuuuaaggcauuuugaauuaugaacauuguaaaaaggaaguguagccaugauuuacuguugaacauagaauuuagcucuugcaauccucaacacaaauuauuuagugacauuuuaagaacauaccucuguuuuauugucucagguauuuguacaagcucugugaccugcacaaggagugugauaacuacaccgaagcggcuuacaccuugcuucuccaugcaaagcuucuuaagguaaugucaauuaccagucaccuugaugauucuauuguuauaaauucuaacaauauucagaauuguauuuuuccauggcaaauuuuaguaggccuauaacuuaagguuuuaugaaauugacuaaauaaaugcaaggauaugaacaaaaauauuuaggaaguacuuugauuagagauuugucccugcugaaugcagauuuaauuagaugucauagcaggugaucacugagcauuauaaacucccaucacuuggcugugagcugacagcaaguuagagauucuacaauuccuuguucaggacuacaggacuccaggaugguggagaacaauaucaagaaggaauuuuccugguagaacagcuaagagauaggaugagacauaccccuaauugucuuaguaaagaguuagggaccagaucaugacuuuucacucuaucaguucacguugagaccuccugcuagugcucucugccugauucuucuaaggaguguugcuccuagcacaagucuggcaugacaacugucuacucuuagugguucuuuuauuacucagauagcuucagacauugacuuucuuuguuuacagugacguauggauggauggauggauggauggauggauggauggauggacaaauugcuauacagccucuaguuuuauauuucacaaccucaguaaguuauuagaugaucuugcucaugacauccuuauaaaaauuugaaaaauuaugaacuggauaaauaagaacaguuacaagaauuagaauuuaguuugguggcauuccacaaagacugcucauucaaggagucauguuuccaaauccaagccagccucccaaaaaccaaaaauguaaugaaagaaaaccagagaaaauuacauuaaaugggcauucaguagugucaauuagguaauaggaguuaaggaagacauuguguuauggaguaaaacucugguaagacucuuuccaucuuuggcccgauccugaaauuucugauaguuucugugacacaaauauacacaggcugcccuagagaccugcgaguauggaaauuugccucugccuggaaacagcagugucuguuacaaauaaaacacacaaagcucagcucagucuggagggaccucaucaguuguccuccugaggcuggcugucugaggacccauuuugccccgugccacgugggcucucccaaggagcauaauuuauaaggauggaaauuucaguugguacaucugauaccagcuaucccacuaugaauucugauggccuucauuuauucaaaacucaaauuucaguagcaagguguuuuuugcaaaugugaagcuauuucuuuuaccccagggaaauuaaaaugggguugacaaacugcucacucaacccuuacuccgucccucauagaacguaaacuuuuauaugcaugugugaauguaaaacauauauaugugcauaaaggcaucauuuguuuaaucauuggauuuauugaguacagauggguuugucacaaacugcaugaugguuuguuucacaacucaaaucgauaggcccaauugcauugcuguuuccccugggcuucugaauuuuccaguuuaauggggaaugcuacauaaucucucuccauaucuuuugccccguuacauuuugcaauuuuuucuaaauauguuuugauauuacuguaaaugugaauucaugcuaaucaccucacuaaagaacaugauuuauguuguugcgaaaauucuucaguaugacagauauauuauuguuuauuaacugaaaauccucaaauagaaucuucuuuuuugguuaggcauaucuuucgucaaaaccaagagcaauaaaaacuuuaguuuuucgccuagcaaucaaauuauuacaucuccauguggaaguggaagguagagaggauuuuugcuucccuaguccauguuuucauuugcaaaagugauuuaaaaaugcaaggaagucauuuggauucugaacuugcuuguucuuaauuuauuuuauugugguuacauuucagaaucuaguuuugcuuuuauucuccauccuccaauaaaaguagaccaauuauguuguacaaacuucaaaguuaaagaguuuguccaauugugauggagauaugcaaguucaauuuuaaggugaaaaaucuugcagaccgcuuaaaggcuucucacucuugccugaccuuucuggaaaggcagagccauacagggcccgugcccugugccugggagcccugauguccagcgggaggugcuccccagcccgugguuucaggaaaguggggcgggaccuuugcuaagacaguaagcagcugacggagccuugccccguugcccggaccccagcuucccacuuagugccuuugcagcacccucccuggccuggcugaaaacagggucaagcucccucuccuagggccagcaauaagcaagcccaugcucaccguguccucccgugagccuccaggcugcccagugggagcacaugccuccugcccguaggugcccauggagucuuuuucacaguguucuuuuucuuguucuguuuuuuuuucuucuucuuccuguagaagggucuugcucuguuguccaggcuagagugcaguagccugguccuagcucacgcaguguuguucugugucauuauucucuaauguagaaucgcaccauccugggagucaggcaucuuccgccuccucuuugaccugguuuguggcacacagcagguccucaucaaauagcugcugaauuuuauugaaccuuauacuuaaugccacugauguguugagcccaaguucaggagcugacacguuguaucuguuaaguggccuugccuucccucuggcaugucuccucgugcaucuucagcucacacgccgacugcaccaaugcuuccaggaauacuggccaaacccugacucugugcccagcaccuugccuauggcugauggugcaaagacaccuccccaucuuuaaggagcuugacagccuuucuagucccuuucugggugacuuguguguuccauguaccaucuuugcuguugauuaaaaugccaacccacgcagcacugagaccagagcccuggggugccgcucuugggauggcccuggaucaccuggcuccugauuugucccggaauguuaggaggugucauuugcaagcugccaguuccgugcuuugcagaaccugcuggguuuuucuuuugucugaaccccacugcagcuaugccuccccugugucuuuuaugccugucgguauguccggacagaggcucugcccuggcaguccccagccuguugacagcagccacacaugucuccagaaccgcggcccacacgcguguccgaugcgaagcucacaccauucugacgucccuggguguuuccgccucggguccgcucaugcuaugcuucucccuuaguggucggaggauguguguguggcccaccucacccagcgggacggguaccaggccaccacgcagggacagcugaaggagcagcucuaccaggaaaucauccacuacuucgacaaaggcaagguaaaacacaaaaagcaauuguccuuguuuuccucuuuccaugcaccuaccugcaguguuguaaacacguuuuuuagcgugugauuuuugcagaaccagaaauuuguuacaaguuguauauugaaauguuuuaugcauguuccuucagcuugcacuuaaaaguagaaaucuucuuuuaaaaaaaaucaauagcccuuuuauagaugcucuaaaaaagcaccaaguauuuuuauaacccuuaccagagggaacuaagucuggaacacugauucggagguguuuccgugcccacagagcuaauguauuccuuugacauccugcauuuuucuguuggcacggaagaauuaaucccaugguaggauggauauugcuccauccugguggcuucuaguuuaauuggcuuaaacaaaauuauagauuccacuugacuuccacuaaaaggaaaccugcugucauuuuaaucagccaguauuauaucugaucacuguaguucuucugauuaagguaugcaguaacuauuuaaaaaaaaaagcuguuucaguuucagaaguuuuuaaaaccugccaccgaagugacauuggaacuccuucuuugguuucaucaagauuccuaacucauuucagaaccuguuuuauuuuucuuuuuuuccuuugagaaaacugacuagcacacuuuaugaagguaccgacguucacauccuagggcugcuguagcacaaacuggguggcuuucaacaacgggaauguauucucauagcuuagugcugggagcugcaagccugaugucacaguguuggcguggccgcccccucugaaggcugcaggggaaaaucugccccgugccuuuuccuuuggguguguugcuggcggucucuggcacuggucaucuguaaccacaucgcuccaagcccuuccuccgucaucacaggccuucuccucaugcgaguuucugucucagucuccuucuccuuaggagguaccagcgguuagacgagggcccacucuccuccaucagguccucaucuucccuugauuacauccaaauacccuguuuccaaauaaggucagauucagaaauaucagggguuaggacuuuaaauauuucuggggacacaguccuacccacaauuguacugaugcccgggagugaugauggcugccccuuuuuguggcuguugacguaaaccaaaccccauugaaaacaaugacucgacagaguccccguggucacgagcuugggauucugcucacauuuggaguaagcgaugcggcauccuuuauuugucccugccauucuugacacagggagaaagucugacguuuucagaauggcaugugggcucccaaaggcugguuggaaauaaggauuggaaauguucugugaauuacacccaguccuguaguuuagggguccccaaaccccagguccucagccucugguacaggucguggccuguuaggaaccaggcugcacagcagcaggugagcaacgggugagcaagcaaagcuucaucuguguuuacagccguuccccaucgcccgcauuaccaccugagcuccaccuccugccagaucagcagcaccauuagauucucacaggagaaugauaccuauugugaacugugcgugugagggaucuaggugccauacuccucaugagaaucuaaugccugaugaucugucacugucucccaucuuccccugaugggaucaucuaguugcaagaaaacaaguucaggcucccacugauucuacaugauggugaguuguauaauuauuucguuauguauuacaauguaauaauaauagaaauaaaguacacgaucaauguaaugcccgugaaucauccugaaaccaucccccaccccgguccauggaaaaauuuuccucccugaaaccagucccuggugccaaaaagguuggggaccgcugcuguaguggaacaggauauauuuuuguucucuggaaugagaagcuuugaggauuagggccaauuacuauaacuguacuagguuagccaggagaauccuguuucucagcaaacugguaaagaaauggagcaaaugcagccaucccuucccggcaguggcuucuuggcuccagggugagcagugcuacagaaugggcagggcagggcagggcaggaggcagggacccugggguggccgggaggcccgagggccagaggucacgggacugaaggaaugugcgcauuuguugauggcuguugccgggcucucuuuguggcagcacauccucugaccagcguuggcucccgcgaccucuccacccucauucccucccuugcccucugcauuccagccacacuggcccuucugcguccugaaaugcaccagcccucucugccacugcccagcggguuucugcugcacugccuugaggacguugcuugagucaguuuuccuuuugcugccuguaccauuuugucacuugaauuagcuuuuucuaagccaggcuuucucaaucugggcaugauuggcauucugggcuaccuguuacuuugugguagaggaccacgcgugcaugguggacucaaggaaugucucccugcagugcccugggcauacuccuuccugucucagcuuaaaugucaccuguucuccagccacggaaacauccucuuuucuccuuuauggcacccacuaucauuugcaaugauagauuugcuuguguguuucuuuaaugaguuccccaguaggcucugagcucugugaagauagaaccucacgcgucaauuccccaccaugcaucuaaugcucggaacagugccuggcacacagcacaugcucauuacauuauggacguguguggaaagaaugaacaaaugaaugaaaagucagcauuuaacagugcuuccugacagaugagaaaugcucauguauggcaggacagguggccuucaauaaaugauaaaucaaaaaacagagucuuuuuuuuuuuuuagcaaagguagccaaauaucuuuuccuacauugugauaguucaucaaaaaaaucauauggaggggcaaaacgaauguguucgguucaguacagugguucucaacugagaucugcaggaggcauuguggguucuccugacugggggaagagaaggugcuguuaacccuccagcagugcacacauggcccccacaccacaaagaaauagcccagaaucccugucguguccagguugagaaagcccuccuuagaaaaaaugaauucaagugaugaaauggaaugggcagcuaaagcaaaacagacucaaggaauguccucagaugucccuguguuuugguggagacagaacaaaggcuauggcaaagugaucauuggcuggccuugaaucagaaugaguuuuaggaggauuuucuucguaguagcugcauugauaaaaccgauggaaaagccacuucugaauauccauaauauuuccacgagaauguuaaaaaggaacaaagccuccuuaucccucuaaaacuaaaguaagaugaagaacaggugcuggaaagaauuugauaaaaugaaauuugaaguaucugagugaucagcugcaaggcaaaaaauucauuuuaacaucaacaagcauuacauuuucugggagaaagagcaguaggaaauaauucaucuuccguaacaaucuggauggccugcacuagaguuugaaccucuccgaaucuccauggcuccaaacagcacagguguguuucucacacaugcuccgaauccuccuuuuggcucggaacccagaugaacagagguuccgccacagaggaacacagccggagaggacagcaaagagucccccgcccuggggcuucugccccaaaaugacaguguucaugucauuggcugaaggagaucacaugaucaccccagacuucaagggguggagaagugcacuuaggggcaggugagugugagcggcacccacgugcaccacacagcuuguuagacaggugagucuaacaaucaagggcaccauccaaucuagauuaacaaaaguucaucuagaaauccccuaaguaugcauguauucugagaaagacgacguccacacuagucucccaaauaacucggcuuccccacaacuagagaugugagaauaacaucucauaaaacuuguugggccucaauccucguuucucugucguggaguuuccuucuuccguuaaagagggggcuuagguaggcagaacccugcaggagaagcagccugagagaaugggcuccugacccccgugacugcgauguggggaaucccaccagguggccagugcaggaggaagggggcacacaguagaagcucgaagugugauguuuugugccggacuuagaaucacuuuuguuuaagaaacaaggcugaggccugaguauccccggcugcuuuggggaugugccaucauuugagaaauaacguccuccugccuuuccuaaaugcaguggaaugacaaaggccacggcugaagguugagaagcuugaaguugggagggcccagggcacaccuuuccacacuccauucccagacuguaauuaucuugggggaaaaauacuuuuuaaaugguccacaggucaucacaggccuuagugggcaggugacacagcccaaggaaacuugaaggagggccuugauugguguggagcccugauaugguuucgaucugggucccugcccaaaucugaagucguuguaaucuccaauguuggagguggggccuggugggaggugauugggucauaaggguggauuuccuccuuggugcugugucgugagagugagugaguucuugugagaucuggguuguucaaaagugugugggaccggccgggcgugguggcucaugccuguaaucccagcacuucgggcugaggcggggcagaucaccugaggucaggaguuugagaccagccuggccaauaugacaaaaccccguuucuacugaaaauacaaaaauuagcccaucgugguggcaggcaccuguaaucccagcuacuugggaggcugaggcaugagaaucgcuugaaccugggaggcggagauugcagugagccgagauugagccacugcacuccagccugggcgacaggaacucugucucaaacaaaaaaaaaaaagaggggcugugagaccucccugccuucugcucucgguccugugccugcuuugccuuccgccgugaguauaagcucccugacgccuccccagaaguggcugcugccaugcuuccuguacagccuauggaacugugagcugauuaaaccucuuuucuuuauacauuacucagucucagauauuucuuuaagcccucugagcagcugagcaccagagaaaccaacucucaauuaauugguaggacucuaacccucacuguuguccaguacugaguccugagccacaugcggccauugggcccacgugaaccaucuuucuaagaccaaguacaaaaaaacaaauguucuuaugggcugaguugcauccccccaaaauuccuauguugaaauccuaaccuucaguauuucaaaauauggcuauauuuggagauagggucuuuaaagagguaauuaagguaaaaugaggucauuagggugggcccuaaucgaaucugacugguguccuuauaagaagggggauuaggauacagacacacacagggaagaccauauugaggauacagcaagaaggcagccaucuacaagccaacgagagaggacucagaggaaaccagcccugcagacacuuugaucgcagaauccuggccuccagaacagugaggaagugaaugaaugugacuugacgcccccagcaccuacucagugcuucauuauggcagcccuggcaaacuaauaccaauaccaggugucucauucauuuguuuguauagauuucauguugaaauaguaauauuuuagauagagucaauauuacuacaauuaauuuuacucuuuaaaagguagcagcuaggaaaugcaacauucacggauguggcuccuauuggacggugguuccuguuggacggugcugcucugagucaaagacuuugcucuuguugagcgccaagaacaucgucagaccagcacugccgcccacaugcggcugggaagcggaagcugcccacuguccuguggggccucacaggcaguagaauugccugccugccuguugguaucuacuccuuagacuacaggaauauuuaaacagcgaaaauauuucugaaagaguuacaaaauggggacucaagucuggaaagaauaaaauguaugucgaaauggcaaggaaaaaagcaugaucacaagcaccaagauaugauguuuuuuuccugugacucaauuucauuucuguaguggugaaacagcugucaagacuacggcaguuaccagcgggaaccuggagggaagggugacuugggaguucucacauggcccuuaaggaaauacagaugaggcaaauaggagagagguagaaacaggcagcugccaagauaagguguaagaaaucaagaaaaagcagcaucuucuuguuggagcaagacagaguuuuccgauaccuauuuuauuauuaaaauuuagaauuaugcgccucggugauguuguuuucauuugugcuuuggauaaaucccauuauaaucucauuuuucauuucccgggcuuagcaaggauaagucacguuugcuccucaggaucugucuaugcacgugccuuagggaauagcgagccuuccccgcugacagacuggcucuaagaucugcaccaucuugacccacuucuaccugggccacuucugaacaacucgggccucugggcagaagcccugcugcuagauccaguucacuuugugucuccuuguaagcucucggucccucucaccugggucugucugagaucccuacccacucuccuccccaaggccccaugccugucuccacccuuccgcuccugcagauagauagcagucugguuucuaauaaaguggccucuggaucacagcgugaacugcuucaaagaugcccaaaccucagggauucucccaucuccucugcaggcgauccaggccucucaccuggcaugaggccccuuagaguaggaaucgagccuccagauguacccucucaucacccacagcaucuggccuucugaacaugcccucuguuccccaagcccuugcaccuucccauggucugccccggcguggaccggcugcuucuugcugcugucucgugugacggcugccaugacagcugccuuccugccuucugggcauauuucacugcucucaaacuuucguggcuuuuggaguucaccggcgaaucuuguuaaaauccagauuuugauucagcuggucuggggugggccucgaggcucugcauuucugagaagcucccaggugaugucccagcugcuccagggaccaucccugaguccccagggccugugcugacuuaagcuccugagagcagaggcaguggcuguggcugccaccucuggaucucccucugagggagcugugccguggccugggcuccacuccauuuuuuuaaauagcuuuuuaagagugguuuuaggcucacagcaacauggaacagugaguacagccaggucccagacacccccugcccacacacauacacaggcacggggcuuucaggguggucauuuguuagugaguugagcacauucuggccagcacuugagcaaacagcacacaaucaagaagguggccgucacccagacuuuccacaaaguuccuuauuuggggcauauuuuguuuguuaacggaucuugcauccugacucagacugagccccugggagagcgaaaggccaugccucccaccuccccacccccagcgccgggucgggggcagaucccaccccacucugccacgugccgcaucacaguuggguuuugucagugugcuccuuucccaaggcuaacacuaacuugacuuuagcacgacauucacugcaaagguuauggaucagacggagacaaauucuugcaagagcagggcuggauuuuccugucuagaaucuuguauguuaaaaauaacaaucuuccguccaaaugacuacagcaguuuauuaagugaccgaacgggcagacaagcaugcagggagggccgucagcauccacagaacuuaccgaccugacugagagcgccacgugcaccaggcucacguccugagcgugugcccacagcccuuggaguguuuacaagaauuuccuugguucgaucuuacauguauuucauuuuaggggaaacaacgcaauuccaguuuuacaaauguauugggguaaggagacuuaagaccucaguuaagcuuggagaccagugauuaccggggcuugcaagaugauaaaauggaagccaggugggacgucagucuggcaaaaccaugacccggcuacagcuccacugauccagccugucuccucguggcccauuuccauaugcaauuaaggaaaucuucauuacguacuuacucugugggaaggauauacacccuagagcucauucacuguuugaaaugucuacagcuuccuacgggaaauaggggcuuccagaauccaggacaagcuugccucuggacaaggcugagcaggcuguuaagggagcagggguccccaucccaggcccccugcgauggcaucucucugugcuccccgggagagugggcgggggcagggagagacgggaaucgggugauauuaaaguuucucugccuuugugcuuggaaaccagcaaggcaaaauggauuugcugcuguuuuauauuggacacgggcuuuugaaugauguucuguuaucuuucuguauuucuuccccacggaaucauucuucuguuuuugccuuuccaccguuuuuuaaaguuuugaaugucuuucagccuagcucuugguuucuuaaucuuuuucuuucucucugcaaaaugucauuuccaucuguuuccauuuucauucuuuuacguuuccuccuucccgagcuaauaaugacuccuugcucuuuuuccauuccauucuugccgcccgccugagugugccccaaaagccuucuguuugguuuuaucauggcagaccaguguucuuuucugaagaugcucugaauugucugucuuauuguguuugguugaggccuaguaauuuucgauaaagcccuuaauccaaguacuugacugaaaauuaccaggcuucucuguggaggaugagggucaaaaauagaaguccuucuaugaggaagaugcagucagagugagacagucaguauuagccaacaccagccaccucugaaaucaagaaacagccuggcagguugacaaaugcgauacauaauuuguagcccaagugauauaugaagcccugugacuauuuucagcuggagcucuguuguauuuucccuuaaaauaaccuucccuugacaaaguucacacuuugccuugcaccaauguaaaaaaaaaaaaaaaaaagcguuuuacaucauuguguaaacuaaaaauaggaguuuggagcaaauuuccauuuuuggucaaauguuugcaucucuuuuccaaguauuuggggugaaauuuucacaucuucuaaguuucccuuuggaaacacaguuguuauuaagagggacugcaggucaacauaaugaagcccucauauggguuucuuguuggcauuucuagaauuuuugaaaaugugauauuagcagaaccuauucagccagaauuuggccugaauauucaaagagaucauauguucauuaugauuugcuccuaugcaguaauugaucaucaaagcaugagaaaguccauuuucgagucaguaacaacaaugcucccuuagcuuaugugggaucacuaacaagcuuuuccacccaaagcccacagugugcccagugccguccugcgccgugaaauaccgagauggagccaggcccaccucgaggcgauucuagcaucagggcucucauaugagcagauaaauaacaaaacccaccuuccgcccaucacacaggugggcgcugggucucccuaucccacaggugcaggagugaugccuucuuuuggagagcuagagaagacuucacagaggugguuacauuucgugcuucuugaagaguaaaauuaaguuugccagaugauggcugggaggaacaggaauuucagagugugagaauagcgccagaaggggaagagcuccugaugacaucucgcuuuuccggggaaguagagccauucugggagauagcagugcaggggacugucuucgucccuucaugcuccuauaacaaaaugccacagacugggugguuuauaaaccacagauucauuucucaccauucuggaccugggaauuccuagaucaaggcacucacagauuuggugucuggagagggcccucugccugcuccacauaaguagugccuucucugaguagucauguccuggcagguguggcggcgcucuuccgggccucuguuuugaggccacucaucccauucaugagggcuccaccgucaugaccuaaucaccuucgaaggccucaucuccuaaugccaacaccuugaaggugaggauuucaacccgugaauuugagggagacacaaauauucagagcauagcaaagacauuggagcuaguuugucaguggcccuguauugucuccugaagauuuggcuuacaaggacccaauggaaauuucgugaaaguagaaaauaaugauuucauuuuccucuuuucaggggguaauucuggcaacaugguggcagcagacuuagaggagggagggugggagccagagacgagacgagggguggggcauugggccaggccugagccccauaaagccaguggcagauggaagugaugucaugagacuucaaguuagcagauuccacagugucaaagacccuugaacaggguuaaagccagaaaagcaagugccagggguggcuggggcacccacuggccuagaagccaagaguucuugccgggaggaagauguaggaagggaaugcuucacuugcugcagagagcagauggagguccuuucauccuuucagcauugagcaaggcagcgagggugcacacugagcaguccugugcagggcauuuaauggagggugucaaggaaagggagaaaugagcagggucacagcugcagugaugcugggugcauagagagcccugggccaguucacagcugcagugaugcuggguguauagagaguccugggcuaggucacagcugcagugaugcuggcugcauucaagaaucccgggccagguuacggcugcagugaugcuggcugcauucaagaauccugggccaguucacagcugcagugaugcugggugcauagagaguccugggccaggucacagcugcagugauguuuguugacuccccagccugugcccuggaucccccuaucccaggacaucucaccagcaagucugcacucucccuuugcagcacccauguguuguucucugucagcucccacccucccaccugcaaccaugccauuauugcucucaccuuuaagaagaguucuuucuuguuccaacuccccuguccagccacugcccauuucuccuccucuuucuacaacacuccguaaaggauggucugcacuugcuguuccucuccuccuguugucucuggaguccacucccucaccaguggccaguagcugccuguggaaggcaggagugagcagcacggugucucuuucuguccaguuaaagcaccgagcaagaggcaacuguaucucuugcugccugcuuuagucuuuucaaggucuuucuuugcaaaacuacaaauguccuggccuaaagaaaaaaugucauaucucuguuacaaaaaaaaaaaaaaaaaaaucuucauuuuuuuaucuagggcauuacaagcucagugaguaguuuucuguuuugacuaauaaggacuugccguggaauaaaggagacauguugaugaacauaagugacccgggcagugacuccuaugugaucugagcaugaguuacacgggcagcgacuccuaugugaucugagcaugaguuacacgggcagcgucuccugugaucugagcaucaguuacacgggcagcgacuccuaugugaucugagcaugaguuacacgggcggcgacuccuaugugaucugagcaugaguuacacgggcagcgacuccuaugugaucugagcaucaguuacacgggcggugucuccuaugugaucugagcaucaguuacacgggcagcgacuccuaugugaucugagcaugaguuacacgggcagcgucuccugugaucugagcaucaguuacacgggcagcgacuccuaugugaucugagcaugaguuacacgggcggcgacuccuaugugaucugagcaugaguuacacgggcggcaacuccuaugugaucugagcaugaguuacacgggcggugucuccuaugugaucugagcaugaguuacacgggcagugucuccuaugugaucugagcaugaguuacaugggcagcgacuccuaugugaucugagcaugaguuacaagggcagugucuccuaugugaucugagcaugaguuacacgggcagcaacuccuaugugaucugagcaugaguuacacgggcggugucuccuaugugaucugagcaugaguuacaugggcaguguguccuuugugaucugagcaugaguuacacgggcagcgucuccuaugugaucugagcaugaguuacacgggcagcgacuccuaugugaucucagcagcgucuccugcaugacacagguaguagcuccucuaugacccgggcagcgacuccugugugacccgggcagcgacuccuguaugacacgggcagcgacuccuguaugacacgggcagugacuccuguaugacacgggcagugacuccuguaugacccgggcagcgacuccugugugaccugugcauguccuggguagugggugcugcauguccugggcagugacuccucuaugacaugggucauggcuccuggaugacacaaauaguggcuccuggaugacacaggaagcgacuccuguauuacacaacagugacuccgauuuggcaaggcagagguucccgugugauggggcuccugugugacaugcaguggcuccaguaugacauugaaguggcugauccaucuugugcacacuuggggugacuuuggcaucauuacugcaagaucagucagcuuugagcugcagaccgucuuugcuggugcagggaaucaggccugagucugugucagaaaggucuuugcaaaaagucaauccugcacccacaucagucagugccgguugagcacuccaggaggaccaaggaugaggcuuggcucaaggaaaaagcgaggggccuggagagaguggugaugcuugcaaagggucuccauuccuugcagcguaguugcaggcaacaccaagacuagcugggcccuuggaaucauccaggcccaccucaccagggccgccagccccacaccuggaagggaugcugucacucagcacgcauugagcaaagaacggacugaacgcagccuccugcuaguccugggccucccuggcuccugugcugcugagggaccucccccagaguuccagauucuuccgcaccagugauuuuaauccauuuugaugucagagaccugugugggacucuggaaauucagaagguaauugaguaugacucuuuucccaauaacugcugugaaaaaacagaacagaugaauuuuagaagaaugucugaaauucaagcauccugugagguaucuccacuggugaguuacuuacagcuagucagcaaaugaaaccagagucgcccaccaguauccuggugagucaucgccagccugaauuauuagaaagggauggcugucccggcuggcaucuuuccuuucaucugcugcuguucccuuguccugugacauccguguugucauccuaucagaauugucaacaucaccucauggguaagaaaucaauuccugcuguguucucuacagcugcuucugucugggaacuaaggaaggagcuuuauuauaaaagaaaauuuuuauucaaguuucuauucauggaacuugaagaaauggaacuuccugaaaccaagagguucagaagaauagagagaagauuaucaucucaagagaacacgucucguaucaucugggggaaagcaggguggggagaccgugcuccgugcugcaagucaaccggcaauuucaagaaugccguaaauuggauuaaggauuucgcaucagaaaauaaagcuuucugcugauauggggcuuuuucauuuggggcuguggcaaaccucauaagccuguagcacuucugagaacggagccaaaccaggguguucaaucgcagagguuaaagugauucuuucacugagauaaucuaaaucuagaucauauugaaucugccuucucucuggcacggaaacauuuuccaagguauucacguuggaaguaugaauuacccacacucucuuuaaagccccauccaauuaaaaguagaugaaaaucuccuuaaugcagaguccuuuagaacaugccagggguagcagggagggaugagagauauauauuuauaggaaaucugauagaagauaccaccaugcaaccugagggugagucugagaagauauuuacucaugacuuguauuucuuuuaaaaacaauuacuuuugauauguaucuaaaguaucuucucugucauuuaggauaaaaacagauuaggcuuuuacucaggaaugaauuagaagcccuggcauucuaggcagcuacagaguuuguauccgcuugcagaaaauuuaaaaaaaaauaagaagaagaauccaguguaagagaccuacaaggaaagguaauguucucuuugaaauggaaaucugcucagagaggaaguggucacuggagcuuuaaaaaaacguuaaaaguagggaaguucucccuuccuagaaaaugugagccggggcucuggcagaggacauacgaaagacuuagagcagcagacugagauauuccaggaaugggaggcaacuuuaaaccuucagcaggaugggggagacagacagauggggacucugggaagggaccagguagcagagcagggaccguaggcaggaugucuugggccaccuccuacccucccuggacacuggucccagcucugaaaccuuugucuucuuugggcuuacuuuuauuuuguuauucaaaguauuaaaaugcagcucugauuguagaauaacuuuuacucucaucaaaaaaaaaaaaaagcagaugguuucuuuacgucguggcuaugacaagaguacuuugggagcauuuaaguaaaacaguguucuuaaguuuauuggguggcucugaagugagugaggacuucaguggggucauccuggaaaggaaaggcaaaggccagugagcgggugggggcucagugccaugggugacccaggucuggggcuuggcagucugccuccccugugggaaccugcaguucaaggccagccuggacucuuuucaaauccauccuggcaggagguggggaagcagcuuggaagugcugcuauguggccaucaggagcaaggacuuucaaaaaggccacgcugggucaagcccaccgcuuaucugcuguguguccuuggcaagcuacuuaccagucugaucccuagauuccuuaucugcaaaauggguauaaugcagaugcccaccugacaaggugauuggaggccuuaaaccggagagcacagguggcuggacauagaguaagcugggaaaagccaaaaucaccuuugcaaaaaaaauuaacagugaggaaaugauggcaguaaaagagaucugaucuaaauccucacccaccucccacccccagucaugccucuccuguaaucauuccugggcuuuggcuaagccaacuuugggagaccucuaguuuaagguuuaaaugauaauaggccuucccuaaaacucagcugccuugauaaagcuaaugaaaggccaucaggcuaggaagaggggagaaaccugaauucugcuaagguguagacugcucacaaaauauacaacuucacuaucguagaugagccuuuugagaucuuuucagguuuuuugcaugucugacaccuggcucuacccagaccaccagccccacuccuauggcccaccuagaagcaacucagcucaagaggacagcucugacccccugugauuucaucagcagcaagcauccauuaccuggccgccaccaccccuucucccaaacugccuuugaaaagccccuccccuaggaaccuuuggggagauugauuugaguaaugacaccgucucccacguggcgguguuacuggccgcaaaucuguauagcucugcagcaaccucaguucucaccuugucagaagaaggaauucgauugaggggcauaacgcagaagaagagaccgaggcaaguuucagagcaggagugaaaguuuauuaaaaaguuuuagagcaggaaugaaaagaaaguacacuuggaagagggccaagcagacaucuuggaggucaagugccccauuugaccuuggacuuaggguuugauaugcuggccuacuuccagcgucgugcaccccuuuuccgguggaaugccccuggaagguuaccaguuaaacuccgccauuuugccucucaauucacaugcuugggcccacucacccagcuccugagaucuuaucaggaagcugcugaucaccagcuuguguuucuagcucuugggaaacugccuuucccuggcacugucugugaccaauuauuauuuuagagagacaguguacaccugccugaccaucaucugacggucaccugacuuuccugguagggugucaggacagcccucuccugccccgcucaugccugacuagcuaccugcuguaacagcauggcuggccuuaugucaauuaaacucuuucuuuacugcaaugccuugaucuuuuuuugugcagcaggcgggugggggcucagugccaaggguagucuagauucgcggccuagaaagccuggccuguugggugguuccaaagcugcgugguuccccucaggacuggcgcuaccgucuugugggaaugauggaaguugaaugcagcauauaggaagcuuuccugauuguaacucagcauccugcaguucuguucacuaaaccuuguuaagcaggcccuggauuaagguccagagguuuuacagguugauaaagcugagccccuguccucaagggcuuauauucucugaggaggaaugacaaagggucaugcuaguuucaguaccuuaccaaaaguuuugaggcagcaggauccugggucuuugugggagcacagaggaggagagugggcggcagcuaggaaggcuuccuggaagaggugguuccucuuacuuuuccaugguuuucuccaguaauccgcuuuguuuuucccaagaaaaauaagggaaauucaggccaacuaucuaucaaaaaauuauuccacaugugucaaaagcuuaucaacauuuuaaucacuuauuuggaaaguuacuuaccuuacaaaguucccccuuuucaaaaugauaacaggcuuuauauccauagcauagucacacacauacaucaaacuuucugcaagcuuuaguuuagagucgaagucugcccuguuauuucugaucauuggugauauucgacauagcauuuuuuagguggacagcuugggaaaagagccaagucaggcgcccaguuucuacauaaauggcaccccacagccucucuucacccuacgguuccuuuucccuggcuccaaggcugcuccgacagacgggcuucgggccacagcuggcagcaggagagcaaagacaggagcagugaggacuggcugacagacugcuguuaccauggccagaggccugcgugauugacaugccagugauugaccucuuuggccagcugaugccgcaggucacgagccaaaagacaugagacucaagaaaauauuuguauuuuuucgguguuauucccauaauguuucauucaaauguacuucuacacuguuuuauuuugaaugauugcauuccuguuugacucuuugcacaauucaggccucggcuucucuuucuuuucuuuauuuuaacucacagaugugggaggaggccauugccuugggcaaggagcuagccgagcaguaugagaacgaaauguuugauuaugagcaacucagcgaauugcuggugagucuuuauuucuuuuuauuuaaaugaacacaggcaaucucagcugguuuuucaggaaucucucuuuccaugucaauguuaggguucaccccaggcacucugggaccuuggccaugucccuccguuuugccuaggaagaugguuuuaguuaauuugcugguugauauuuggcccauaaauauuuacuuuuuagucccaagucagcucuuauaaccaaacucuuaaggcuucuaugaauaaauuguacguaaacaacugcugaccuuguguauagcggucuugacagcccaggagucugugaacauuuguacuaguuuaaaacugaccccaggccaggcgcacuggcucacgccuguaaucccagcacuuugggaggcuaaggcaggcggaucacgaggucaggagaucaagaccauccuggcuaacacggugaaaccccaucucuacuaaaaauacaacaaaguagccgggcgugguagcacacgccuguaguccuggcuacuugggaggcugaggcuggagaaucgcuugaacccaggagguggaaguugcagugagcugagaucgcgccaaugcacuccagccugggcaacagagugagaguccgucucaaaaaacaaaaaaaccugaccccuucuaugagagagggauggauagauaaugaccagaccuuucuucugccaugggaaugcuguuaguuucuaauugcuaccuccuccaccuugucauuuuuguauucagcagaucaccuuaaugaugugggaaugucugucaugaauuuagaacagaacgauucuguuccuuuaaauucucuuugaacguaucccacuaucugaccuauaccuuuuaaaaaauacuaagggccagccauuucuauggcacuucuuugguuauugaaaacacccauaagucacaacuuuuugcugaauuugggcuaguugguucagauucccuugcggaaugauggagaaugagugaaaaauaaugucaaaacgauggagugagaugaaauucaggugcaagccucaguacccucucccaccaucucccucucccaccaucucccccucccacccuauagaaguugccagagcuuuuaaagagcccgcaagaagaauccagaggcacacaugcuugaauacucaaaccugaaaugcauuuucuuuuuuccuuccagaaaaaacaggcucaguuuuaugaaaacaucgucaaagugaucaggcccaagccugacuauuuugcuguuggcuacuacggacaaggguuccccacauuccugcggguaaaguuugguucugccuaaucugagccaugauuguucccccagcagaaaauccccuucccguucugaggaaggguggggaguuugcauccgcgugggaucgugcaacucucuacacugccauagcucggugguuagcccggggggcagagagggguugacaggauuuuauuugguugcauauaaccuuucuaucugauuuuuccguaaaaggacccuccuucagagauuuacacguauuauuuuaauugaggugugauauaugauaugugauacuauuugccaucuuagccauuuuuagguguguaguucgguggcauuaauacagucacguuguugugcggccagcaccaccaucuaccuucagaacuuuuucaucuugcaaaacugagauucugcauccauuaaacacgaacuccccauucucccuccugccagccccagcagccaccguucuacuuugugucucuaugaaucugacuguuguagggaccuuguauuaguggaauuguacaguguucgcccuucuguguuuggcuuguuucacucggccgaaugucuuccaguuucauccagguuguagcaugugucagaacuuuauccuuuuugaggcugaaugguauuucauugcauggagaggccacauuuuauuuauucauugauccacugaugaacauuuggguuguccccgcccaaugugcugcuaugaagauguauguuuuuaauuauaugggaaauuggaaauggaucuguauggccacggugcuagaaacuccaaaccaggcuccaucccugagacaggcaugugcuuucagacauguaauugaagcaguaaccgugaucaccugccaggugcccauuucccaguauucacaugaggccaaaggagaaguuacauaaauauuaauagugcugccuggccuaccauagaauuguuuauacauuuucucaagaacacauucuuuggaugccauugaccagugggucaugauuuccugauauuucuuaugacuuuuuuuuuuuuuuuuuggacacuugguuuucucuuauccuaggagacuaugugugauugcucuggcuuuaggaagcagaagcucugugucuugagcacagccgucuggggcaguugaaaccaguugggagauuccccugguuccagacguuguucauuugggguccuguguuuccgacuccacgggagucacuaauagugugacaucucuucaucacggcacccagaggauacagaccuccccuuaggaagggcaugucacuguugacaggggagcaccacaguucuggccugcucuaggaggugaggcuggcugcccacucaguguccugccuggugacggaggcgucuggcccuguccuggucacuccuggucacugcuggucagcuucuccucuugccuucaucgugcagcaaagacagcgguugaucagaagcacagauucugaacaaagucuucccuuccaaagaaugaauaaaggaggcuuaguuacaagcucuaaauuagagacaaauuugaaauuagcuucauucucaauaaaaaacaaagcugaaggguggaaugagcuuggaguuaaagccacuuacuguugcuaaaggcuuuaauucgagugugugugugcuccggaacauacaucuuuaggaaagggaggcagguggacccuaagccaugcagccuugugcagugcuugguguuagauggugcguguggccccuguggauggagaucuaccucugguauguaggcaccaacucuggauccgugcaggaugguuaucccagaauccagagcaagggagcagccugcguggaauauuaugugagggcagugccgggugcggaggacacguugcagcucccgagccaauagaugccagguugugccaggagcucacacacagcaggcuccaggggcggugcugggucaucuccaccaccaaaaggacaaaaugaaaagucugaauggagguuaacaggcucgauuaauauugaacugacuuucccgccacaccuggaucauucugugggucugcagcaauauauuuaucacacuucacagaugagcuggcaggggucaaucugccaaugacacuggcaguuaccaaaacgugggcagaauguuugcgugcuucaugcccugcuggagaggagccuccaagaacugacuagcugucccuuuugcuuuguuuuucucuaaaaauuggucucacuguuuuuugugcucauguugauauuuauagaccuuacaaggaauaaauaucuuugacuauauguacauuucccccuuguuuucauguucaaaaggaucacuucagaaugcaaaguaacugacauuuucagaaaauguuauucguguuuuuaccuauaacucacuagcuuuuuucuauuaaagucuuuauauacauuuuuauuauuauguuuucucauguaaagcauaagaaaaaugcuugcuaguuugauaguagucuguuauccauuaaaucuuacugaauuuuggaagugcguggcuuuauauagaagccuuagaaguugcucagacuguauuuaagaugacauauuaucugguuucugcuugacuuuuuuuuuucgggggggcgguggggagaaauagagcauuuuucuuccauaaugguacuucuaagacauaucuaagcacaaagugaaaaagaauucaauucuuaaacugguucuuuuuuuagcgauuuaggagaacucagaauaagcuggggcaagggaaggggacugucuuaguccacuggggcugcuguaacaaaauaccuuagacuggguacuuuauaaacaacaggaauguauuguucacaguuccggaggcugggaaguccaagaucaaggugccagcagauuuggagucuggggagggccauuccucauagauggcgccuuccaccuguucucaugggguggaaagggcaggcagcucucuggggccucuuuucugaggcacugaugacuuuccuaaggguggagccuuuccagaggccccaccuucuaauacuaucaccuuggugauuagguuucaacaucugaauuuuggggacuacaaacguucugaccacagcagggaucaauugauucagugucauagaaucucucuuaauccuuuugaaaauccuuuaguuagacaaauuuuaauuugacuucaaucuuagucuuuaggggguaaguguaaaaauaugcagcaaaaugcuguccucucugucugucucugucucuguucgucucccucucuggcaccuguccaggaaugacugcagauggggcagggcugcagcugacuugggagcagccaaccuggagguucuucccccguguccccugaucaaagaacagaagcaccucagcaaccacgccccguccuggaaaguguuacccccccaaccccagacuucuguuucuuguaccccuguggcuucugcucgcugucuucuccuuguggcaguuuucauuucgguugagacagccccagaugggacaggauggguggggggaggcagaaggcuuccaaaaccagcagcagcauuacacuagguacucauuggccccuuucugugaccgaguucacacucagaacacacguguugaaaucgggaaaaaaacggagaccuguuguaucuugcaaggaaaacguuccuuacagguauauuuacagaggacugugucacacucaggcagaaaugaccucaacaagacagccucguggaaggaagaacacuuaccuacuuaacuccccuccccgccccggacugccuagucuagccuagccgucuauaacaaccccaguggacugacauuccaucuuggaauuuauggaggugacaaaagugucauuugagauggaccaaacccagcccuuccaagaagagcucuguauguuuuaucuugacauguguugaugaauaaugaccugcacacacauucugaaugcaggaagggaaguccugcucuccguccaucgccagucacucacucgggggaggccaggaacuuaguagcucucggcucuggucugcaucccuuccccucggguucugcucgccucggcugugucucacaggagucagcgcccggcggccgugugcaggugcuggggccccaccuuagcucaagcucucuuaaauuccuuauggcagaaugaaaacaacuucauuagggccuaccugagaagaaaacaaaaacaagaaaaaguguggacaucauuauccacuuguccuggcugccuugcccccuucuaaccauuucaugcccauucuagugugggcuucugagugcucauuugguuuuucauauaguuuuuaaaucaguuguuacugucaagaugaaaacauaucacagauguuaguagcgcagugcugagugcuucuuaaacaguauuaacuuacaugcuugaugaccauguguucuugauuaacaaagccaacgcaaguacaaaaaaaaauaaaaauuacaaguuguucuuaaauuuaaugacauuuuguaagaacccguaaggcauauuuuaaggccagcauauugcaugugaacucuuccuggcccuuucucugugguguuaugaaaugaaugucacccuuuucagggaaaaguuuucauuuaccgagggaaagaguaugagcgccgggaagauuuugaggcucggcucuuaacucaguuuccaaacgccgagaaaaugaagacaacaucuccaccaggcgacgauauuaaaaacucuccuggccaguguauccuuuaagacaaccucaucaacucugaaaccauggugaugccauucauuugggugguugggugugguggggggccucucucaugguugaugucuaugcugccuuagugauccuuaacccccucaccucagauauucagugcuucacagugaagcccaaacucgaucugccuccuaaguuucacaggccagugucagagcagauuguaagguaauaaucccauuuuucuuacccaacgugaggguuguaagaggcuguguacagaucucuugcuaauaauuccaccuuuuaaaggacggacuuuggccauggauucgcuuuccaaaugcucuuucuguccucuuugaagagcaagggaagcuaauuauuuucagcauccaaaaaaagugacaggagauguuaauccaugugcugggagcgugcaaagccuauuccuuucccaaagucagcugacagcaaaaaccuaagagggcaguggaggccgucuggucuccuuuauagaccugcccugugggguacaauccccuagggaacuucacagcagugcacaaguccugccuguucccagcaaagccaaguucauacaugugaguguggccugaauguuugcauuuuagaaggcgggaaaugggauuugcacauuugcuccuggugacacacaggagaacccuucagccuuacagcacagcaauuccauaauguaggguuaugagggggcuuuuaaaccuccugagucaacuguccauauuugagugagauuuucugccugucaguuguaucgcaccugacuuagcaauggcauagaaagaccugcuuuagcagauguguuugauauuaagacuuuucuguucuguuugauccauguucuggugaaaauauuaaucucuuugaugaccucauauuccuuaggaucagcuucauuuugcuuccugaaguuuggugguuucuuuaaccuuucaucguuucuuugaccuugcaucagcaauaaugggaaauaaacugggacccuguuuauuuacaaaugauugcucucgcaaggcauacauuuuaaggguugcaacauuuuuuuucagaggccuuaagcaaauagugacgcuuagagccuucucagaugcaguaguuucuuuugcuguggaagccugccugcauuucagugcaggggagaaaucagucucagucucuccacgcccugcccugugcaugcggaaagccugccucguaccccgaccgcggaggcagguuacuuauguuuccugugugucacucuuggggugguugcaaaaucugugcuuuguagaucugaaacuaagguauguaauacuuuuuuaaaauaauaauaaacacauacguugaacacaaaagcuuuuuucucucuccuucgcuucaccuuuccucuguuuuugcucauuucacucuuacucagcuucuguuuucccucgaggguuggcagggacagggaagaggcaaaaacucaaguuaauuuuuccaccugccaacauuucccuggcugggagaggacaccaaggcgauggcuucaggucaagguuagggacauuuuacaggaggcagugacauguucuaaggccagaccccguguccaaaagcaaauuggcuauuugccggguuaaauaucuaaugaucugucugucucuguacaguuuuuacagggugaacgagguccagcgauuugaauauucucggccaauccggaagggagagaaaaacccagacaaugaauuugcgguaaaaaacaaacaaaccaccaaaccaaacaacaaaaaauaucauuccgccaccaguagaacugccacuggagaagcguggccucagaggcagccacggagccauauuaaaugucuuuguguauuaugugcagaaaucuuaaucuauuacccccuccaaaguuagaaaaacuaauugccauuucacuaacaauaugacuaaggucacugagauauuuaauaaggagacugugccguccaaaugccggagcucccauaugaguagcgcacugccuucccugcgagccccaggugagagagcaggugccugucaucucuaguuaaaaauggacccaccgagugcugaggugcggggugcugacguggcuuucugcaggugacacagcagucagcacaugaacuggaucuggacccgggugcucauuccucauucaguauccagcaccugaacuucaguggagcacaacacacaacugcaggguugaccccagcacuacuagcaauacggaccggguuauucucugugguggggaccauccagugcauccagggauguuuggcagcaucccugaacacugccuacuaggugccagugccaccaccccaguugggacaaccaaucaaaaagauuuccaggccaggcaugguggcucacaccuguaaucccaacacuuugggaggcugaggcagguagaucaaauuaguucaggaguucgagaccagccugaccaacaugguaaaacacugucucuacuaaaaguacaacauuagccgggcgugguggugcacgccuguaaucccagcuauuugggaggcugaggcgggagaaucgcuugaacccaggaggcagagguugcagugagccaagaucgcuccauugcacuccagccuggggaacgagagugaaacuccaucaaaaaaauaaaguuuccagacauugcaaaauaaaacaucugccccuuguugcaaaccacggcauucgaguuguagaaauaacagcaaacaucuuuagagccuuuuuucuuuauuuuuuuauuuuuauuuguuuauuuuuuuugagacagagccucgcucugucgcccaagcuggaaugcagugccaugaucucagcucacugcaagcuccgccucccagguucacgccauucuccugccucacccucccaaguagcugggacuacaggugcccgccacuacgcccggcuaauuuuuuguauuuuuaguagagacgggguuucacgguguuagccagaauggucucgaucuccugaccucgugauccccccgccucagccucccaaagugcugggauuacaggcgugagccaccgcgccuggcccuagagccuuuuaaaaauucuacauacaaacugcuuucauggauucauuuguauuuuuauuuuauuuauuuuuuuauauagagguggggucuauguugcucaggcuggucuugaacuccugggcucaagugaguggauccauguugaaaaggcaucaaauaagccauaauuuuuuuaaaauguuaauguuuauccgucuugccugggaaaccuccggaaauccuucuguacuccuguauugcaaggaggcauuagcccggggacccccaaggaggaccggcucugcugagaauggcuucucuugugugccguccgaaggcaucuaggcugcaaaggucaaaggugaauuaacacccuacuccugaccagagcaaagcucggaacccuuccagcaggguugccucaaguaaagagugguggcuacccagucucccucccaaucccucaggggucugccagucaugggauccucagggcaguaccugugagucuccuagcucagcucuuaagagccauggggaaguuccuuccagccccgaggccagauuccuugugugucaccaaggagcacaaaggagcuuggaguuggugaaaucugcaguauugugcagucccagcaggcugguuguuugaagauuauguucacccuauuuguuggugaacccagcacccuggaccuccuccaggacuggucacuacaguguccauugucugcaacagugcgggcagaaccuaggcacguccaaccuggacacccucgcuaagggcaguggcuuucagagcagacugcaccuguuacugucaucauaagcacuaacgcuaguguuuauauggagucccucaacugugggauuuauaggcaguucuugaauuucccucacaccucucccaucuggcaaguagauauauucuuagacuauaaagaaauagacacaaggaggucaagugagccacuggagggugcgcggccaguugggugcagagcuaagaauaacgaaggcucuugacauuuugagcuaugcugagccucagaggcuaugcuucuucuaaauggcccugaaauccccuaauggcccuguugagguccgggcacuuggacaaaguguucggaagcugcaggauuugguccuucacaugccccacaaagccuuagauaagugcaacgucuuuugcucuacugggaagccagccucggccccuccagcggggagccuggcuccaagugcagggggcuggggaagcugcccaccaggccgagagcagugcgagguggcucaucccugcagaccuggcaaggggugacugaugugcuggggagugagggcacugacgaggaggaagaugagacagggccugcgugaggaggagcuggccguaaagcccaggauggaacccagagguccgucucagggcauguugacaugagagaaagcacuggaaucuggucuagagguggaugugagagggccagaccuguuuccauugccaggacaaaaaccugagggagccguccccauggggcaaagaggacuggugugggacacggaggccuugccuguguccuuauggcuucagccagcuccuucccuuuccuccuauggaacguaagaaguuugggauaaaugcuuuccaagauccaagucaguuuucugaaaauuuuuuuuuuuugagagagagucuugcucuguugccuaggcugaagugcagugguguaaugucagcucccugcaaccuccgccucccgaguucaagcgauucucaugccucagccuccugaguagcugagacuauaggcacaugccaccacaucuggcuaauuuuuguauuuuuaguagagacgggauuuugccacguugcccggccuggucucgaaguccugagcucaggcaaucugcccgcccuggccucccaaagugcugggauuacagacgugagccccccacgcuugucccaguuuucuggaaugacuggcauuccauuaucccaucugcuuaagucuagauuccuguugacacucagacugcucagugacccugcagugcagggagguuggaauggcagaagauuguugcaagcuagacaguacgaacgaggcaguaggauaaaggauuuccaguugaccccugcauuggaguuuuugugcaauccuuaaagaguaguagaauuguauuuauuggguuagaacaguuuccugcaauagguaauauacuguuuuacaaagaacacauugucaaaugauguuuuuauuuaaaauaugcauagacacacuuuuuaauacuuaguaagaagucuugaacaauagauacuaaagcauauagguuaucagcuucagguaggggaugguuuuuccuccugcucuuuccauaucuuuauguucucauauaaacauauauuaguuacgucaaaacauuuuaaaguuuaaaauaccgacugguuuuaucagaacaucagaggucacuuugauuaaauccagucucccaaagauguauuugccccuuuuaguuucuuaugaacacuguagcuaauguaagacuucuuuggagccuuccucaaaaucuguuugcucaagaggggcuccccauaccucauuuuggaguauacacaucuuucucacucaccuaguauacuuucauugucaaauaccagaguggugggcaauguuggcuaggggacaggggauacuuugauguauccugagcgaccguuagguagagcguggcuugugaggugcuaccugaaggcacacaugcccugugcugagcaccacagacccuguccugcugaaggaccugacuccuuuggaguuauucuauaaaucccccuuagggcagagcuguccaccugcugacauccuucuaacccguguuguguguguguguuuccuuugcagaauauguggaucgagagaaccauauauacaacugcauauaaauuaccuggaauuuuaaggugguuugaggucaagucuguuuucaugguaaggauggccccaccccagaaggaauuguccguucccuuccucaauacagucugccacgccuucuucaccugcucaugccccguggucacuguggcagcgugcacacagcagacucuacaguucccauaaccaccccaccuguucuugagagcaucgauaucuccucgccuagccauauuuuaguggaaaugcuguguaaucacgaccaacucuagcuuaucaaaaaaccagaaugaagauuucauuucuucuuacaauguauuuaaauucagucauagcugugcuguuuugacaaugcuuuguguuaaccaagugaaaaguugaagacaaauuccagucuacauaaacuuuuuuaaagauuuuuuuccugaugguuuuauugccauuuacaugacaaacaacuauuaauuaauaguccuugcccauuucaaguaaaaauagccugagaacauaccccucccugacccuuuuuaaagaaauaacgauuuccagcucucaacaaagcuaaacuuugcuuugagauggggcaguuucauuuacgugaaacucacauuugcagugagcuauuggacaguuucauuuacaugaaccagaguugggcugcagauuuauugacaguauugaaaugucagggccaaggcaacuggcaauauaaaaacaucugauugaaaucuguacguuuuuguucaugugucucagugccuuuuguuuucaccuggcaagaacucacugaggggguggcacuugccauuuaguuuucaaugaguccccccgaaacaccugauuauuugucucuaggggccggcaucucucugcccagcugcguguccagcgccgagccuucuccuuugcccacaccagcaugagcuaugggcagcuaugggccacucucugagagguugcccgcagucagagccacugcuuuauacucaaagcacccagggcucuucaccuaccccuccuggggucacuuucugcucuggaguucccuuucugugccccuagcagccaggcagugccugacagauagaaggcugugggaguuaugugucaggugguaaaaaugcacucccuuugcugggucccuuuguagcuagugaggcauuguacaugugagagacaacagaagagcaggcccuccaccuaaacaggccgugauccucuuaaucacccucugcccaugagcccuuuguaaucggggccugccagccaacagcugccggaugcaggagcuuagggagguggagaggggagcccugaccuuucgugaggaugcagcuucuccucgggcugcuuuggccauuuugaacagacuaagagggcaggaaggcaaauaaucccagaauggcaggacucacguccugcuaccaaacccugaugcccuccucgugccaccugggaccaacccccgugggauaucugugggagcagcagcuaaccuucuucaauaaaaauaggaagggauucuuucucagugcaaaugagauuaguaacagggagguaacagucaguccugguggaauacugcccuggagugugcauuuguugaagcugugugcccgggaugaaaugucguagggccuggcaaaguaaguuguggggucaggacagcauggcuaugccugcuguccaggacaccggacaaggggcccucucagcagggugcacguggcuggccacaccagugcaucacaaucuccccaaggcugucccuccaucagugcaaggacagugacaucagugggcagacaaccucuguuauguccacagccaccuaggagugccagucuaggguugcugacggacagaaucgcccauucgcuguucaucucugcccugccccacccccagcucccaggcaguccgcuagaggcuguagcaggaagaaagccggacaugaagauaccaagggcucuugggcaugggugggggcccaucacgcuuccuuuggaaggagcaaaguuauugcugaggucacccugggacaugguccccguggcccagugugaggaggagguuuggucugcucaagcaagaccucagggcagcuguggucccugccuuagacccagccacguugcccuggcaccuuagggcugagcuggagggcacugggcugggacucggccaggccaggcccuguggggcccucagagaaagaggguggaggucccugagagacacgcacuggagccaggaggacaguggucaguccccuaccuccugcacugaaggugucauuaaccauggcaagugugcaaaugaagccugugaggguggccuggagugcuccaagcagccuuuuccucccgaccccaggggccaugagcucucuuuguuguuguuuguuuguuuuuuggagucucacucuguugcccagccugaauacaguggcucaaucucggcucacugcaaccccugccuccuggguucaaguaauuauccugccuuagccucccgaguagcugggauuacaggcaugcaccaccacaccuggcuaauuuuuguguuuuuaguagagacaagguuuugcuauguuggccaggcuggucuugaacuccugaccucaggugacccgcccaccucagccucccaaagugcuaggauugcaggcaggagccaccacgccugcccaucacucuuccuucacaugaugguguguggugccauggcggagcccugccuugaccuccuuugcccucccuaaccggacagguagugcaggcugcccgggcuuagauuccucaaaauucccgaacaucuucucccucagcacaacaagcagagaacaagaacaggauuggaagugucuguucugaagcagguguauucaagcacucaaggcugcguguuuuccugggaugaccacauaugugcauagccacaugcacacacacagccccgcccccagagcugagcagcagcuuugcuuuguuccuuuggaauuuucaucucugggaacaaacaauaauaauaaaaugcccagccacccaaaaauucuguuuggaagaaagguucacggaggagcaggaagccugccccagagcacguggcuccucuggugagacccugggaguggaggcagcuguggggcugacaucgggcucuccucucucuuugcagguggaaaucagcccccuggagaaugccauugagaccaugcagcugacgaacgacaagaucaacagcauggugcagcagcaccuggaugaccccagccugcccaucaacccgcucuccaugcuccugaacggcaucguggacccagcugucauggggggcuucgcaaacuacgaaaagguacgggacccaccagcuugcucugggcaagcaguccugcccggggacagacugaaaauucccgagaguccccaaagcccagaaacgccccuggucucauugagcaaucucagcaguggcccagccaaggccaggcagcagcagccaguggcggccccugaagccugcagcaaggucaaggccggagucccggcaaggcuccccugggcauccccagacagccaggaagcccccacugacccacccaggcugggcuuaucugcacccaggccuccaguggcuuuuacaaggucugggaucuuacaggccaaaagauaaaguuagacaaaaacaccagaauaucaggacuagggagguagcgcuuugacgguggagggggcccggccagcuggucucccuggauccuagcucuguaggaaugggcagaaguugaaggacacaggguguauccuagaccaccccugccuguguuuguaacugcaguucuuuuggaagaaggccacgccugugcacuuacuuacgccugaggcuguuuuccugauacuguaacuggcgaguugaguaguggcagcauugaguaguugugauagagaccuguaugguccacaacaccuaaaauguuuaccaucuggccuuucacaaaaaaagcuuguugaccccugaucuagacagagcaaaaacugagacaaaaaggauacugccugagagaaggcugcgaggagaugauuacccacccuugcacaaagaaguuuguugccuucagguguaggucaggccugggcaggugcaggggcuaggcaggaggcaugggcgugugaguagcugggagggcuguauucacugccacccagcaggaccaagccaccaggucagcuguggccuuccuggaccccaagaacugggguugcugcuguagacagcccuguuagcuccacuuacaguguuugaccuugugggacauuuuguccugggugcugcgaagggugugacccugagucugcagugagcuucguguggaucuguuuuaugcacagcucuauucucagggccuggcacacaguaagugugcaaaaaccuguguuugcugagcaggugcacugagcaacucuccuugucuccaccaggccuucuuuacagaccgguaccugcaggagcacccugaggcccaugaaaagaucgagaagcucaaggaccugauugcuuggcagguaaaguguccagcaagaguccugcauggcuggagggaaggaaagcuaggagggucuaggcucagcacacacaccagccagcauggaggucccugggcugcaguccugaugcacguggcugugauugucccugggugaacccacccacugcugucgugaucaacucagcuccugggcugcagucaggaauuugaacacccagaaaauuaucucuugcaaaugaacaaggucucuuuccuccccuuggucaauucugccggcugcuggaaaacuuuuucucugucuguauugauagaacauugaggugagcucagagccaugaagccuugagcucuagccugugccaggaaaggcgcucgggccagugcagucccugugaaacgcauguacgucagaagcugcagugcacccucucccuguucuccgugcaccucuggcgguggugugcguccucaucuguguuuucccagcugaaguugugcaaguuauuucacuguucuacuuaugcuccuggggccucgggagccuuucccagagggccagcaucuugaaagggcagacccugggugccuuggguuuaagugucagaaccggacggaugcaucugugcuucucagagccuuccugagccuggaaguguaggggucaagagccaguccucacaagagcuuggccggcaccagccugcucugcugcuuuaggccacugccucuuuaggcuuccuuuucacaugugggaggcaaggagggugcuguccccgagaucuugccacacuguguaaagagaguugagggaggugggggcaaaggccugcauggguuuggaccaggugucguagcccaggccacuuugcuaagcuggggucccaggcucccagucaaggcccagagaugcugugcaguugaucugcacccaguccagaacagggcaagauacaaaauuagcugggcgugguggugcacgccuauaaucccagcuacucaggaggcugaggcaggagaaucgcuugaacccgggaggcggagguugcagugagcugagaucacgccacugcacuccagccuggguaacgagcaaaacugucuaaaaaacaaaaaaaaaaggaacagggcaaggcuguuccucuuaugagacaucaccgugagcaguuuauuuguuuguuuguuuguuuguuuguuuguuuuggaggugaagucucgcucuguugcccagacuggagugcaguagcgugaccucagcuuacugcaaccuccuccuccgggguucaagugauucuccugccuuagccuuccaaguagcugggacugcaagugugcaccaccaugcccggcuaauuuuuuuguacuuguaauggagaugggguuuugccauguuggccaggcuggucuugaacuccugaccucaggugauccgcccaccuuggccuaagugcugggauuacaggcaugagccacugcaccaggccacugugagcauuuuuauucugacaucccagcagggccucuucuuaguggccucucugucaucagcacauuggccaaugagacgucuuagaguggagcaaggcugagcuuugguugugagccaagguacgaguccucuuaaauuuguguuuagauauauaggauggguuggauuuuuauaauucuaagugcuuauacugauauguaaacauaauauacauuauguauauauuauaaauaauugugauaaaauauacauaacauaaaauuucccaucuuaaacauuuuuaaguguccaguucagaggcaauaaguacauucacacuguuguacaaccagcaccgccaccauccaucuccagagccuugucaucuugcaaaucuccaacucucuacccauugaacgacuuccccauuccucccuccacccaccuccuggucaccaccauucuacuuugugucucuaugaauuugccuacucuagauagcuuauaugaguggaaucauguaauacuuguccuucugugucuggcuuguuucucuuagcagaaugucuuccagauucauccauguuguagugugugucagaacuucauuccuuuuuaaggcugaguaauacuccauuauagggcuagaccgcaauguguuucuccacggaucugucaaggaacaacauguggguuguuucuaccuuuuggcuggugugaacaaugcugcugugaauguggguguauaaauaccugcucaagucccugcuuucaauacucccauaguuugggguauauacccaaauuuagaauugcuggcucaugugguauucuguguuuucuuuuucacgaaacugccaaacucuucuacggucacagcaccauuugacauucccaccagcaguaaugcaugauuccaacuucucugcacccccaacaagacuuguuauuuuguuugucuuuuuuuuuuuuuuuuuuuuuuuuuuugagauggagucucgcucugucaccagccuggagugcaguggcgugaucuuggcucacugcaaccuccaccucccggguucaagcgauucuccugccucggccucccgaguagcugggacuacagaugugugccaccacaccuggcuaauuuuuguauuuuugguagagaugggguuucaccauguuggccaggauggucucgauuucuugaccucgugauccgcccaccucagccucccaaagugcugggauuacaggugugagccaccgugccuggccuguuuaucuuuuaaguaauagccauuuuaaugagugagaaguuuuauuuauauguauauauaaacaaaaauuauauuaaaagggaagaaaucagacuuugucacaaaucugcauuugaaaucuguuugcuuuggaauuaugguuuugaacguccucagaguuugacugaaagggacauuguuggccaacuuuggcuucuuuguauggauuguaagccucauguagacagucucccucuguaacuaaaaaagugggagagaguuuaaaauugugaaugauuccauuuuagauguuguagauuuuuuacuaaaggguacgaaauucaaaauuccucugcaggcuauaaaacuauugcuauacaaaaacuaguuuggucugcaaaaguucuauugauuuuuuuuuuccuauaagcuuuuacagcaaauuggauuuuaagaguuucaaguccuacagaggaaaauaauuuguuccccagagagcagcuuuaugucagcacuaugucaucauuccuaauaacuauauuaaaggaugaauuuuaaagcaggucacaggaaagguaaaagaaucaguuuucuaguaacuucauuaaaucaaagagugaugaaaaaugcauauuccaaacauuaccugugauuuugcuuucauuugcaaauguuuggaaaacccguaucuugguauuggcaacugagucauauguucauuaaaaauaagaaguuugaauuuaucagaaugcuuuguucucuuuuuguuuauuaguucaucugguuugguuuuuuccugaaacuaucagggcagagugagguuuuucuccugggagucccaggacucaugugcagaguuuucaucaccgauauauaauaagcucagcucugaugcauaaaaugguuugugaagguugguuaauaagucccaggcagcuccuccucagcccugcuugcugccucagaaacagaggaugggcugaccugcuccucgcugggugggagguggcagucagggugcacacuguguggugccucuuguagguuugcggcuggcaccaggucaugagucacuuucucaaaggcacaauuccaucuuucuccauacacagcugucauuguggagcaucccugccgaguauccaaagacaaauccauacagucucauauuaaacugcugugauguauacauauuucucuuuugaaauguacgaagaugaaaggcugaacucagccaucauccccagcugaugacaagcaugacuguuguguccagggguggugcuccuggagcauuaagcaaggcuuccagauguucugugcugcuuucagggcaugaaucugugcaggggacagacaggagcaaacuucaaauacggcccaucaggagggcgucuuuguagagcaggcugcaggcucgcuuugauuaauuagaggugugacuuagggaaaguccucucccaucucugggcucugagaaacucuuuaggaaugcagauuccugggaucugccuacagcaaaucagggcucuggaggugggguucaggaauccaccugagauucugaugcuuagccagaguggaacccacucaacuacagggucuccagagaccauuucagacccucggucuauguuaagugcuuuuugugcauuggaauguguuuacucagggcauccucuuaucuucuuucauuuagaaucacaccugcaguucagccccaaguagacauauaacagggaaccaguuccuguccuaucagaagguuauuucccaucaacgucaggaacugcugagaguggugaauucucacaccugguaaauuucaccuaucagauugcaguucgagcagcacaagcguccuaaaccaaaaggucuuaacucucaucugacaaguaccuucuuugacagaaagaaucugaccauuaagaguuuuaucacaccaccaucaacaccaacaacagcaaaacucaggaacuagauuacauuuuguaguuugagaaaggcccgcccuaaaucagaaaugcuuuuaguaucuaggguggcugugcuuucaccuugcaacagcaccuccacacaucccugccuuugcauccagagagagacccaacacauucgacaucccaccaaaaguugucccggucugucugcgucaucccccaaggcggaacucaggaggcagaaggcugacagugagcauuuucuacugcuggcccugaguaaaccgcggcuagccccggggaagcugccaucugcacgaguaauucauagggaauauuaaaacaucccaaguauuuugaaaucucucuguaugcuguccuuucggugauaacuggccagaaaggccugacaugugccuaggguuuggggccaacugucagcaaaacaaacuuuugugucggugcagccuccaagcaggcuaggagggcuaugagcgaggagagcgcugcuacucccuccuuuccuggagcaccaagagaggcaacagcugugugcuauaaaugguaaccaaauacauuugaugcguugauucaucuugauaagauuucuugaauuugcucacaugaaauucaauuguguacuuauuaucguucauacuaauaaaucugcucauuuagauugguguucuguccuauuaggaaaaucuguuuuuaaucaguauuuugauuuaauuauaaauuauugagaggaagccucuuagcuugauuacauggaagaaugucuaacugaguccaagcccuggggggaagcagagaccagggacagaaagggagacuuuuccuucucccaccccacaacagcagcaacucuggugggucucugcagcugggagaaugaaaaugucucucuuagaacguuuuuaaaggucagcuucaucuccacucucggaagugaaguguuggcauggauauuuugugacagcagugucgcagagaagcgauuauuuuuaguuuuaaagaagaauaaauuugguuuucacuuccaaaaaaggaagauuuuucaggacuauagaucacauguaauuaccuuuuggaauaggguucucguaaaggcaauauucuuagcuaaaaaauguucgcacucugacaugacccuuugcuaauagaacaaguuacaucuaaacaaauucaagguguagcucuucccaaacucaagugaaaagcacagauaagucuauucugggaaauuaacugaguagccgugguguagggcgcaccacacuggacauagucaauucagaacacaaaugguuuucauguaaacauuuuggucuuuggugguaauaugccugcugguaaauugaaucagcugguuugauuuggaaaccaaagcagaucguuuugccaguuccccuuuccccaagugugcauugcucguccuagaccauuauccaagaaauaaggaaugucaaccucucuguuuuccagauuccuuuucuggccgaagggaucagaauccauggagacaaagucacggaggcacugaggccguuccacgagaggauggaggccuguuucaaacagcugaaggaaaagguggagaaagaguacggcguccgaaucaugguaagaggguaguaugcguaguguugcagaagagugggugucugggcaucccacuguugaacagggacaagcuuccagagcagaggaacucacauguacacauggugcccgcuuaggaagugggaugugagggagcucagcccccuugggcagucuugucuaccggcaacucagcaaccuccuuucaauaacuggaaaugucagggcgaauaaacauucaugaauuuccuugauuaccaaaugcccccucaccugcugugaacacaguccaaccuuauuguugcagagcaauggagaaaucucacagcgcccaggcaacucagcugguugacagugcacaccuacagucauacaauacacacagaggguucggucauccacagggcaacagcacucacgacggcccauggcagagguagcccagcccaagguugacaucagaggaucauggccaucgaggaagaagugaccaacaucuggagugugaaauuauuagugaagauuuaccuauuguaggaagggguaauugaucuagaccaaggaagauaagccagauguggucaggggaggagaucaagaagacacugccuggggaaaggacucccucaacagaggcugagaggcaggaguuugaauggcaggccaggggccagugcagacacaggcaugcuuugggcagaagagaaaauucagagcggagauggaaaggcacccaaccuccaagaacaagggaugcuaggcuggggcaggaggcucugcucgggaugaagggcagaacugagcuuuugcaaugaguuuauggaagguuucugagcaaaggcuggcaucaggagcaggguggagagcagcuugaguuuuaaugaugcaaaaaccuugcaguucaaaucuuacagcccacuugagacuguccccaggagccaugccuuagcagaugugggagcaaagccaggcaccgugagucacagugcugcccugcuuugcagcucagaguggugcucccaucuuuacucagucucugggagcuuugcugggccuacccugccugcucgggaacuguggagacaccagacacggcaaaggguccccacuccccauuguucagggaugaggggcaauguggcacagagaagcagggagcucucuucugucuacuggaauuccaugccugccggcacugagggggugugcacagggcuucaacuccccggcaaaaggaaggcgagcugugggaagucgcgcugcuucucccagguaacauacggcacuuuccucugcuccuugaagaccaggugucgaguggggugugccauuuugguuuuuuucugggcccagggccgccuguccaccagucccugaaguucucagcuauucucuauugaacccuguuuucuuugacacauugaucucaauaagcaaacaguaauuuagugcuccccacgugccagggaccuuccuaagugcuguauagauacucaguugcuuaaucugccucacacucugugaagcaggcacugcagucaccugcauuuuacagucaaggaaacagggacaugggaagguaaguaggucacacccuagcacguggcagacccaugguucaagcccuauccauguaccuccagggucugugcuuuuagccccuacuccaggggcugacauuuggcaccacagagcuucuccgccucuuucccacaugguaggaaaugcauaugagaccugggcaaccccugagagaagguaauuugguuaugaucacacugcaugcucucccagucuccccgccucugccgggcaugaccgaaccuuggugccuccaagccuaggaccuggugucccucagaugagagggucccaggcccagcagggcuugaacccaacaaagccaacauaacacaacugcugcucugagguugaaaacucagcaggugggagucuggaacugccagcccagcgggagcugcugcaggugaacaggccuggaaaucagggcucuguccuucaaggcugggcuggaggauccuuugugcaagucagaaugcuagaguagcgcuugauagcuucagagccugcaacucauuacagucagagcugaguggcaagaagcguuucggagugcgucacaucgcaucucuuucaaaguugaugccuguauuaauucauucuaagaaacaaacacuugugaaaucuugacauuuucuuccuaagugaaaagcuuccucuuuucucagucauuuaauguauauuucaaaaucacagaaagcugucuggcucaccagacauccugcauauucccuucucugccacauucaugaguucugagugugcuugcuuugggcacagguggagaaagcaagggcaggaagguagggugcuguggauuggugugcuguguggauuggggugccgugugaauuggggugccgugugaauuggagugccuuguggauuggggugccguguggauuggggugucauguggauuggggugucguguggauuggggugccaugucgauugugccauguggauugugguguuguguggauuggggugccauguggauugugguguuguguggauugggcugccauguggauugugccauguggauuggggugucauguggauuggagugccguguggauuggggugccguguggauugggguaccguguggauuguggugcuguguggacugugucauguggauugugguguccuguggauuggggugcuguguggauugggguaccguguggacuguggugcuguguggacugugucauguggauuggggugccguguggauugggguaccguguggauugugccguguggauuggggugucguguggauuggggugccauguggauugggguaccguguggauugagccguguggauugggguaccguguggauugugccguguggauuggggugcuguguggauucggguaccauguggauuggggugccguguggauugggaugccguguggauuggggugccguguggauuggggugucauguggauuggggugcuguguggauugggguaccauguggauuggggugccguguggauugggaugcuguguguccuugguuggagcuuauuuccagcacauugugaggcagcaccgucuccaucaaccuccccacccuucucuguagcaccagcugggucaccccgucuagggggugggaggcuuuuacagaaugaagguugcauuuuccacccugagauacuuuguuccccggacccaccuugcagaguccugcuccauccuuugaccgcaacagcaggcucugcaagcauccuuugagagucaaggggacuggcagguccccuuguccuucccugagaaauguggcaauaaaacgcagucugggaugugccuuuccugucuuaccuacuuuggaaacuugcaaucaucucagagcacuuugaaaagcaaucuaguaucacccuguuugcaaaaaagauggauuuuaaaauuuaaaaauaaacccauagaaaggacauaaaccauuuugucaguguuucugagccagcuuaagccauagaaagagaagauguggacgcccucugacuucucgauacccaggccccucugccacucugccuuggcuuucaucguguucccaguccuggggcuccaaggagcugccauucccuggaugggagcucugcagcccagcuucuccugaccuuuagggagcgaggugugcagggccccagggaugagcccgugagcaccugccacguucggcauuggcccccgugcccucaccggcccacagcgccacguucggcauuggcccccgugcccucaccagcccacagcgugcaggaggcauguguguuggccuucaggcuugugaaaaagagcuuuagguuucucaccaaaacuucaucuaccucuucaaguccgauuaggagcagggaaauugauccugguucugcauucucucuacucccauccaccucaucacuccaaacaccauggagagccauaaccccaagaugccaucgucccccucuccccuccccaccuacagucacaacacccgcuggccacccagacccgggagagaaccaggagucacccuuccucccucaaguuaguucuagcugugguauccccugguggugcugggguucaccccaccaucuuugccaucacaguuggccccugaccuggcccccagcuuccaggauuucuccucucucgcccucccuccacagcugccggggggacccaucccaguaguucucuuaacugggauccaugagacccugggguuccucagaggcuguugggagggguguugacugggagguggagcugauagccccugccucagcaggaacauuuagcuucaccuauuccuugugcuggaguuccauggugaggagaagcaguguggcauggccuacaagaacagccagggaccaggguucuguuucagaugcagagcugauggugcaguuguguccuucagucuuguggccucugagggccggccaagguucuaacaucacacucgcacccucccugcugggccugcccaucuucugccccaccccccagccccuccucccccaccugcucucuccaaaggaaaaugugucacccucuguggauuuccaggcuguagcuggcauuuguauagcaucuggaaagggacauuccagaucacgaugaagugugccugcuucuuacccuuccuuguacagcacuggucccugugauuaaguucagccaaccccuucaacccagcccauucccauccaagacucugggcaguaaacaccuguggcuggcucaaggugggacguuacagcucagccgggagacagcgacguaaaacucagggucauuaggcagggccagaggaucgcuccuggucagaaaacuggaaugaguguuugcucaggcggugaagacagcagcagccaucaggguaaggagcccugugggcuuccccggcaucauuucauuuaguucuaaugcuggcccucugggcagggaagacugcucccugugugcucaggaggaagcuggggcuccgaguggcucgggguuuuauggagggucacaccaucagugccagggccacaauuccagccuaguuccaauguccccaacuccuacccaccagcccuacuuucagucacagugucuggccguggagucccaccucccaggacugguugagacccuaauugcaucagaugaaacaaaaguaaagcccugaugucuugauuucuagaggcucaaucaagaaggaauuaugcggcagaccgcccaguaaacccauggucgcacccagggagugcccucugucucuccuugacgggagucauccuccugccaacccccuuccuuuauuccuugaaauccauacucacacaucucaaccaagaccugaggucaccuucugagauuauguaugggguaagguuuucacaguuggggauaauccccaagcaaccauuucccuuuuaguuucuucuaaaggcagaguaauuacagugaacaucuccaugaagcuauccccuggcaccaucauuggugcagguccaagacugaccaaccccucucugcuggcaaaucccagcugcacgucacucagagccaguggucagcaaacuguggccccuggcgugguuguguaaauaaaguuuuguugacaggcaggccaugcucauucauuucuguauuaucuguggcugcuuuugugcugucguggcagcgcgugcuaguuuccacagagaccauauguccugcaagccuaaaauacuuaccugguccuuugcagcagaggucccagcccucaggcaguggacugguaucagucuguggcccguuaggaacugggcccacagcuggaggugagcggcgggugagggagcauuacugucugagcucugccuccuaucagaucaguggcagcauuagauucucaugggagcaugaacucgauuguaaacugugcaugugagggaucuggguugugcacuccuuaugagaaucuaaugccugaugaucugaggugcaacaguuucauccugaaaccaucuccugcuggucuguggaaaaauuguauuccacgauaccgguuccuggugccaaaaagguuggggacaacugcuuuacagaaaaugugggccaauuccugcccuuuuacaauuuugagcuucuuauuaugaaagagauaguuuacacaucaaaugcuguuuuauuugggaucacauauuuaagaaaaaggcccacuuuucagaaggggaaguggcguuauauuaaucuuaccuguaaucuaccgcuucuggccuuggagggcuggaaccaugguccacagcaggucuucuguaguugauuggcugaaugagaugggcggggugggguugcaggguggggaagucaacgccacacagagaggaggugcccuacaggaacuuaguuuccacauccucagguuaaaggaagguccuugugcagcagcugcagucccagaugugccaacaucuggcucggggugcagguacccuggaauuuucuagcuaaugagauguggacacaugcuguauuucaaggacacuugcuucuguaauaugucaagaagaagauggaaaaguccaucuagagaucuuuuuuuuguuuguuuuuggcacaaugcaucacuaguucacuaccuagcaagugggagaagcuuuagcaacuucagcagcgguuucaccuacucaguggcuucagucacuugcagaaaggaaacguacucuucauuaagcagcaggagcauguuauuuuugucuagaggaggucagucauuauggauucaugcauuuugauggcccguguagucugucaaccugcagagauacacaaaaugcaucuaaagaucgaaagacucuuuaaucacucucuagguguuacucuacauuaaacuuucuggucggcacauucuccuguggcuuuggaauguguugacgcaucgcggucuuugaagaaaacuugcacuguguauuaaaaggcuaagaagguuccuucugauacuuucacaguauuggguuagguuuuaaaagacucaaaaauaaucauuguuuuugucuuccacucagaacaagaacauguacuguuuacagaagucugaacgaugauggucucgauuccacacagcuaaggccacuuuaucucaggagucugaccauggcaggcacaggcaucaaacaagucuccuucucucucuuucucgcucucagcccucaagucuggaugauagaagaggcagccgcccccgguccauggugcgguccuucacgaugccuuccucaucccgcccucugucuguggccucugucucuucccucucaucggacagcaccccuuccagaccaggcuccgacgggugagucaagcucacagcagggcugagcugagcagugagggcuugggggaucuggaaggagccacccagggcucuggguuuauuuucuuacaacugaggauuuuguguucaucaaaauuaucuuugaaacugagacccuccgagacuuucugaccguagugcccaauauuacuuugaggucgugugaguuguugagaaaaacauccucucuuuggguaccacuuugggugagguuuucauccaauuuagaaccuccagugaguguucaguccucuucagcauggcuuagaacaagcuuguccacccgcggcccacgggccacaugcagcccaggauggcuuugaauguggcccaacaccaauccauaaacuccuuaaaacaguaugagauuguuuuugugauuucuucuuuuuuuuuuuuuaauagcucaucagcuauuguuaguguuaguguauuucauguguggcccaagacaauucuucuucuucuaauguggcucagggaagccaaaagauugggcaccccugggaaaaagcaaggugcaguccgggcuggccaagcacuuuguacuuuucaucuccuguucaccuccaggguguugugcccggacaggagcugguguggucugaccaugacacaaccuccacugucccccugugacaccauucugccaagccaacugucacagagucaggcuuucaugauggauggccgggccuucuuuuuuuuuuuucuuuuccucccuuccucauuuuuuuggagagcaaauguuuuguuuauuuuuguuucugcugagguuuauugccuuuuaaagggaaaugguguuuaagugaaugcuucugagaaugaccaucugucccuacuuuuuaggacaacucuggaaaauaaaaggcauauuauccuuuuuaaaaaauuuuguuuuugaggcagacucucacucugccacccaggcuggaaugcaguggugugaucacagcucacugcagccuccacuucccaagcucaagcgaucauaaccauuuguaagugaacaguucgguggcauugcguacguucacaucgcugugcagccaugaccaccauccaccuccagaacucuuuaauauugccaaacugaaacucuguacccauuuaacaacaauuccccacucuuuaccucccauauugauuaaacacuaacuuugcauucuuuccccccaccccugacacccugacaaugucuacuuucuuuuuuuuuuuuuuugagacggagucucccucugucgcccaggcugagugcaguggcacgaucucggcucacugcaaccuccgccucccagguucaaacaauucuuuugccucagccucccaaguagcugggccuacaggcacaugccaccaugccuggccaauucuuuguauauuuaguagagacgggguuucaccauauuagccaggauggucucgaucuccugaccucaugauccgcccgccucggccucccaaaaugcugggauuacaggugugagccaccgcgccuggccaacguccacuuucuaucacuaugauuuugacuauucuaaauacucaugggccaccuucuuuguacaaggccacuuuggagaugcauuuuugcucuugaguacccaauaguuaacauuuauugagcacacacuguggcucuggcauuagcucagguuauugcaaagagaacugcaacauugguauuuuuuuguauuuuugagcggcaagcauguaaaguuuguucuucuacaaaaagaaaaaaauguugcaugcaauuuaaacaacacagaagaaccucuaauuguuuuacugcugauuuguacaguuguuuguguguccaaucccauuuuguuuacaauccaucacccuaucaaacccacaggcaucuggcccccucaacacacagaaacaaacuuccagagagccccaagggacggcucaacucggauugcccuuuguugccaacgacugaugugcccgauggagaauugcaaacuauccccauauuuuuucuuaacaguaauuuuuaucagcgucugauauuuauaaggccaaguccauauggaaauucucaauuuagagguauuuaaaucaugugugcuugucacuuacagcaagauugcuaaagaaauuuaauucaacuucuccccgagaaaauccccggacugguuauggaaagguuuuuauauuucuaggaacauagggguuaggguggaaauuaauggagagguuuuagacagaagaguggugaauugcacaugugagcucaggcugcuggcucuuccccagaaggcauuuguuuaaccuuuaacuggaaggcgucuuuauuacaguccagauuuguguucauucuugggguuaccacccuuugcuagcuaacuaauguggagaaaaugaggcuuuggucucaaauggcacagguuacaugcagaauaaaguucauccuguaggcaguugcuucucguaauaugaaaauuuaaaacuccaccugccuuucucuggguucuuuguauacgcaucaggauuucacaacccgggucuucucccugagcuaaacagcaucuacuaauccuuuucuuaccuacauuaucucaaguucugcuaaaccuagaauaaaaucaugaaauguuugguuguugcuuauaauagauaaaauauuucucaccuaauggauauggauguauuguauauccagugugaaaaguccagaugucccaaaaugccuuaaugaucuaagucaauauugguauauuuuaucaaucaguuuaaauuuuuuaagcauuuuaguauagaaaaaugucaaagcugaguacaguggcucaugccuaaaaucccagcacuuugggaggcugaggcagguggauugcuugagcucuggaguucaagaccagccuaggcaacauaacaaaaccccaucucuacaaaaaaauauaaaaauuagcugggugugguggugcaugccuguagucucagcuaccugggaggcugaggugggaggaucaccugaaccuggagagguuguggcuguagugagccaugauugaaccacugcacuccagccugggcaacagagugagacucuguuucagaaaaaaagaaacauuucagauauguacaaagugggccaaacaguguaaugaggcccccaugccccaucaugcagucuugacaauuaucagcuuuuaacuaaucuuuuuuuuucaaucuguaucaaucauauuuuccagcaaaucucaaauaucauauuuuaucuauagcuauuucacuaugaauuucuaauuuaaacucuuuuuuaaaaccauaacucgguuauauuauauaaacuauaguaauauaguuuauuucacaccaaaaauauugacaggaauuccauauuauaauaauacaugaguguuaauuucccauugucaugucuuuuuuuuuaguuugaggcaaaauccaaauaagguucccaccuuguaccuugcacuugguugauauuaucucuuuaagucucuuuuaguccccuuuucucccuuguaauuuauuugugggaaauccuagguuguguauccugucaugguccccaccaucaggacucugcugauagcgugcccuaucgcauuguuuaauucgcgucucgauucuccauauucccugcauauuggugguugaaucuagcgauuugaucagauucagauuugauuuagggacaagaugacuucauagguacuuguguguucuuccauucagaggcacaucauaaccuguucucucucuuauggagauguuaacagcuauugauaaucagugcuuagauucaauaccauuauuguuuacauagugaccugcagcagauccuacugcacagccauauuagaugagagaagcaaagaauagguggugguccuugcucuggguagucugcaucuucagcagauuuaagcgcaguuuugcaaaugauccuucccuuccugguucaucuuacuccccauuaugggacacacaacauggaaauaaucaacagugagcaaaucaauggggagcaagauugcugcaaugaccaucuuuuuuuuuuuuuuuuuuuuugagacaggaucuggcucugucacccaggcugugcaauggcacagucuuggcucacugcaauuucuaccucccaggcucaagccauccugccaccucagccuccugaguagcugggacuauaggugcacaccaccaugcccagcuaauuuuuguacguuuuaucgagacuggaucuugccauguuggccaggcuggucucgaacuccugagcucaaaugauccaccugccuuagccuccccaagugcuaggauuauaggcaugagccaccaugcccggcccugcaauggccuucuuaaugagaacaguggcuuucuuccaagugucccauucagaaauacauguaaaagaaacuagagcuaggaugaaaauaugacuggcuggcuaaauuaucuucucuugaaaucaugcuccccuugaagaagccaauugcuucuccaggcggucaaggaagucagguuuggaaguugcugugaggcucagagcuccaaagagcaggcuguauuuugaaaauguaagauccuaguaacagcacugccuuccacgugaguuaugcuauaugguuuuucaggcgggcccaugccuucauccauucaaccaucucuccugacuccuccucacagcaggagcugcuagggaugagacuccagucuuagaguuggauccauuucuuccaccuccugauaggacuucuaggaccagaaacaggauggacaugccaaucuuguguuggagugacaaaucacaaucauguguggauaugcuugcacacuaaccuuuugguacaugccuuagacacuagccuaagauucauuuacuccaugguauaaccacgaaugugucuuuacagcaacugugggguaggcagaagggugguggugucuuuauacccuuuuauaagugagacagcugccagagguuacgaggacaucaagagucacccacaguggcagaccuagaaugcaggucuucugucuccagcuuaguugcuggcuggaaaccucagggcaucuccaagcaccugugagcuggcccuggcuugcuucugacugagccaugcaaagugcuuucaccugaaaacaaccgucuaucuguaaucauagagccuuggucaggaucaagguagcagacauuucuuugcauugacgucuauuuuuccccauuaaaaaauagacaaaauauuucuauauaaaucucuaaaagacgaggguuccccuuuugaaauaugcccuaaauaccauccucccaucguaaaugaacaauuccuuaauaucaucaucaaauauccggucagacuucacauuugcccuaucgugcuaaguguucuaucuuuuuccaguuuaucuguguugggauugaaacacaguccuugcaucuggugacuguguaucugaagucacccuuggccucccuuuuaaaucacugcuuucauuguaaaugucuucgauggauugugagugacuuuacacgugucugugggcuggaaagcaauugcucuccuauuaagacgucauugaccuuuccuuuagguuugcccuggagccucuccugccaaagaaaaugcacuccaggucccaggacaagcuggacaaggaugaccuggagaaggagaagaaggacaagaagaaggaaaaaaggaacagcaaacaucaagagauauuugagaaagaauuuaaacccaccgacauuucccugcagcagucugaggcugugauccuuucggaaacgguaacccgacaggguaucuuuccucgcucugcgguagcuucagggaccuaccuuugccccaccuguagccaacagggcugacggugggcucuuauugaacuuguuauaaauuagcaacucagaaaccugggguccuccuccccuaaccucaaaugucccaaggcaguaggacagccagagccacagagagaccuggaggaaggugggcuuagcauuugucccccuuccgcagggccuggggcgaggccgcucugcugcuaggcucugccgcucuguuggacuuguuuccuacacauguccuaauaucccagaagaugagcaggaguccuuuuguugucaggaaacaguccuugguguccgcuaaugccuuccccuugccccuugcugacuggaacucuucuaagcuaguuacggcccaaguguuaaaaucagcggaacuagaauccaaagaccucuucccaccgggccccagaagcuggacccaguccugggguauccugcucugucucaucugcuccaccuuuaaaucuccuggccgucuuucacaaggacuuaacagggacuucacaugacccguacugcugagcugaccuugaagacgggucccagugagucucguucauuccacagucgugggcgugugagggcggugaaacccaggagccggcucucauccuggggcugggccugagggcugauccucccagaagugcaccacauugggaaucuguguucgucuguuuuguguuacugcaaaggaauaacugagccugcgucauuuaugaagagguugauuuggcucaugguucugcaggcuguacgagcacagcacuagcaucugcuuggcuucuggugaggccucaggaggcuuuuauucuuggcugaaggcaggggaggggagcaggcgugucacauggugagaaagagaguauggguggggggugggggguguguuccaggcucuuuuaaauaacuaggucucacaugaacugauagaaugaggacccacucauuacccccauuacugcaaggacagcaccaagcccuucacgagagaucugcucccaggacccagaugccucccacuggccgcacccccaacauuucaacaugagaguuggagaggacagauauccgagcuguaucagagucugagugcgaagaugaggcacagcccacuuccagggcgaacuugauuccaaaagugcuagcuguagugggaaacaaaaauaaagaaggaguucucaugggcugucagcaucaaaggugaagucaggauuggagccgcccucccuggaaaugggugggugucugcuugucucagcccugggcgucggcgggcugugauuagaggguuagacauacugcacugcuuguuuauaacuuaaaacccagaagguacguuuuaucuauacuucaugccacucagaaagcagucacaugcuaccuggcuaucuagagguggaaggcaaacgccccagccaugacuugacguccaacaggccagcgcugcucugcggccuguggguaggugcuguggcugcagcugggcuggagaauucccaugaggguggccgaggaugucagaccaggggggcacuggcuggaggcuggccugaaguacccagacgcucagcguccagcagauugagggguuccugaccacacagcaugcucugucugcuauucuggaaaguugagaugcccaccaccccagaggcuggcugaagucuccaucucuuaagccccagguagauuucucaagucucaaaacauuauagcuggguaggggaaugaacagaagcauuuuugaauauuacuuagugccagacacugugcaagucuuucauacauuuuaauuuaagcuccguuuuaagaugcuaaauuggagggccucggagcaguugugccaaguggcagaauugaucacagcugacuugugugaaaagaaguccaaggacacaagcacacacgugacaggcacagagccagcacagugcaucuucugucccugcccuugguggcccaagcauccuucuaggguccuugcaagcagcagggcuaggggcagccccacgagggcugccuccccacggcuggcccuagcacccucagcaaauccacaggaacucaccaaggucagagcacagaaccuuggcggugcuucucagcaucuggcccagugucagcuugaaccuuccagcaccaggaggcggagaauccgaaccucccacugggggacaggcuuacuauucuugguccagcccagcaaccugucugucuacgcagagggcaccuccuccaggggacgggugccggcaaggucugugaggacagucagacaccugaaguuuccuagcaggcggcugcgugccagugaccagccaugcgcaggaggggaggugcgggggaggagguucacaggaacagaagcagcaacccauucccuggggacaacaccagccacccccccaccacccccacuguaguguccuccuugcccuuccccccugcgggccuccccugcaccccagcuucugcaaagguuuucccuccucaccccuguggcuggguucgguuuccuacuugauuugcaucaucaacaauuuccugaccuuuagcugagccucuccagccagagccuccaggcugugauuugcaucucagcaguccagccuccucagcucucugagucagaaugugcccucccugggaugcagggaggccaggagaagcaccuuaggagaccccaaaucucucuugccagcacauucaccuucagagagcccagcgcuucacccggccuuuccugacuucccacagcaguuuugcugccuggaacaaggccauuucuucagaggaggugcagcuccugggcgcuuggcucccccgacagcacaggacaguucuggaaauagaccuguuggccuggcucugucacucauuuaccagagggccugaaucuuccucccaagccuaguucccauuuccuccuuccagccucaguaaccuccagacuggcccuggcacagcugacuccuccuggggcagacauugaagccuaugugcucuguugcucacccaaaccagcacagcgcauccaccaggcccccagacccagccgcagccccaagcccagagcugcccacucaccugccugcccuuccuugggggagaacguugaccccuccuuuuuggcuggguuaauacguuuucuaauuacuccugcgucagaguauuuuguaacugcuccuguuccccaaagccugaugaucugagaccaaccuguaagaaauauguaaauacaacuuacugauggaacaaacagggaaagggcuuaggugggggaaagucaagugccuccaaaagccagagaugagcaggaaaaaaugcauugaaaaggagagaaaaagaaucccugcccaguaaugaccuaggaugagagaagaagcaaaggaaaggaauagcaaaaauccuucagccaauuccuagacuuucagguacacgccaaggagaccaaagcaugcugagcacagcugggaauaauucugccauggaacaggccauugauuuuguucuugaccgcacggauguugccccguguguccuugcuggcuaucugcaugucuugcaauaauacucagccacuuuugcaucuauauucaggucaccugcgaugugcuguccagcccaggcugugugaggacagcagugccagccccucgugugggggaggucugcuguaaccacaugcugggcggcuccaaccccagaaacucauugucucccaguucuagaggcgucggcagggcugauuccuucagaggcugugagggagagucuacacaugccucucuccuccugucuggggguuugcugccaucucugguguuucuuggcugauagaagcaucacccugaccucugcuuucaucuucacguugugcccucccaaauuuggacacguccauguccagauuucccuuuuucauaaggucaccuguccuguuggaauuggaccuguuacugggaagugugcagguccuugguucuuagucuucuuagaggaaagaauucagccaagagaccaauuaguaaaguagguaaaguaggcuuauuaaggaaauaaaaguagcauggacucugggagaggagcaggcugacccuguggagagcagcccccaggaguucuguguugugguuuuuauauuggacuguuuuaagcucccaccucugucuuaagccucucccuuugucuuugucuguuuucccugcucugucuuaagucuccaccuuuucccugccuaguuccugcccagguuuguggggcucucccuugcugcuaguugaugugcacacguggggcucagugaucaguaggaaccuaccuaauggcggcauugcucauuaccgccaccccaagaaggucauacaguggucaaaucuguacauacuguguguguguaucucuuaggcauucaucccuugcccuguuucccuccugaucagcauguagcuaguuacauugucacacguuagcuacagagggagcaauuacugggugucuuaugggguguuucaggaugcugccuccugccuagguauucuccuccccucugcucacaccuagcauguguguuuuggggggucucuggggcauaagguuuuccagaguuuccucccccggucccccauuccuuuucaugucuuacuaucugcccacucuaacaggcccacccuaagagccacaccuuagcuugaucauuugcaaagacccuauuuccaguuaaggucauauucuaagguaaugggggucaggacuucaacauaggaauuuagguggaaacgcaacucagcccauaacagaccguaacugugcucuuucuguccuuuugauguagauaaguccccugcggccccagagaccgaagagccaggugaugaacgucauuggaagcgaaaggcgcuucucggugucccccucgucaccguccucccagcaaacacccccuccaguuacaccaagggccaagcucagcuucagcaugcagucgaguaaguggaacgcuccccacauacgaaucgugcuauagcuccgugacuuccccucacugaaggcucugagguuagaagcgcuuccucccuccccuugcagcagagggugggaguuuagauaaacaccuggcucccugggaguguccccugggacaggcuguagagucuggacuuccgcaaaucaggccaaaauccagagcccaggucuccagcacuggaggggcagaaagugcagggucugucccaggguccauguggaggggaccugugaagcacguggaaccaccacacuuucuaucccaggacgcagagcugcaggaggccgugggccugcuugugucuaggacugugcacuggagaagcaccuucaggcaguuggcaacagcuaaggggcacagcuuauuuuucuaguuuugaccaauguuuaaauuacccuagaaguucccacaaaacugguggcuccaaacagcagaaauuuguucucugaagguuuuggaggccaaaacucugaaaucaaggagguagcaaguugguucccucugguggcuccaagggagagccugucccgggccucccuccagcuucugguggcucccagcagucccuagcccuccuuggcuuguggccacaucacuccccucucugccccugucuccacguggccuccuucucgguguccucucuucuuacaaggacaucagucauuggauauaggguccacugcaaauccaggaugaucucaccuugagauccuucacuaauuacaucugcaaagacccuacauccaaauaagguacauucugagguucuggguggcccuaagaggucuacauuuuggagagacucuacucaacuuacucuaaguggcagacagcuuuucaccacuagauucagagccagcagagaggagaaaucuuggcagggagaaggugcugaggauggggacggcagcagaaccggggagcccacucuccuuccuguggcacagagaggggucccaggcaggagagcucugugcccuguggcgagggcugugcaaggcagugagugauuguccucugcuccugauuuuccucuugcugaaaggggagcagucaugauucuggagacugucaguggguggggaggcuggcugcaggaguggaugcgugagucuaauugaguaggcaaagagcuuucugggcacuggauaugucuuuggagggugcaucuucacauccuugcacuauuacuacaugaucuuucuaaaaauguguuuaaaaucuauuuuaauauugaaaacagacaccaucacugcugcugcggaaaacaauuuagugguuccuccaaaguucaauguagaauaaaccuauaauaucaacuggcaguccugcuucuaggccuguacuccaaagaauugaagacagggacucaaacagauacuuaauauucauagcaguauuuuucaagagccaguaagcaaacacaggccaaauguccaucaacugauggccagauuaacaaaauguacguccaaagaaauguccgugcaauggaauauuacccagccguagaaaggagugaaguucugacacgugcuacagcacggacgaaccucagaaccaugaugcugagugaaauagaucagucacaaagggacaaauauuauaugacuccaccuaaaucaaauaucuaaggcaaguucauagagacagaaaggcauggcucacgccugucaucccagcacuuugggaguucgagguggguggaucagcugaggucaggaguucgagaccagccagucaacaugguaaaaccccgucucuacuaaaaauacaauaauuagcugggugugguggugcgugccuauaaucucagcuacucagaaggcugaggcaggagaaucacuugaaccugggaggcggagguugcagugagcugagaucgcaccacugcacuccagccugggcgacacagcgagacuccaucccaaacaaaaagaaaagaaaaaaaaaaagaaaguagaauagaggauacuaggggcgggagagaggaguggagaguuacuguuuaauggguacagaauuccguuuggggugauggaaauguuucagaaauacaucauggugaugguuaucccccacggucgaugugauuaaugccaccaaauuguccccuaaaggauggcuaaaauggcaaauuuuaugucguguauaucuuaccacaauaauagcaaagaaguaggcagcaaucaugaggacagucacucaccgaagccuucguauuucccucagccccauggcagagcuuccuuauaagcuuacaguguggccuuccuagcaugcauuuuccuaauaaaggauuuuucaucagaugaauccuaggggaaaacuccaaaagagacucaucaguaaaaauguccauuuuucucucuuuaauauaaaagaaaacaaauuaucuuuaagagucucaacaagguuugagaaaauauccugccuuaaugauuauuccuccguuugaaaacggcuauuuuuuccaguuuacuuuaaaaaucaauuguacuuccccuuggcuuauuuaaagcaacagccacagugacugcuauggcuaaugacuucaugucauacgacuguggauuuuccuguggaaagagaugggaagcuggguggcuggucggcguguuagacuuugcuuagugaaucucuccaggugauaacugcaggggugacugcaggggccuggcuuggcuucgaaagcaguagcagcagcagcggagacgguccuguggcacccagcuguuuaacuuccaccgaggcagggggcccgagcagggacagaagaggccggggugaacaucacccuuucuacaguggcucgaugccuugcuucacacuccaguuuuaguguucgugugauacuugcuauucucuuucuagaacauugccguuaggagagggucccacccuuuguguucgcucccucccugcccucaucugcucuguugacaaacguuuucugccagaugaaguguuucugcugugccugccucucugggagggaacguggagcagcucccugagcauucaggcuccguggggaagucgggcugauuuuaaauagaucccgguuuuccaggcuuggagcugaacggcaugacgggggcggacguggccgaugucccacccccucugccucucaaaggcagcguggcagauuacgggaauuugauggaaaaccaggacuugcugggcucgccaacaccuccaccucccccuccacaccagaggguaagucggcaaucugaaacacaggcuuucauugcuucgccuccacaaaguaggacgagucccucauuccagauacuagcagguuuacuucgggcuagugagcacaugaggaaaaccauguaugaugggcccggguuugauuuugcaaaaagauaucgaagcaguaaggacuccaguggguaagaucuguggcucugcgucauuaucaauaacugcaucaaaaagcacauuuugauaucaugccucagaacgaggaagaggauagacauuccaagguugucaucgguuaucaucaccauggagaucauuccacuggagaugcaauucuaaugacauuuugauuuuugagaaguagcuuuucuaucaagaggucugacuuuuuaaagagguuggccaauaucgcccuguauggcaggcaccuguuguacaccugcuuggcccuggagaagcuugucuccaaacaucccuccaggcagccucaccuggugcugggagcuccuggguggugacaggcacucaccuuacggagacugcagaggacagccagguuuggcuccugggcacagucauccucacugugcccccaccccugggcacccuccccagugcuaguucgggggugcugaccuggcuuccuccagcagcacuggccuuuguaagccuaagcaaccugcuggaaccccucuucagcgugagucccugaagcugguaccccccagcagcuguuuuagucauucaugccacccaaagugccuugugccaaacagccccugggccugccugcccguacaaauauuagucaaagucaugaaaagccauuuaaacaagcaccucaguuaccaguugacaguucuagaaacauucuuuugagauccaccccguuccucuccugguucucaaggaugcugucaggcgucacucaucccugcgggucccagccccauccucaugucgggcccaggcauguguggagggcagcaugagugggauggaggcgggcgagcgauugacucagccacggcgggaacuucugcuucuaggcucaggccuccccaggccauguuauucacagccuuugacaauuaaaucaguggugucugaaggguaaaauaucccucuucauauguggacagcuggccguauuuuuuuugcuauccagccuuagugaaguaauuauauggccgcaaaacuccuguagaacauugaaaacaugagauuguuggguggcucuguuuuuuucauaauggugagacaugguuuuuuuuuuuauuuuucuuuaauaaacaauauaaaucccacgugccauuucuuuuucuuuuuuuuuaauggagacucguugacggaguguuccacaaggucauuacaucccuuaugagaggaguggaagagagaggguguuuguguacagcauacguauuucaucauucccuuuguaucagaaaacuaaacaagcagucaucuuuaauaucaaagaggcagauugcucuucugagacccaagugccauuuaaacaggcucccucucccuagagacgccucgauggggaaccgguccuggaggaggcaccagguuccccugugaagagggcuuucuggcaggcuggaaugguuuguugcaccacagaaauggaagccggaccuuccccggccauuucuaacuacuugugagaguaaaaggagauucgggggggucuaacaagaauauuggguugcuuggaguauuguuucccuaacagcuucguuaauuggucacauucucuucucucuauuuuauugcaaaggcaggaauguucccccuagucucccuacacuaguaaacugaaaauucuaaacuuagaauuacagccaauuccucuucuuguuacaaaucaacuccgggguaacauuuuauugucucaauuucuuggauacaccauuguggguuacugaugccacauacaguugauuaaguaagggauaacauggauuagcucucucucaauugauaaagggcgugugaauucaauuagauuaaugacccaggugucuuuggucuuuguuucuuguuuaauuuacuugcagccugagugcaugcucaggugacacgcuggugguuaguaugucaucauuaggcagaagcgguugcauuuccuggggugccucccuuugcacaggcccugagagcuguucuaggauaaugaucauccaucugccaugaugggggugugaucaauauccuccugucacucucauugaucagccucaggcuuguaggcaacucugucuuuaguuguugccacuaagcugucauuucuuuccaaauggcucuuccugucaguaaucugagcuuacugaguuuaucaccauuaaucauuuugcuuaauggugauaaacuuuugacaugcucauacuuggcauagaggucauuugcagcgcuguguugguaucaggcuguguuagugugguccuuaccugcuccucauuggccuaucagugaguguggcuuucacauguaaacaaacaguuucaucagaccucaaaauagaugucucuuuuaacgguucuaaccaaccuuaaaaagacuuaauuguuguuuuaccuuccuuaauauaaggucauacacucauaggacaucuuuauaucagcuuuacuuuuccacauuuauucuccucucuguguuaagcauuaggucauuuuuguauuuacuagucugugaaucaggaggaaaucugggcgaugagugagagacuacugcgucacugucuauccuugaaaaccucuuuucucacauucagcuaaaugcaaacccacacugagaggcugauaaaaauccacucuuacccuuaaguuagacgauaguguucugugauuucauucugguucuucugccuguggcaugcucccacuuacccuggucuguucacuucuucauucauuuguuuacuuaccuguucauuucuucauuuauccacugacucguuuauucacucauucauuuauucacucauucauccauuuuucuauucgauugacccauauuucuagagagucuccugcacaucaggugugugugaugggcaugagggucccaaaagcaauagggugcagcugcccucagucauaacacuccagccagguccaucagcaagggguuugcuauuaucuucacauuggaaauuaauguucuuuuuuggaaucuaaaguaauauaugcccaugagcugaagccagccagccagccaccuguuucugugaauaguuuucuuggaacacagccacaccccuuucuguacacacugucaaugaccgcuuuucggccacaccaguggcauugaguggcugcaacagagaccguguggccugccaaaaagcuggaaauauguacugucuagcccuuuccaggagaagcuugcuaaccuuugcccgaagcucagaaagcaaaagaaggucucucaucucaccccuggagagugccucuaaggacuuauuuaucccuuagacaauagauggauaacuuggucgauagcaucuagauuuaaaaaggccacgcaaagggcaaugguaccucucaggggcugugcagacggugggagagugcucagaggcgucagaaaggcccaggcccauagcagcccagucuugagccuaguagaccugccagccccaagucggacaggauggagcccaacucauguggggaggaugguuccggcugaguggcugugccaggucagaccccaccuggagacggugucuuuucugucaggacaucaguuaugugacaucuuccccauccucauguuuuuuagcaucugccaccuccacugcccagcaaaacuccgccuccucccccuccaaagacaacucgcaagcaggcaucgguggacuccgggaucgugcagugacgucgcaagccucucuggaaagagugugcugccccuccccaucuccaugcccucuccuucuguguccccugagucugcuguuuaccucauugggccugugauguuaacauuucgugcgacugcuuuuucuucaaaggaguucaguucucaccauggagugaguggccuuuagcgucauggagcaaggugggucugggagguagauauggguccgggaugugcuaucguaguuaucagaguugggggccucugagugugucuggcucugagagagucugagucuugcccaaacauucuuucuuuuugugccaaaugacuugcauuugcaaagagcucaauugcucugagcucagccaaguaggagaggcuaggccaucacucuuaggaagcuguguagugaugauguauaagaauccuccucacugucaugggauguuguauccagccccuccuuguuccagccgguggugugacuucguugguugaggugugucuccaaccuacaucagaccaugaaguucaaccccuccagggaagcuccugauuuccccugcauaauugaaaauaggauauuucucagcuauugaacaguuacuaauuuaugggguggaaacagcauuaagaauacugaaucaaauggaaaaacaaaugaauacaggaagauaaguguucguucuuuucugaaaaagaguauguguaccacaagagcugguuuuaauugggugaauuguuuuuguccucauucuguacagaaauuuguauauaugaugguucuuagaacuuguuuuaauuuuugugguccuuccguuuauuauaauaggcguccaccaaugauuauccauauguguucuuaauuuuuaacugcuggaaguguuaaaacacacacacacacacacacacauuuuuuuuuugagaacuccaaaguccugaaaauuuugguggacaaugauuuuuaaaaaacuaacuuuguauaaccuaauauuuguauucucucaucuauauuuuuuuauucacuauaaucaugauacucuucuaauagacuuaaaaguuaaucauugacaacgaaaaauaaaauguuauuuuaaaaga

SEQ ID NO: 192936 - RNA, 656758 nt, Homo sapiens
  misc_feature (484712)..(634711): n is a, c, g, or u
ucuuuuaaaauaacauuuuauuuuucguugucaaugauuaacuuuuaagucuauuagaagaguaucaugauuauagugaauaaaaaaauauagaugagagaauacaaauauuagguuauacaaaguuaguuuuuuaaaaaucauuguccaccaaaauuuucaggacuuuggaguucucaaaaaaaaaauguguguguguguguguguguguuuuaacacuuccagcaguuaaaaauuaagaacacauauggauaaucauugguggacgccuauuauaauaaacggaaggaccacaaaaauuaaaacaaguucuaagaaccaucauauauacaaauuucuguacagaaugaggacaaaaacaauucacccaauuaaaaccagcucuugugguacacauacucuuuuucagaaaagaacgaacacuuaucuuccuguauucauuuguuuuuccauuugauucaguauucuuaaugcuguuuccaccccauaaauuaguaacuguucaauagcugagaaauauccuauuuucaauuaugcaggggaaaucaggagcuucccuggagggguugaacuucauggucugauguagguuggagacacaccucaaccaacgaagucacaccaccggcuggaacaaggaggggcuggauacaacaucccaugacagugaggaggauucuuauacaucaucacuacacagcuuccuaagagugauggccuagccucuccuacuuggcugagcucagagcaauugagcucuuugcaaaugcaagucauuuggcacaaaaagaaagaauguuugggcaagacucagacucucucagagccagacacacucagaggcccccaacucugauaacuacgauagcacaucccggacccauaucuaccucccagacccaccuugcuccaugacgcuaaaggccacucacuccauggugagaacugaacuccuuugaagaaaaagcagucgcacgaaauguuaacaucacaggcccaaugagguaaacagcagacucaggggacacagaaggagagggcauggagauggggaggggcagcacacucuuuccagagaggcuugcgacgucacugcacgaucccggaguccaccgaugccugcuugcgaguugucuuuggagggggaggaggcggaguuuugcugggcaguggagguggcagaugcuaaaaaacaugaggauggggaagaugucacauaacugauguccugacagaaaagacaccgucuccagguggggucugaccuggcacagccacucagccggaaccauccuccccacaugaguugggcuccauccuguccgacuuggggcuggcaggucuacuaggcucaagacugggcugcuaugggccugggccuuucugacgccucugagcacucucccaccgucugcacagccccugagagguaccauugcccuuugcguggccuuuuuaaaucuagaugcuaucgaccaaguuauccaucuauugucuaagggauaaauaaguccuuagaggcacucuccaggggugagaugagagaccuucuuuugcuuucugagcuucgggcaaagguuagcaagcuucuccuggaaagggcuagacaguacauauuuccagcuuuuuggcaggccacacggucucuguugcagccacucaaugccacugguguggccgaaaagcggucauugacaguguguacagaaagggguguggcuguguuccaagaaaacuauucacagaaacagguggcuggcuggcuggcuucagcucaugggcauauauuacuuuagauuccaaaaaagaacauuaauuuccaaugugaagauaauagcaaaccccuugcugauggaccuggcuggaguguuaugacugagggcagcugcacccuauugcuuuugggacccucaugcccaucacacacaccugaugugcaggagacucucuagaaauaugggucaaucgaauagaaaaauggaugaaugagugaauaaaugaaugagugaauaaacgagucaguggauaaaugaagaaaugaacagguaaguaaacaaaugaaugaagaagugaacagaccaggguaagugggagcaugccacaggcagaagaaccagaaugaaaucacagaacacuaucgucuaacuuaaggguaagaguggauuuuuaucagccucucaguguggguuugcauuuagcugaaugugagaaaagagguuuucaaggauagacagugacgcaguagucucucacucaucgcccagauuuccuccugauucacagacuaguaaauacaaaaaugaccuaaugcuuaacacagagaggagaauaaauguggaaaaguaaagcugauauaaagauguccuaugaguguaugaccuuauauuaaggaagguaaaacaacaauuaagucuuuuuaagguugguuagaaccguuaaaagagacaucuauuuugaggucugaugaaacuguuuguuuacaugugaaagccacacucacugauaggccaaugaggagcagguaaggaccacacuaacacagccugauaccaacacagcgcugcaaaugaccucuaugccaaguaugagcaugucaaaaguuuaucaccauuaagcaaaaugauuaauggugauaaacucaguaagcucagauuacugacaggaagagccauuuggaaagaaaugacagcuuaguggcaacaacuaaagacagaguugccuacaagccugaggcugaucaaugagagugacaggaggauauugaucacacccccaucauggcagauggaugaucauuauccuagaacagcucucagggccugugcaaagggaggcaccccaggaaaugcaaccgcuucugccuaaugaugacauacuaaccaccagcgugucaccugagcaugcacucaggcugcaaguaaauuaaacaagaaacaaagaccaaagacaccugggucauuaaucuaauugaauucacacgcccuuuaucaauugagagagagcuaauccauguuaucccuuacuuaaucaacuguauguggcaucaguaacccacaaugguguauccaagaaauugagacaauaaaauguuaccccggaguugauuuguaacaagaagaggaauuggcuguaauucuaaguuuagaauuuucaguuuacuaguguagggagacuagggggaacauuccugccuuugcaauaaaauagagagaagagaaugugaccaauuaacgaagcuguuagggaaacaauacuccaagcaacccaauauucuuguuagacccccccgaaucuccuuuuacucucacaaguaguuagaaauggccggggaagguccggcuuccauuucuguggugcaacaaaccauuccagccugccagaaagcccucuucacaggggaaccuggugccuccuccaggaccgguuccccaucgaggcgucucuagggagagggagccuguuuaaauggcacuugggucucagaagagcaaucugccucuuugauauuaaagaugacugcuuguuuaguuuucugauacaaagggaaugaugaaauacguaugcuguacacaaacacccucucucuuccacuccucucauaagggauguaaugaccuuguggaacacuccgucaacgagucuccauuaaaaaaaaagaaaaagaaauggcacgugggauuuauauuguuuauuaaagaaaaauaaaaaaaaaaaccaugucucaccauuaugaaaaaaacagagccacccaacaaucucauguuuucaauguucuacaggaguuuugcggccauauaauuacuucacuaaggcuggauagcaaaaaaaauacggccagcuguccacauaugaagagggauauuuuacccuucagacaccacugauuuaauugucaaaggcugugaauaacauggccuggggaggccugagccuagaagcagaaguucccgccguggcugagucaaucgcucgcccgccuccaucccacucaugcugcccuccacacaugccugggcccgacaugaggauggggcugggacccgcagggaugagugacgccugacagcauccuugagaaccaggagaggaacgggguggaucucaaaagaauguuucuagaacugucaacugguaacugaggugcuuguuuaaauggcuuuucaugacuuugacuaauauuuguacgggcaggcaggcccaggggcuguuuggcacaaggcacuuuggguggcaugaaugacuaaaacagcugcugggggguaccagcuucagggacucacgcugaagagggguuccagcagguugcuuaggcuuacaaaggccagugcugcuggaggaagccaggucagcacccccgaacuagcacuggggagggugcccaggggugggggcacagugaggaugacugugcccaggagccaaaccuggcuguccucugcagucuccguaaggugagugccugucaccacccaggagcucccagcaccaggugaggcugccuggagggauguuuggagacaagcuucuccagggccaagcagguguacaacaggugccugccauacagggcgauauuggccaaccucuuuaaaaagucagaccucuugauagaaaagcuacuucucaaaaaucaaaaugucauuagaauugcaucuccaguggaaugaucuccauggugaugauaaccgaugacaaccuuggaaugucuauccucuuccucguucugaggcaugauaucaaaaugugcuuuuugaugcaguuauugauaaugacgcagagccacagaucuuacccacuggaguccuuacugcuucgauaucuuuuugcaaaaucaaacccgggcccaucauacaugguuuuccucaugugcucacuagcccgaaguaaaccugcuaguaucuggaaugagggacucguccuacuuuguggaggcgaagcaaugaaagccuguguuucagauugccgacuuacccucugguguggagggggagguggagguguuggcgagcccagcaaguccugguuuuccaucaaauucccguaaucugccacgcugccuuugagaggcagagggggugggacaucggccacguccgcccccgucaugccguucagcuccaagccuggaaaaccgggaucuauuuaaaaucagcccgacuuccccacggagccugaaugcucagggagcugcuccacguucccucccagagaggcaggcacagcagaaacacuucaucuggcagaaaacguuugucaacagagcagaugagggcagggagggagcgaacacaaagggugggacccucuccuaacggcaauguucuagaaagagaauagcaaguaucacacgaacacuaaaacuggagugugaagcaaggcaucgagccacuguagaaagggugauguucaccccggccucuucugucccugcucgggcccccugccucgguggaaguuaaacagcugggugccacaggaccgucuccgcugcugcugcuacugcuuucgaagccaagccaggccccugcagucaccccugcaguuaucaccuggagagauucacuaagcaaagucuaacacgccgaccagccacccagcuucccaucucuuuccacaggaaaauccacagucguaugacaugaagucauuagccauagcagucacuguggcuguugcuuuaaauaagccaaggggaaguacaauugauuuuuaaaguaaacuggaaaaaauagccguuuucaaacggaggaauaaucauuaaggcaggauauuuucucaaaccuuguugagacucuuaaagauaauuuguuuucuuuuauauuaaagagagaaaaauggacauuuuuacugaugagucucuuuuggaguuuuccccuaggauucaucugaugaaaaauccuuuauuaggaaaaugcaugcuaggaaggccacacuguaagcuuauaaggaagcucugccauggggcugagggaaauacgaaggcuucggugagugacuguccucaugauugcugccuacuucuuugcuauuauugugguaagauauacacgacauaaaauuugccauuuuagccauccuuuaggggacaauuugguggcauuaaucacaucgaccgugggggauaaccaucaccaugauguauuucugaaacauuuccaucaccccaaacggaauucuguacccauuaaacaguaacucuccacuccucucucccgccccuaguauccucuauucuacuuucuuuuuuuuuuucuuuucuuuuuguuugggauggagucucgcugugucgcccaggcuggagugcaguggugcgaucucagcucacugcaaccuccgccucccagguucaagugauucuccugccucagccuucugaguagcugagauuauaggcacgcaccaccacacccagcuaauuauuguauuuuuaguagagacgggguuuuaccauguugacuggcuggucucgaacuccugaccucagcugauccacccaccucgaacucccaaagugcugggaugacaggcgugagccaugccuuucugucucuaugaacuugccuuagauauuugauuuagguggagucauauaauauuugucccuuugugacugaucuauuucacucagcaucaugguucugagguucguccgugcuguagcacgugucagaacuucacuccuuucuacggcuggguaauauuccauugcacggacauuucuuuggacguacauuuuguuaaucuggccaucaguugauggacauuuggccuguguuugcuuacuggcucuugaaaaauacugcuaugaauauuaaguaucuguuugagucccugucuucaauucuuuggaguacaggccuagaagcaggacugccaguugauauuauagguuuauucuacauugaacuuuggaggaaccacuaaauuguuuuccgcagcagcagugauggugucuguuuucaauauuaaaauagauuuuaaacacauuuuuagaaagaucauguaguaauagugcaaggaugugaagaugcacccuccaaagacauauccagugcccagaaagcucuuugccuacucaauuagacucacgcauccacuccugcagccagccuccccacccacugacagucuccagaaucaugacugcuccccuuucagcaagaggaaaaucaggagcagaggacaaucacucacugccuugcacagcccucgccacagggcacagagcucuccugccugggaccccucucugugccacaggaaggagagugggcuccccgguucugcugccguccccauccucagcaccuucucccugccaagauuucuccucucugcuggcucugaaucuaguggugaaaagcugucugccacuuagaguaaguugaguagagucucuccaaaauguagaccucuuagggccacccagaaccucagaauguaccuuauuuggauguagggucuuugcagauguaauuagugaaggaucucaaggugagaucauccuggauuugcaguggacccuauauccaaugacugauguccuuguaagaagagaggacaccgagaaggaggccacguggagacaggggcagagaggggagugauguggccacaagccaaggagggcuagggacugcugggagccaccagaagcuggagggaggcccgggacaggcucucccuuggagccaccagagggaaccaacuugcuaccuccuugauuucagaguuuuggccuccaaaaccuucagagaacaaauuucugcuguuuggagccaccaguuuugugggaacuucuaggguaauuuaaacauuggucaaaacuagaaaaauaagcugugccccuuagcuguugccaacugccugaaggugcuucuccagugcacaguccuagacacaagcaggcccacggccuccugcagcucugcguccugggauagaaaguguggugguuccacgugcuucacagguccccuccacauggacccugggacagacccugcacuuucugccccuccagugcuggagaccugggcucuggauuuuggccugauuugcggaaguccagacucuacagccugucccaggggacacucccagggagccagguguuuaucuaaacucccacccucugcugcaaggggagggaggaagcgcuucuaaccucagagccuucagugaggggaagucacggagcuauagcacgauucguauguggggagcguuccacuuacucgacugcaugcugaagcugagcuuggcccuugguguaacuggaggggguguuugcugggaggacggugacgagggggacaccgagaagcgccuuucgcuuccaaugacguucaucaccuggcucuucggucucuggggccgcaggggacuuaucuacaucaaaaggacagaaagagcacaguuacggucuguuaugggcugaguugcguuuccaccuaaauuccuauguugaaguccugacccccauuaccuuagaauaugaccuuaacuggaaauagggucuuugcaaaugaucaagcuaagguguggcucuuagggugggccuguuagagugggcagauaguaagacaugaaaaggaaugggggaccgggggaggaaacucuggaaaaccuuaugccccagagaccccccaaaacacacaugcuaggugugagcagaggggaggagaauaccuaggcaggaggcagcauccugaaacaccccauaagacacccaguaauugcucccucuguagcuaacgugugacaauguaacuagcuacaugcugaucaggagggaaacagggcaagggaugaaugccuaagagauacacacacacaguauguacagauuugaccacuguaugaccuucuugggguggcgguaaugagcaaugccgccauuagguagguuccuacugaucacugagccccacgugugcacaucaacuagcagcaagggagagccccacaaaccugggcaggaacuaggcagggaaaagguggagacuuaagacagagcagggaaaacagacaaagacaaagggagaggcuuaagacagaggugggagcuuaaaacaguccaauauaaaaaccacaacacagaacuccugggggcugcucuccacagggucagccugcuccucucccagaguccaugcuacuuuuauuuccuuaauaagccuacuuuaccuacuuuacuaauuggucucuuggcugaauucuuuccucuaagaagacuaagaaccaaggaccugcacacuucccaguaacagguccaauuccaacaggacaggugaccuuaugaaaaagggaaaucuggacauggacguguccaaauuugggagggcacaacgugaagaugaaagcagaggucagggugaugcuucuaucagccaagaaacaccagagauggcagcaaacccccagacaggaggagagaggcauguguagacucucccucacagccucugaaggaaucagcccugccgacgccucuagaacugggagacaaugaguuucugggguuggagccgcccagcaugugguuacagcagaccucccccacacgaggggcuggcacugcuguccucacacagccugggcuggacagcacaucgcaggugaccugaauauagaugcaaaaguggcugaguauuauugcaagacaugcagauagccagcaaggacacacggggcaacauccgugcggucaagaacaaaaucaauggccuguuccauggcagaauuauucccagcugugcucagcaugcuuuggucuccuuggcguguaccugaaagucuaggaauuggcugaaggauuuuugcuauuccuuuccuuugcuucuucucucauccuaggucauuacugggcagggauucuuuuucucuccuuuucaaugcauuuuuuccugcucaucucuggcuuuuggaggcacuugacuuucccccaccuaagcccuuucccuguuuguuccaucaguaaguuguauuuacauauuucuuacagguuggucucagaucaucaggcuuuggggaacaggagcaguuacaaaauacucugacgcaggaguaauuagaaaacguauuaacccagccaaaaaggaggggucaacguucucccccaaggaagggcaggcaggugagugggcagcucugggcuuggggcugcggcugggucugggggccugguggaugcgcugugcugguuugggugagcaacagagcacauaggcuucaaugucugccccaggaggagucagcugugccagggccagucuggagguuacugaggcuggaaggaggaaaugggaacuaggcuugggaggaagauucaggcccucugguaaaugagugacagagccaggccaacaggucuauuuccagaacuguccugugcugucgggggagccaagcgcccaggagcugcaccuccucugaagaaauggccuuguuccaggcagcaaaacugcugugggaagucaggaaaggccgggugaagcgcugggcucucugaaggugaaugugcuggcaagagagauuuggggucuccuaaggugcuucuccuggccucccugcaucccagggagggcacauucugacucagagagcugaggaggcuggacugcugagaugcaaaucacagccuggaggcucuggcuggagaggcucagcuaaaggucaggaaauuguugaugaugcaaaucaaguaggaaaccgaacccagccacaggggugaggagggaaaaccuuugcagaagcuggggugcaggggaggcccgcaggggggaagggcaaggaggacacuacagugggggugguggggggguggcugguguuguccccagggaauggguugcugcuucuguuccugugaaccuccucccccgcaccuccccuccugcgcauggcuggucacuggcacgcagccgccugcuaggaaacuucaggugucugacuguccucacagaccuugccggcacccguccccuggaggaggugcccucugcguagacagacagguugcugggcuggaccaagaauaguaagccugucccccagugggagguucggauucuccgccuccuggugcuggaagguucaagcugacacugggccagaugcugagaagcaccgccaagguucugugcucugaccuuggugaguuccuguggauuugcugagggugcuagggccagccguggggaggcagcccucguggggcugccccuagcccugcugcuugcaaggacccuagaaggaugcuugggccaccaagggcagggacagaagaugcacugugcuggcucugugccugucacgugugugcuuguguccuuggacuucuuuucacacaagucagcugugaucaauucugccacuuggcacaacugcuccgaggcccuccaauuuagcaucuuaaaacggagcuuaaauuaaaauguaugaaagacuugcacagugucuggcacuaaguaauauucaaaaaugcuucuguucauuccccuacccagcuauaauguuuugagacuugagaaaucuaccuggggcuuaagagauggagacuucagccagccucugggguggugggcaucucaacuuuccagaauagcagacagagcaugcuguguggucaggaaccccucaaucugcuggacgcugagcgucuggguacuucaggccagccuccagccagugccccccuggucugacauccucggccacccucaugggaauucuccagcccagcugcagccacagcaccuacccacaggccgcagagcagcgcuggccuguuggacgucaagucauggcuggggcguuugccuuccaccucuagauagccagguagcaugugacugcuuucugaguggcaugaaguauagauaaaacguaccuucuggguuuuaaguuauaaacaagcagugcaguaugucuaacccucuaaucacagcccgccgacgcccagggcugagacaagcagacacccacccauuuccagggagggcggcuccaauccugacuucaccuuugaugcugacagcccaugagaacuccuucuuuauuuuuguuucccacuacagcuagcacuuuuggaaucaaguucgcccuggaagugggcugugccucaucuucgcacucagacucugauacagcucggauaucuguccucuccaacucucauguugaaauguugggggugcggccagugggaggcaucuggguccugggagcagaucucucgugaagggcuuggugcuguccuugcaguaauggggguaaugaguggguccucauucuaucaguucaugugagaccuaguuauuuaaaagagccuggaacacaccccccaccccccacccauacucucuuucucaccaugugacacgccugcuccccuccccugccuucagccaagaauaaaagccuccugaggccucaccagaagccaagcagaugcuagugcugugcucguacagccugcagaaccaugagccaaaucaaccucuucauaaaugacgcaggcucaguuauuccuuugcaguaacacaaaacagacgaacacagauucccaauguggugcacuucugggaggaucagcccucaggcccagccccaggaugagagccggcuccuggguuucaccgcccucacacgcccacgacuguggaaugaacgagacucacugggacccgucuucaaggucagcucagcaguacgggucaugugaagucccuguuaaguccuugugaaagacggccaggagauuuaaagguggagcagaugagacagagcaggauaccccaggacuggguccagcuucuggggcccggugggaagaggucuuuggauucuaguuccgcugauuuuaacacuugggccguaacuagcuuagaagaguuccagucagcaaggggcaaggggaaggcauuagcggacaccaaggacuguuuccugacaacaaaaggacuccugcucaucuucugggauauuaggacauguguaggaaacaaguccaacagagcggcagagccuagcagcagagcggccucgccccaggcccugcggaagggggacaaaugcuaagcccaccuuccuccaggucucucuguggcucuggcuguccuacugccuugggacauuugagguuaggggaggaggaccccagguuucugaguugcuaauuuauaacaaguucaauaagagcccaccgucagcccuguuggcuacagguggggcaaagguaggucccugaagcuaccgcagagcgaggaaagauacccugucggguuaccguuuccgaaaggaucacagccucagacugcugcagggaaaugucgguggguuuaaauucuuucucaaauaucucuugauguuugcuguuccuuuuuuccuucuucuuguccuucuucuccuucuccaggucauccuuguccagcuuguccugggaccuggagugcauuuucuuuggcaggagaggcuccagggcaaaccuaaaggaaaggucaaugacgucuuaauaggagagcaauugcuuuccagcccacagacacguguaaagucacucacaauccaucgaagacauuuacaaugaaagcagugauuuaaaagggaggccaagggugacuucagauacacagucaccagaugcaaggacuguguuucaaucccaacacagauaaacuggaaaaagauagaacacuuagcacgauagggcaaaugugaagucugaccggauauuugaugaugauauuaaggaauuguucauuuacgaugggaggaugguauuuagggcauauuucaaaaggggaacccucgucuuuuagagauuuauauagaaauauuuugucuauuuuuuaauggggaaaaauagacgucaaugcaaagaaaugucugcuaccuugauccugaccaaggcucuaugauuacagauagacgguuguuuucaggugaaagcacuuugcauggcucagucagaagcaagccagggccagcucacaggugcuuggagaugcccugagguuuccagccagcaacuaagcuggagacagaagaccugcauucuaggucugccacugugggugacucuugauguccucguaaccucuggcagcugucucacuuauaaaaggguauaaagacaccaccacccuucugccuaccccacaguugcuguaaagacacauucgugguuauaccauggaguaaaugaaucuuaggcuagugucuaaggcauguaccaaaagguuagugugcaagcauauccacacaugauugugauuugucacuccaacacaagauuggcauguccauccuguuucugguccuagaaguccuaucaggagguggaagaaauggauccaacucuaagacuggagucucaucccuagcagcuccugcugugaggaggagucaggagagaugguugaauggaugaaggcaugggcccgccugaaaaaccauauagcauaacucacguggaaggcagugcuguuacuaggaucuuacauuuucaaaauacagccugcucuuuggagcucugagccucacagcaacuuccaaaccugacuuccuugaccgccuggagaagcaauuggcuucuucaaggggagcaugauuucaagagaagauaauuuagccagccagucauauuuucauccuagcucuaguuucuuuuacauguauuucugaaugggacacuuggaagaaagccacuguucucauuaagaaggccauugcagggccgggcaugguggcucaugccuauaauccuagcacuuggggaggcuaaggcagguggaucauuugagcucaggaguucgagaccagccuggccaacauggcaagauccagucucgauaaaacguacaaaaauuagcugggcaugguggugugcaccuauagucccagcuacucaggaggcugagguggcaggauggcuugagccugggagguagaaauugcagugagccaagacugugccauugcacagccugggugacagagccagauccugucucaaaaaaaaaaaaaaaaaaaaagauggucauugcagcaaucuugcuccccauugauuugcucacuguugauuauuuccauguugugugucccauaauggggaguaagaugaaccaggaagggaaggaucauuugcaaaacugcgcuuaaaucugcugaagaugcagacuacccagagcaaggaccaccaccuauucuuugcuucucucaucuaauauggcugugcaguaggaucugcugcaggucacuauguaaacaauaaugguauugaaucuaagcacugauuaucaauagcuguuaacaucuccauaagagagagaacagguuaugaugugccucugaauggaagaacacacaaguaccuaugaagucaucuugucccuaaaucaaaucugaaucugaucaaaucgcuagauucaaccaccaauaugcagggaauauggagaaucgagacgcgaauuaaacaaugcgauagggcacgcuaucagcagaguccugaugguggggaccaugacaggauacacaaccuaggauuucccacaaauaaauuacaagggagaaaaggggacuaaaagagacuuaaagagauaauaucaaccaagugcaagguacaaggugggaaccuuauuuggauuuugccucaaacuaaaaaaaaagacaugacaaugggaaauuaacacucauguauuauuauaauauggaauuccugucaauauuuuuggugugaaauaaacuauauuacuauaguuuauauaauauaaccgaguuaugguuuuaaaaaagaguuuaaauuagaaauucauagugaaauagcuauagauaaaauaugauauuugagauuugcuggaaaauaugauugauacagauugaaaaaaaaagauuaguuaaaagcugauaauugucaagacugcaugauggggcaugggggccucauuacacuguuuggcccacuuuguacauaucugaaauguuucuuuuuuucugaaacagagucucacucuguugcccaggcuggagugcagugguucaaucauggcucacuacagccacaaccucuccagguucaggugauccucccaccucagccucccagguagcugagacuacaggcaugcaccaccacacccagcuaauuuuuauauuuuuuuguagagaugggguuuuguuauguugccuaggcuggucuugaacuccagagcucaagcaauccaccugccucagccucccaaagugcugggauuuuaggcaugagccacuguacucagcuuugacauuuuucuauacuaaaaugcuuaaaaaauuuaaacugauugauaaaauauaccaauauugacuuagaucauuaaggcauuuugggacaucuggacuuuucacacuggauauacaauacauccauauccauuaggugagaaauauuuuaucuauuauaagcaacaaccaaacauuucaugauuuuauucuagguuuagcagaacuugagauaauguagguaagaaaaggauuaguagaugcuguuuagcucagggagaagacccggguugugaaauccugaugcguauacaaagaacccagagaaaggcagguggaguuuuaaauuuucauauuacgagaagcaacugccuacaggaugaacuuuauucugcauguaaccugugccauuugagaccaaagccucauuuucuccacauuaguuagcuagcaaagggugguaaccccaagaaugaacacaaaucuggacuguaauaaagacgccuuccaguuaaagguuaaacaaaugccuucuggggaagagccagcagccugagcucacaugugcaauucaccacucuucugucuaaaaccucuccauuaauuuccacccuaaccccuauguuccuagaaauauaaaaaccuuuccauaaccaguccggggauuuucucggggagaaguugaauuaaauuucuuuagcaaucuugcuguaagugacaagcacacaugauuuaaauaccucuaaauugagaauuuccauauggacuuggccuuauaaauaucagacgcugauaaaaauuacuguuaagaaaaaauauggggauaguuugcaauucuccaucgggcacaucagucguuggcaacaaagggcaauccgaguugagccgucccuuggggcucucuggaaguuuguuucuguguguugagggggccagaugccuguggguuugauagggugauggauuguaaacaaaaugggauuggacacacaaacaacuguacaaaucagcaguaaaacaauuagagguucuucuguguuguuuaaauugcaugcaacauuuuuuucuuuuuguagaagaacaaacuuuacaugcuugccgcucaaaaauacaaaaaaauaccaauguugcaguucucuuugcaauaaccugagcuaaugccagagccacagugugugcucaauaaauguuaacuauuggguacucaagagcaaaaaugcaucuccaaaguggccuuguacaaagaagguggcccaugaguauuuagaauagucaaaaucauagugauagaaaguggacguuggccaggcgcgguggcucacaccuguaaucccagcauuuugggaggccgaggcgggcggaucaugaggucaggagaucgagaccauccuggcuaauauggugaaaccccgucucuacuaaauauacaaagaauuggccaggcaugguggcaugugccuguaggcccagcuacuugggaggcugaggcaaaagaauuguuugaaccugggaggcggagguugcagugagccgagaucgugccacugcacucagccugggcgacagagggagacuccgucucaaaaaaaaaaaaaaagaaaguagacauugucagggugucagggguggggggaaagaaugcaaaguuaguguuuaaucaauaugggagguaaagaguggggaauuguuguuaaauggguacagaguuucaguuuggcaauauuaaagaguucuggagguggaugguggucauggcugcacagcgaugugaacguacgcaaugccaccgaacuguucacuuacaaaugguuaugaucgcuugagcuugggaaguggaggcugcagugagcugugaucacaccacugcauuccagccuggguggcagagugagagucugccucaaaaacaaaauuuuuuaaaaaggauaauaugccuuuuauuuuccagaguuguccuaaaaaguagggacagauggucauucucagaagcauucacuuaaacaccauuucccuuuaaaaggcaauaaaccucagcagaaacaaaaauaaacaaaacauuugcucuccaaaaaaaugaggaagggaggaaaagaaaaaaaaaaaagaaggcccggccauccaucaugaaagccugacucugugacaguuggcuuggcagaauggugucacagggggacaguggagguugugucauggucagaccacaccagcuccuguccgggcacaacacccuggaggugaacaggagaugaaaaguacaaagugcuuggccagcccggacugcaccuugcuuuuucccaggggugcccaaucuuuuggcuucccugagccacauuagaagaagaagaauugucuugggccacacaugaaauacacuaacacuaacaauagcugaugagcuauuaaaaaaaaaaaaagaagaaaucacaaaaacaaucucauacuguuuuaaggaguuuauggauugguguugggccacauucaaagccauccugggcugcauguggcccgugggccgcggguggacaagcuuguucuaagccaugcugaagaggacugaacacucacuggagguucuaaauuggaugaaaaccucacccaaagugguacccaaagagaggauguuuuucucaacaacucacacgaccucaaaguaauauugggcacuacggucagaaagucucggagggucucaguuucaaagauaauuuugaugaacacaaaauccucaguuguaagaaaauaaacccagagcccuggguggcuccuuccagaucccccaagcccucacugcucagcucagcccugcugugagcuugacucacccgucggagccuggucuggaaggggugcuguccgaugagagggaagagacagaggccacagacagagggcgggaugaggaaggcaucgugaaggaccgcaccauggaccgggggcggcugccucuucuaucauccagacuugagggcugagagcgagaaagagagagaaggagacuuguuugaugccugugccugccauggucagacuccugagauaaaguggccuuagcuguguggaaucgagaccaucaucguucagacuucuguaaacaguacauguucuuguucugaguggaagacaaaaacaaugauuauuuuugagucuuuuaaaaccuaacccaauacugugaaaguaucagaaggaaccuucuuagccuuuuaauacacagugcaaguuuucuucaaagaccgcgaugcgucaacacauuccaaagccacaggagaaugugccgaccagaaaguuuaauguagaguaacaccuagagagugauuaaagagucuuucgaucuuuagaugcauuuuguguaucucugcagguugacagacuacacgggccaucaaaaugcaugaauccauaaugacugaccuccucuagacaaaaauaacaugcuccugcugcuuaaugaagaguacguuuccuuucugcaagugacugaagccacugaguaggugaaaccgcugcugaaguugcuaaagcuucucccacuugcuagguagugaacuagugaugcauugugccaaaaacaaacaaaaaaaagaucucuagauggacuuuuccaucuucuucuugacauauuacagaagcaaguguccuugaaauacagcauguguccacaucucauuagcuagaaaauuccaggguaccugcaccccgagccagauguuggcacaucugggacugcagcugcugcacaaggaccuuccuuuaaccugaggauguggaaacuaaguuccuguagggcaccuccucucuguguggcguugacuuccccacccugcaaccccaccccgcccaucucauucagccaaucaacuacagaagaccugcuguggaccaugguuccagcccuccaaggccagaagcgguagauuacagguaagauuaauauaacgccacuuccccuucugaaaagugggccuuuuucuuaaauaugugaucccaaauaaaacagcauuugauguguaaacuaucucuuucauaauaagaagcucaaaauuguaaaagggcaggaauuggcccacauuuucuguaaagcaguuguccccaaccuuuuuggcaccaggaaccgguaucguggaauacaauuuuuccacagaccagcaggagaugguuucaggaugaaacuguugcaccucagaucaucaggcauuagauucucauaaggagugcacaacccagaucccucacaugcacaguuuacaaucgaguucaugcucccaugagaaucuaaugcugccacugaucugauaggaggcagagcucagacaguaaugcucccucacccgccgcucaccuccagcugugggcccaguuccuaacgggccacagacugauaccaguccacugccugagggcugggaccucugcugcaaaggaccagguaaguauuuuaggcuugcaggacauauggucucuguggaaacuagcacgcgcugccacgacagcacaaaagcagccacagauaauacagaaaugaaugagcauggccugccugucaacaaaacuuuauuuacacaaccacgccaggggccacaguuugcugaccacuggcucugagugacgugcagcugggauuugccagcagagagggguuggucagucuuggaccugcaccaaugauggugccaggggauagcuucauggagauguucacuguaauuacucugccuuuagaagaaacuaaaagggaaaugguugcuuggggauuauccccaacugugaaaaccuuaccccauacauaaucucagaaggugaccucaggucuugguugagaugugugaguauggauuucaaggaauaaaggaaggggguuggcaggaggaugacucccgucaaggagagacagagggcacucccugggugcgaccauggguuuacugggcggucugccgcauaauuccuucuugauugagccucuagaaaucaagacaucagggcuuuacuuuuguuucaucugaugcaauuagggucucaaccaguccugggaggugggacuccacggccagacacugugacugaaaguagggcugguggguaggaguuggggacauuggaacuaggcuggaauuguggcccuggcacugauggugugacccuccauaaaaccccgagccacucggagccccagcuuccuccugagcacacagggagcagucuucccugcccagagggccagcauuagaacuaaaugaaaugaugccggggaagcccacagggcuccuuacccugauggcugcugcugucuucaccgccugagcaaacacucauuccaguuuucugaccaggagcgauccucuggcccugccuaaugacccugaguuuuacgucgcugucucccggcugagcuguaacgucccaccuugagccagccacagguguuuacugcccagagucuuggaugggaaugggcuggguugaagggguuggcugaacuuaaucacagggaccagugcuguacaaggaaggguaagaagcaggcacacuucaucgugaucuggaaugucccuuuccagaugcuauacaaaugccagcuacagccuggaaauccacagagggugacacauuuuccuuuggagagagcaggugggggaggaggggcugggggguggggcagaagaugggcaggcccagcagggagggugcgagugugauguuagaaccuuggccggcccucagaggccacaagacugaaggacacaacugcaccaucagcucugcaucugaaacagaacccuggucccuggcuguucuuguaggccaugccacacugcuucuccucaccauggaacuccagcacaaggaauaggugaagcuaaauguuccugcugaggcaggggcuaucagcuccaccucccagucaacaccccucccaacagccucugaggaaccccagggucucauggaucccaguuaagagaacuacugggauggguccccccggcagcuguggagggagggcgagagaggagaaauccuggaagcugggggccaggucaggggccaacugugauggcaaagaugguggggugaaccccagcaccaccaggggauaccacagcuagaacuaacuugagggaggaagggugacuccugguucucucccgggucuggguggccagcggguguugugacuguagguggggaggggagagggggacgauggcaucuugggguuauggcucuccaugguguuuggagugaugagguggaugggaguagagagaaugcagaaccaggaucaauuucccugcuccuaaucggacuugaagagguagaugaaguuuuggugagaaaccuaaagcucuuuuucacaagccugaaggccaacacacaugccuccugcacgcugugggcuggugagggcacgggggccaaugccgaacguggcgcugugggccggugagggcacgggggccaaugccgaacguggcaggugcucacgggcucaucccuggggcccugcacaccucgcucccuaaaggucaggagaagcugggcugcagagcucccauccagggaauggcagcuccuuggagccccaggacugggaacacgaugaaagccaaggcagaguggcagaggggccuggguaucgagaagucagagggcguccacaucuucucuuucuauggcuuaagcuggcucagaaacacugacaaaaugguuuauguccuuucuauggguuuauuuuuaaauuuuaaaauccaucuuuuuugcaaacagggugauacuagauugcuuuucaaagugcucugagaugauugcaaguuuccaaaguagguaagacaggaaaggcacaucccagacugcguuuuauugccacauuucucagggaaggacaaggggaccugccaguccccuugacucucaaaggaugcuugcagagccugcuguugcggucaaaggauggagcaggacucugcaagguggguccggggaacaaaguaucucaggguggaaaaugcaaccuucauucuguaaaagccucccacccccuagacggggugacccagcuggugcuacagagaaggguggggagguugauggagacggugcugccucacaaugugcuggaaauaagcuccaaccaaggacacacagcaucccaauccacacggcaccccaauccacaugguaccccaauccacacagcaccccaauccacaugacaccccaauccacacggcaccccaauccacacggcaucccaauccacacggcaccccaauccacaugguacccgaauccacacagcaccccaauccacacggcacaauccacacgguaccccaauccacacggcucaauccacacgguaccccaauccacauggcaccccaauccacacgacaccccaauccacacggcacaauccacacgguaccccaauccacacggcaccccaauccacaugacacaguccacacagcaccacaguccacacgguaccccaauccacacagcaccccaauccacaggacaccacaauccacaugacacaguccacacagcaccacaauccacacgguaccccaauccacacggcaccccaauccacacggcacuccaauccacaugacaccccaauccacauggcacaauccacauggcagcccaauccacacaacaccacaauccacauggcaccccaauccacacaacaccacaauccacauggcacaaucgacauggcaccccaauccacacgacaccccaauccacaugacaccccaauccacacggcaccccaauccacaaggcacuccaauucacacggcaccccaauucacacggcaccccaauccacacagcacaccaauccacagcacccuaccuuccugcccuugcuuucuccaccugugcccaaagcaagcacacucagaacucaugaauguggcagagaagggaauaugcaggaugucuggugagccagacagcuuucugugauuuugaaauauacauuaaaugacugagaaaagaggaagcuuuucacuuaggaagaaaaugucaagauuucacaaguguuuguuucuuagaaugaauuaauacaggcaucaacuuugaaagagaugcgaugugacgcacuccgaaacgcuucuugccacucagcucugacuguaaugaguugcaggcucugaagcuaucaagcgcuacucuagcauucugacuugcacaaaggauccuccagcccagccuugaaggacagagcccugauuuccaggccuguucaccugcagcagcucccgcugggcuggcaguuccagacucccaccugcugaguuuucaaccucagagcagcaguuguguuauguuggcuuuguuggguucaagcccugcugggccugggacccucucaucugagggacaccagguccuaggcuuggaggcaccaagguucggucaugcccggcagaggcggggagacugggagagcaugcagugugaucauaaccaaauuaccuucucucagggguugcccaggucucauaugcauuuccuaccaugugggaaagaggcggagaagcucuguggugccaaaugucagccccuggaguaggggcuaaaagcacagacccuggagguacauggauagggcuugaaccaugggucugccacgugcuagggugugaccuacuuaccuucccaugucccuguuuccuugacuguaaaaugcaggugacugcagugccugcuucacagagugugaggcagauuaagcaacugaguaucuauacagcacuuaggaaggucccuggcacguggggagcacuaaauuacuguuugcuuauugagaucaaugugucaaagaaaacaggguucaauagagaauagcugagaacuucagggacugguggacaggcggcccugggcccagaaaaaaaccaaaauggcacaccccacucgacaccuggucuucaaggagcagaggaaagugccguauguuaccugggagaagcagcgcgacuucccacagcucgccuuccuuuugccggggaguugaagcccugugcacacccccucagugccggcaggcauggaauuccaguagacagaagagagcucccugcuucucugugccacauugccccucaucccugaacaauggggaguggggacccuuugccgugucuggugucuccacaguucccgagcaggcaggguaggcccagcaaagcucccagagacugaguaaagaugggagcaccacucugagcugcaaagcagggcagcacugugacucacggugccuggcuuugcucccacaucugcuaaggcauggcuccuggggacagucucaagugggcuguaagauuugaacugcaagguuuuugcaucauuaaaacucaagcugcucuccacccugcuccugaugccagccuuugcucagaaaccuuccauaaacucauugcaaaagcucaguucugcccuucaucccgagcagagccuccugccccagccuagcaucccuuguucuuggagguugggugccuuuccaucuccgcucugaauuuucucuucugcccaaagcaugccugugucugcacuggccccuggccugccauucaaacuccugccucucagccucuguugagggaguccuuuccccaggcagugucuucuugaucuccuccccugaccacaucuggcuuaucuuccuuggucuagaucaauuaccccuuccuacaauagguaaaucuucacuaauaauuucacacuccagauguuggucacuucuuccucgauggccaugauccucugaugucaaccuugggcugggcuaccucugccaugggccgucgugagugcuguugcccuguggaugaccgaacccucuguguguauuguaugacuguaggugugcacugucaaccagcugaguugccugggcgcugugagauuucuccauugcucugcaacaauaagguuggacuguguucacagcaggugagggggcauuugguaaucaaggaaauucaugaauguuuauucgcccugacauuuccaguuauugaaaggagguugcugaguugccgguagacaagacugcccaagggggcugagcucccucacaucccacuuccuaagcgggcaccauguguacaugugaguuccucugcucuggaagcuugucccuguucaacagugggaugcccagacacccacucuucugcaacacuacgcauacuacccucuuaccaugauucggacgccguacucuuucuccaccuuuuccuucagcuguuugaaacaggccuccauccucucguggaacggccucagugccuccgugacuuugucuccauggauucugaucccuucggccagaaaaggaaucuggaaaacagagagguugacauuccuuauuucuuggauaauggucuaggacgagcaaugcacacuuggggaaaggggaacuggcaaaacgaucugcuuugguuuccaaaucaaaccagcugauucaauuuaccagcaggcauauuaccaccaaagaccaaaauguuuacaugaaaaccauuuguguucugaauugacuauguccaguguggugcgcccuacaccacggcuacucaguuaauuucccagaauagacuuaucugugcuuuucacuugaguuugggaagagcuacaccuugaauuuguuuagauguaacuuguucuauuagcaaagggucaugucagagugcgaacauuuuuuagcuaagaauauugccuuuacgagaacccuauuccaaaagguaauuacaugugaucuauaguccugaaaaaucuuccuuuuuuggaagugaaaaccaaauuuauucuucuuuaaaacuaaaaauaaucgcuucucugcgacacugcugucacaaaauauccaugccaacacuucacuuccgagaguggagaugaagcugaccuuuaaaaacguucuaagagagacauuuucauucucccagcugcagagacccaccagaguugcugcuguuguggggugggagaaggaaaagucucccuuucugucccuggucucugcuuccccccagggcuuggacucaguuagacauucuuccauguaaucaagcuaagaggcuuccucucaauaauuuauaauuaaaucaaaauacugauuaaaaacagauuuuccuaauaggacagaacaccaaucuaaaugagcagauuuauuaguaugaacgauaauaaguacacaauugaauuucaugugagcaaauucaagaaaucuuaucaagaugaaucaacgcaucaaauguauuugguuaccauuuauagcacacagcuguugccucucuuggugcuccaggaaaggagggaguagcagcgcucuccucgcucauagcccuccuagccugcuuggaggcugcaccgacacaaaaguuuguuuugcugacaguuggccccaaacccuaggcacaugucaggccuuucuggccaguuaucaccgaaaggacagcauacagagagauuucaaaauacuugggauguuuuaauauucccuaugaauuacucgugcagauggcagcuuccccggggcuagccgcgguuuacucagggccagcaguagaaaaugcucacugucagccuucugccuccugaguuccgccuugggggaugacgcagacagaccgggacaacuuuuggugggaugucgaauguguugggucucucucuggaugcaaaggcagggauguguggaggugcuguugcaaggugaaagcacagccacccuagauacuaaaagcauuucugauuuagggcgggccuuucucaaacuacaaaauguaaucuaguuccugaguuuugcuguuguugguguugaugguggugugauaaaacucuuaauggucagauucuuucugucaaagaagguacuugucagaugagaguuaagaccuuuugguuuaggacgcuugugcugcucgaacugcaaucugauaggugaaauuuaccaggugugagaauucaccacucucagcaguuccugacguugaugggaaauaaccuucugauaggacaggaacugguucccuguuauaugucuacuuggggcugaacugcaggugugauucuaaaugaaagaagauaagaggaugcccugaguaaacacauuccaaugcacaaaaagcacuuaacauagaccgagggucugaaauggucucuggagacccuguaguugaguggguuccacucuggcuaagcaucagaaucucagguggauuccugaaccccaccuccagagcccugauuugcuguaggcagaucccaggaaucugcauuccuaaagaguuucucagagcccagagaugggagaggacuuucccuaagucacaccucuaauuaaucaaagcgagccugcagccugcucuacaaagacgcccuccugaugggccguauuugaaguuugcuccugucuguccccugcacagauucaugcccugaaagcagcacagaacaucuggaagccuugcuuaaugcuccaggagcaccaccccuggacacaacagucaugcuugucaucagcuggggaugauggcugaguucagccuuucaucuucguacauuucaaaagagaaauauguauacaucacagcaguuuaauaugagacuguauggauuugucuuuggauacucggcagggaugcuccacaaugacagcuguguauggagaaagauggaauugugccuuugagaaagugacucaugaccuggugccagccgcaaaccuacaagaggcaccacacagugugcacccugacugccaccucccacccagcgaggagcaggucagcccauccucuguuucugaggcagcaagcagggcugaggaggagcugccugggacuuauuaaccaaccuucacaaaccauuuuaugcaucagagcugagcuuauuauauaucggugaugaaaacucugcacaugaguccugggacucccaggagaaaaaccucacucugcccugauaguuucaggaaaaaaccaaaccagaugaacuaauaaacaaaaagagaacaaagcauucugauaaauucaaacuucuuauuuuuaaugaacauaugacucaguugccaauaccaagauacggguuuuccaaacauuugcaaaugaaagcaaaaucacagguaauguuuggaauaugcauuuuucaucacucuuugauuuaaugaaguuacuagaaaacugauucuuuuaccuuuccugugaccugcuuuaaaauucauccuuuaauauaguuauuaggaaugaugacauagugcugacauaaagcugcucucuggggaacaaauuauuuuccucuguaggacuugaaacucuuaaaauccaauuugcuguaaaagcuuauaggaaaaaaaaaaucaauagaacuuuugcagaccaaacuaguuuuuguauagcaauaguuuuauagccugcagaggaauuuugaauuucguacccuuuaguaaaaaaucuacaacaucuaaaauggaaucauucacaauuuuaaacucucucccacuuuuuuaguuacagagggagacugucuacaugaggcuuacaauccauacaaagaagccaaaguuggccaacaaugucccuuucagucaaacucugaggacguucaaaaccauaauuccaaagcaaacagauuucaaaugcagauuugugacaaagucugauuucuucccuuuuaauauaauuuuuguuuauauauacauauaaauaaaacuucucacucauuaaaauggcuauuacuuaaaagauaaacaggccaggcacgguggcucacaccuguaaucccagcacuuugggaggcugaggugggcggaucacgaggucaagaaaucgagaccauccuggccaacauggugaaaccccaucucuaccaaaaauacaaaaauuagccaggugugguggcacacaucuguagucccagcuacucgggaggccgaggcaggagaaucgcuugaacccgggagguggagguugcagugagccaagaucacgccacugcacuccaggcuggugacagagcgagacuccaucucaaaaaaaaaaaaaaaaaaaaaaaaaaagacaaacaaaauaacaagucuuguugggggugcagagaaguuggaaucaugcauuacugcuggugggaaugucaaauggugcugugaccguagaagaguuuggcaguuucgugaaaaagaaaacacagaauaccacaugagccagcaauucuaaauuuggguauauaccccaaacuaugggaguauugaaagcagggacuugagcagguauuuauacacccacauucacagcagcauuguucacaccagccaaaagguagaaacaacccacauguuguuccuugacagauccguggagaaacacauugcggucuagcccuauaauggaguauuacucagccuuaaaaaggaaugaaguucugacacacacuacaacauggaugaaucuggaagacauucugcuaagagaaacaagccagacacagaaggacaaguauuacaugauuccacucauauaagcuaucuagaguaggcaaauucauagagacacaaaguagaaugguggugaccaggagguggguggagggaggaauggggaagucguucaauggguagagaguuggagauuugcaagaugacaaggcucuggagauggaugguggcggugcugguuguacaacagugugaauguacuuauugccucugaacuggacacuuaaaaauguuuaagaugggaaauuuuauguuauguauauuuuaucacaauuauuuauaauauauacauaauguauauuauguuuacauaucaguauaagcacuuagaauuauaaaaauccaacccauccuauauaucuaaacacaaauuuaagaggacucguaccuuggcucacaaccaaagcucagccuugcuccacucuaagacgucucauuggccaaugugcugaugacagagaggccacuaagaagaggcccugcugggaugucagaauaaaaaugcucacaguggccuggugcaguggcucaugccuguaaucccagcacuuaggccaaggugggcggaucaccugaggucaggaguucaagaccagccuggccaacauggcaaaaccccaucuccauuacaaguacaaaaaaauuagccgggcaugguggugcacacuugcagucccagcuacuuggaaggcuaaggcaggagaaucacuugaaccccggaggaggagguugcaguaagcugaggucacgcuacugcacuccagucugggcaacagagcgagacuucaccuccaaaacaaacaaacaaacaaacaaacaaacaaauaaacugcucacggugaugucucauaagaggaacagccuugcccuguuccuuuuuuuuuuguuuuuuagacaguuuugcucguuacccaggcuggagugcaguggcgugaucucagcucacugcaaccuccgccucccggguucaagcgauucuccugccucagccuccugaguagcugggauuauaggcgugcaccaccacgcccagcuaauuuuguaucuugcccuguucuggacugggugcagaucaacugcacagcaucucugggccuugacugggagccugggaccccagcuuagcaaaguggccugggcuacgacaccugguccaaacccaugcaggccuuugcccccaccucccucaacucucuuuacacaguguggcaagaucucggggacagcacccuccuugccucccacaugugaaaaggaagccuaaagaggcaguggccuaaagcagcagagcaggcuggugccggccaagcucuugugaggacuggcucuugaccccuacacuuccaggcucaggaaggcucugagaagcacagaugcauccguccgguucugacacuuaaacccaaggcacccagggucugcccuuucaagaugcuggcccucugggaaaggcucccgaggccccaggagcauaaguagaacagugaaauaacuugcacaacuucagcugggaaaacacagaugaggacgcacaccaccgccagaggugcacggagaacagggagagggugcacugcagcuucugacguacaugcguuucacagggacugcacuggcccgagcgccuuuccuggcacaggcuagagcucaaggcuucauggcucugagcucaccucaauguucuaucaauacagacagagaaaaaguuuuccagcagccggcagaauugaccaaggggaggaaagagaccuuguucauuugcaagagauaauuuucuggguguucaaauuccugacugcagcccaggagcugaguugaucacgacagcaguggguggguucacccagggacaaucacagccacgugcaucaggacugcagcccagggaccuccaugcuggcuggugugugugcugagccuagacccuccuagcuuuccuucccuccagccaugcaggacucuugcuggacacuuuaccugccaagcaaucagguccuugagcuucucgaucuuuucaugggccucagggugcuccugcagguaccggucuguaaagaaggccugguggagacaaggagaguugcucagugcaccugcucagcaaacacagguuuuugcacacuuacugugugccaggcccugagaauagagcugugcauaaaacagauccacacgaagcucacugcagacucagggucacacccuucgcagcacccaggacaaaaugucccacaaggucaaacacuguaaguggagcuaacagggcugucuacagcagcaaccccaguucuugggguccaggaaggccacagcugaccugguggcuugguccugcuggguggcagugaauacagcccucccagcuacucacacgcccaugccuccugccuagccccugcaccugcccaggccugaccuacaccugaaggcaacaaacuucuuugugcaaggguggguaaucaucuccucgcagccuucucucaggcaguauccuuuuugucucaguuuuugcucugucuagaucaggggucaacaagcuuuuuuugugaaaggccagaugguaaacauuuuagguguuguggaccauacaggucucuaucacaacuacucaaugcugccacuacucaacucgccaguuacaguaucaggaaaacagccucaggcguaaguaagugcacaggcguggccuucuuccaaaagaacugcaguuacaaacacaggcagggguggucuaggauacacccuguguccuucaacuucugcccauuccuacagagcuaggauccagggagaccagcuggccgggcccccuccaccgucaaagcgcuaccucccuaguccugauauucugguguuuuugucuaacuuuaucuuuuggccuguaagaucccagaccuuguaaaagccacuggaggccugggugcagauaagcccagccugggugggucagugggggcuuccuggcugucuggggaugcccaggggagccuugccgggacuccggccuugaccuugcugcaggcuucaggggccgccacuggcugcugcugccuggccuuggcugggccacugcugagauugcucaaugagaccaggggcguuucugggcuuuggggacucucgggaauuuucagucuguccccgggcaggacugcuugcccagagcaagcuggugggucccguaccuuuucguaguuugcgaagccccccaugacagcuggguccacgaugccguucaggagcauggagagcggguugaugggcaggcuggggucauccaggugcugcugcaccaugcuguugaucuugucguucgucagcugcauggucucaauggcauucuccagggggcugauuuccaccugcaaagagagaggagagcccgaugucagccccacagcugccuccacucccagggucucaccagaggagccacgugcucuggggcaggcuuccugcuccuccgugaaccuuucuuccaaacagaauuuuuggguggcugggcauuuuauuauuauuguuuguucccagagaugaaaauuccaaaggaacaaagcaaagcugcugcucagcucugggggcggggcugugugugugcauguggcuaugcacauauguggucaucccaggaaaacacgcagccuugagugcuugaauacaccugcuucagaacagacacuuccaauccuguucuuguucucugcuuguugugcugagggagaagauguucgggaauuuugaggaaucuaagcccgggcagccugcacuaccuguccgguuagggagggcaaaggaggucaaggcagggcuccgccauggcaccacacaccaucaugugaaggaagagugaugggcaggcgugguggcuccugccugcaauccuagcacuuugggaggcugaggugggcgggucaccugaggucaggaguucaagaccagccuggccaacauagcaaaaccuugucucuacuaaaaacacaaaaauuagccaggugugguggugcaugccuguaaucccagcuacucgggaggcuaaggcaggauaauuacuugaacccaggaggcagggguugcagugagccgagauugagccacuguauucaggcugggcaacagagugagacuccaaaaaacaaacaaacaacaacaaagagagcucauggccccuggggucgggaggaaaaggcugcuuggagcacuccaggccacccucacaggcuucauuugcacacuugccaugguuaaugacaccuucagugcaggagguaggggacugaccacuguccuccuggcuccagugcgugucucucagggaccuccacccucuuucucugagggccccacagggccuggccuggccgagucccagcccagugcccuccagcucagcccuaaggugccagggcaacguggcugggucuaaggcagggaccacagcugcccugaggucuugcuugagcagaccaaaccuccuccucacacugggccacggggaccaugucccagggugaccucagcaauaacuuugcuccuuccaaaggaagcgugaugggcccccacccaugcccaagagcccuugguaucuucauguccggcuuucuuccugcuacagccucuagcggacugccugggagcuggggguggggcagggcagagaugaacagcgaaugggcgauucuguccgucagcaacccuagacuggcacuccuagguggcuguggacauaacagagguugucugcccacugaugucacuguccuugcacugauggagggacagccuuggggagauugugaugcacugguguggccagccacgugcacccugcugagagggccccuuguccgguguccuggacagcaggcauagccaugcuguccugaccccacaacuuacuuugccaggcccuacgacauuucaucccgggcacacagcuucaacaaaugcacacuccagggcaguauuccaccaggacugacuguuaccucccuguuacuaaucucauuugcacugagaaagaaucccuuccuauuuuuauugaagaagguuagcugcugcucccacagauaucccacggggguuggucccagguggcacgaggagggcaucaggguuugguagcaggacgugaguccugccauucugggauuauuugccuuccugcccucuuagucuguucaaaauggccaaagcagcccgaggagaagcugcauccucacgaaaggucagggcuccccucuccaccucccuaagcuccugcauccggcagcuguuggcuggcaggccccgauuacaaagggcucaugggcagagggugauuaagaggaucacggccuguuuagguggagggccugcucuucuguugucucucacauguacaaugccucacuagcuacaaagggacccagcaaagggagugcauuuuuaccaccugacacauaacucccacagccuucuaucugucaggcacugccuggcugcuaggggcacagaaagggaacuccagagcagaaagugaccccaggagggguaggugaagagcccugggugcuuugaguauaaagcaguggcucugacugcgggcaaccucucagagaguggcccauagcugcccauagcucaugcuggugugggcaaaggagaaggcucggcgcuggacacgcagcugggcagagagaugccggccccuagagacaaauaaucagguguuucggggggacucauugaaaacuaaauggcaagugccacccccucagugaguucuugccaggugaaaacaaaaggcacugagacacaugaacaaaaacguacagauuucaaucagauguuuuuauauugccaguugccuuggcccugacauuucaauacugucaauaaaucugcagcccaacucugguucauguaaaugaaacuguccaauagcucacugcaaaugugaguuucacguaaaugaaacugccccaucucaaagcaaaguuuagcuuuguugagagcuggaaaucguuauuucuuuaaaaagggucagggagggguauguucucaggcuauuuuuacuugaaaugggcaaggacuauuaauuaauaguuguuugucauguaaauggcaauaaaaccaucaggaaaaaaaucuuuaaaaaaguuuauguagacuggaauuugucuucaacuuuucacuugguuaacacaaagcauugucaaaacagcacagcuaugacugaauuuaaauacauuguaagaagaaaugaaaucuucauucugguuuuuugauaagcuagaguuggucgugauuacacagcauuuccacuaaaauauggcuaggcgaggagauaucgaugcucucaagaacagguggggugguuaugggaacuguagagucugcugugugcacgcugccacagugaccacggggcaugagcaggugaagaaggcguggcagacuguauugaggaagggaacggacaauuccuucugggguggggccauccuuaccaugaaaacagacuugaccucaaaccaccuuaaaauuccagguaauuuauaugcaguuguauauaugguucucucgauccacauauucugcaaaggaaacacacacacacaacacggguuagaaggaugucagcagguggacagcucugcccuaagggggauuuauagaauaacuccaaaggagucagguccuucagcaggacagggucuguggugcucagcacagggcaugugugccuucagguagcaccucacaagccacgcucuaccuaacggucgcucaggauacaucaaaguauccccuguccccuagccaacauugcccaccacucugguauuugacaaugaaaguauacuaggugagugagaaagauguguauacuccaaaaugagguauggggagccccucuugagcaaacagauuuugaggaaggcuccaaagaagucuuacauuagcuacaguguucauaagaaacuaaaaggggcaaauacaucuuugggagacuggauuuaaucaaagugaccucugauguucugauaaaaccagucgguauuuuaaacuuuaaaauguuuugacguaacuaauauauguuuauaugagaacauaaagauauggaaagagcaggaggaaaaaccauccccuaccugaagcugauaaccuauaugcuuuaguaucuauuguucaagacuucuuacuaaguauuaaaaagugugucuaugcauauuuuaaauaaaaacaucauuugacaauguguucuuuguaaaacaguauauuaccuauugcaggaaacuguucuaacccaauaaauacaauucuacuacucuuuaaggauugcacaaaaacuccaaugcaggggucaacuggaaauccuuuauccuacugccucguucguacugucuagcuugcaacaaucuucugccauuccaaccucccugcacugcagggucacugagcagucugagugucaacaggaaucuagacuuaagcagaugggauaauggaaugccagucauuccagaaaacugggacaagcguggggggcucacgucuguaaucccagcacuuugggaggccagggcgggcagauugccugagcucaggacuucgagaccaggccgggcaacguggcaaaaucccgucucuacuaaaaauacaaaaauuagccagaugugguggcaugugccuauagucucagcuacucaggaggcugaggcaugagaaucgcuugaacucgggaggcggagguugcagggagcugacauuacaccacugcacuucagccuaggcaacagagcaagacucucucucaaaaaaaaaaaauuuucagaaaacugacuuggaucuuggaaagcauuuaucccaaacuucuuacguuccauaggaggaaagggaaggagcuggcugaagccauaaggacacaggcaaggccuccgugucccacaccaguccucuuugccccauggggacggcucccucagguuuuuguccuggcaauggaaacaggucuggcccucucacauccaccucuagaccagauuccagugcuuucucucaugucaacaugcccugagacggaccucuggguuccauccugggcuuuacggccagcuccuccucacgcaggcccugucucaucuuccuccucgucagugcccucacuccccagcacaucagucaccccuugccaggucugcagggaugagccaccucgcacugcucucggccuggugggcagcuuccccagcccccugcacuuggagccaggcuccccgcuggaggggccgaggcuggcuucccaguagagcaaaagacguugcacuuaucuaaggcuuuguggggcaugugaaggaccaaauccugcagcuuccgaacacuuuguccaagugcccggaccucaacagggccauuaggggauuucagggccauuuagaagaagcauagccucugaggcucagcauagcucaaaaugucaagagccuucguuauucuuagcucugcacccaacuggccgcgcacccuccaguggcucacuugaccuccuugugucuauuucuuuauagucuaagaauauaucuacuugccagaugggagaggugugagggaaauucaagaacugccuauaaaucccacaguugagggacuccauauaaacacuagcguuagugcuuaugaugacaguaacaggugcagucugcucugaaagccacugcccuuagcgaggguguccagguuggacgugccuagguucugcccgcacuguugcagacaauggacacuguagugaccaguccuggaggagguccagggugcuggguucaccaacaaauagggugaacauaaucuucaaacaaccagccugcugggacugcacaauacugcagauuucaccaacuccaagcuccuuugugcuccuuggugacacacaaggaaucuggccucggggcuggaaggaacuuccccauggcucuuaagagcugagcuaggagacucacagguacugcccugaggaucccaugacuggcagaccccugagggauugggagggagacuggguagccaccacucuuuacuugaggcaacccugcuggaaggguuccgagcuuugcucuggucaggaguaggguguuaauucaccuuugaccuuugcagccuagaugccuucggacggcacacaagagaagccauucucagcagagccgguccuccuuggggguccccgggcuaaugccuccuugcaauacaggaguacagaaggauuuccggagguuucccaggcaagacggauaaacauuaacauuuuaaaaaaauuauggcuuauuugaugccuuuucaacauggauccacucacuugagcccaggaguucaagaccagccugagcaacauagaccccaccucuauauaaaaaaauaaauaaaauaaaaauacaaaugaauccaugaaagcaguuuguauguagaauuuuuaaaaggcucuagggccaggcgcgguggcucacgccuguaaucccagcacuuugggaggcugaggcggggggaucacgaggucaggagaucgagaccauucuggcuaacaccgugaaaccccgucucuacuaaaaauacaaaaaauuagccgggcguaguggcgggcaccuguagucccagcuacuugggagggugaggcaggagaauggcgugaaccugggaggcggagcuugcagugagcugagaucauggcacugcauuccagcuugggcgacagagcgaggcucugucucaaaaaaaauaaacaaauaaaaauaaaaaaauaaagaaaaaaggcucuaaagauguuugcuguuauuucuacaacucgaaugccgugguuugcaacaaggggcagauguuuuauuuugcaaugucuggaaacuuuauuuuuuugauggaguuucacucucguuccccaggcuggagugcaauggagcgaucuuggcucacugcaaccucugccuccuggguucaagcgauucucccgccucagccucccaaauagcugggauuacaggcgugcaccaccacgcccggcuaauguuguacuuuuaguagagacaguguuuuaccauguuggucaggcuggucucgaacuccugaacuaauuugaucuaccugccucagccucccaaaguguugggauuacaggugugagccaccaugccuggccuggaaaucuuuuugauugguugucccaacuggggugguggcacuggcaccuaguaggcaguguucagggaugcugccaaacaucccuggaugcacuggaugguccccaccacagagaauaacccgguccguauugcuaguagugcuggggucaacccugcaguuguguguugugcuccacugaaguucaggugcuggauacugaaugaggaaugagcacccggguccagauccaguucaugugcugacugcugugucaccugcagaaagccacgucagcaccccgcaccucagcacucgguggguccauuuuuaacuagagaugacaggcaccugcucucucaccuggggcucgcagggaaggcagugcgcuacucauaugggagcuccggcauuuggacggcacagucuccuuauuaaauaucucagugaccuuagucauauuguuagugaaauggcaauuaguuuuucuaacuuuggaggggguaauagauuaagauuucugcacauaauacacaaagacauuuaauauggcuccguggcugccucugaggccacgcuucuccaguggcaguucuacugguggcggaaugauauuuuuuguuguuugguuuggugguuuguuuguuuuuuaccgcaaauucauugucuggguuuuucucucccuuccggauuggccgagaauauucaaaucgcuggaccucguucacccuguaaaaacuguacagagacagacagaucauuagauauuuaacccggcaaauagccaauuugcuuuuggacacggggucuggccuuagaacaugucacugccuccuguaaaaugucccuaaccuugaccugaagccaucgccuugguguccucucccagccagggaaauguuggcagguggaaaaauuaacuugaguuuuugccucuucccugucccugccaacccucgagggaaaacagaagcugaguaagagugaaaugagcaaaaacagaggaaaggugaagcgaaggagagagaaaaaagcuuuuguguucaacguauguguuuauuauuauuuuaaaaaaguauuacauaccuuaguuucagaucuacaaagcacagauuuugcaaccaccccaagagugacacacaggaaacauaaguaaccugccuccgcggucgggguacgaggcaggcuuuccgcaugcacagggcagggcguggagagacugagacugauuucuccccugcacugaaaugcaggcaggcuuccacagcaaaagaaacuacugcaucugagaaggcucuaagcgucacuauuugcuuaaggccucugaaaaaaaauguugcaacccuuaaaauguaugccuugcgagagcaaucauuuguaaauaaacagggucccaguuuauuucccauuauugcugaugcaaggucaaagaaacgaugaaagguuaaagaaaccaccaaacuucaggaagcaaaaugaagcugauccuaaggaauaugaggucaucaaagagauuaauauuuucaccagaacauggaucaaacagaacagaaaagucuuaauaucaaacacaucugcuaaagcaggucuuucuaugccauugcuaagucaggugcgauacaacugacaggcagaaaaucucacucaaauauggacaguugacucaggagguuuaaaagcccccucauaacccuacauuauggaauugcugugcuguaaggcugaaggguucuccugugugucaccaggagcaaaugugcaaaucccauuucccgccuucuaaaaugcaaacauucaggccacacucacauguaugaacuuggcuuugcugggaacaggcaggacuugugcacugcugugaaguucccuaggggauuguaccccacagggcaggucuauaaaggagaccagacggccuccacugcccucuuagguuuuugcugucagcugacuuugggaaaggaauaggcuuugcacgcucccagcacauggauuaacaucuccugucacuuuuuuuggaugcugaaaauaauuagcuucccuugcucuucaaagaggacagaaagagcauuuggaaagcgaauccauggccaaaguccguccuuuaaaagguggaauuauuagcaagagaucuguacacagccucuuacaacccucacguuggguaagaaaaaugggauuauuaccuuacaaucugcucugacacuggccugugaaacuuaggaggcagaucgaguuugggcuucacugugaagcacugaauaucugaggugaggggguuaaggaucacuaaggcagcauagacaucaaccaugagagaggccccccaccacacccaaccacccaaaugaauggcaucaccaugguuucagaguugaugagguugucuuaaaggauacacuggccaggagaguuuuuaauaucgucgccugguggagauguugucuucauuuucucggcguuuggaaacugaguuaagagccgagccucaaaaucuucccggcgcucauacucuuucccucgguaaaugaaaacuuuucccugaaaagggugacauucauuucauaacaccacagagaaagggccaggaagaguucacaugcaauaugcuggccuuaaaauaugccuuacggguucuuacaaaaugucauuaaauuuaagaacaacuuguaauuuuuauuuuuuuuuguacuugcguuggcuuuguuaaucaagaacacauggucaucaagcauguaaguuaauacuguuuaagaagcacucagcacugcgcuacuaacaucugugauauguuuucaucuugacaguaacaacugauuuaaaaacuauaugaaaaaccaaaugagcacucagaagcccacacuagaaugggcaugaaaugguuagaagggggcaaggcagccaggacaaguggauaaugauguccacacuuuuucuuguuuuuguuuucuucucagguaggcccuaaugaaguuguuuucauucugccauaaggaauuuaagagagcuugagcuaagguggggccccagcaccugcacacggccgccgggcgcugacuccugugagacacagccgaggcgagcagaacccgaggggaagggaugcagaccagagccgagagcuacuaaguuccuggccucccccgagugagugacuggcgauggacggagagcaggacuucccuuccugcauucagaaugugugugcaggucauuauucaucaacacaugucaagauaaaacauacagagcucuucuuggaagggcuggguuugguccaucucaaaugacacuuuugucaccuccauaaauuccaagauggaaugucaguccacugggguuguuauagacggcuaggcuagacuaggcaguccggggcggggaggggaguuaaguagguaaguguucuuccuuccacgaggcugucuuguugaggucauuucugccugagugugacacaguccucuguaaauauaccuguaaggaacguuuuccuugcaagauacaacaggucuccguuuuuuucccgauuucaacacguguguucugagugugaacucggucacagaaaggggccaaugaguaccuaguguaaugcugcugcugguuuuggaagccuucugccuccccccacccauccugucccaucuggggcugucucaaccgaaaugaaaacugccacaaggagaagacagcgagcagaagccacagggguacaagaaacagaagucugggguuggggggguaacacuuuccaggacggggcgugguugcugaggugcuucuguucuuugaucaggggacacgggggaagaaccuccagguuggcugcucccaagucagcugcagcccugccccaucugcagucauuccuggacaggugccagagagggagacgaacagagacagagacagacagagaggacagcauuuugcugcauauuuuuacacuuacccccuaaagacuaagauugaagucaaauuaaaauuugucuaacuaaaggauuuucaaaaggauuaagagagauucuaugacacugaaucaauugaucccugcuguggucagaacguuuguaguccccaaaauucagauguugaaaccuaaucaccaaggugauaguauuagaagguggggccucuggaaaggcuccacccuuaggaaagucaucagugccucagaaaagaggccccagagagcugccugcccuuuccaccccaugagaacagguggaaggcgccaucuaugaggaauggcccuccccagacuccaaaucugcuggcaccuugaucuuggacuucccagccuccggaacugugaacaauacauuccuguuguuuauaaaguacccagucuaagguauuuuguuacagcagccccaguggacuaagacaguccccuucccuugccccagcuuauucugaguucuccuaaaucgcuaaaaaaagaaccaguuuaagaauugaauucuuuuucacuuugugcuuagauaugucuuagaaguaccauuauggaagaaaaaugcucuauuucuccccaccgcccccccgaaaaaaaaaagucaagcagaaaccagauaauaugucaucuuaaauacagucugagcaacuucuaaggcuucuauauaaagccacgcacuuccaaaauucaguaagauuuaauggauaacagacuacuaucaaacuagcaagcauuuuucuuaugcuuuacaugagaaaacauaauaauaaaaauguauauaaagacuuuaauagaaaaaagcuagugaguuauagguaaaaacacgaauaacauuuucugaaaaugucaguuacuuugcauucugaagugauccuuuugaacaugaaaacaagggggaaauguacauauagucaaagauauuuauuccuuguaaggucuauaaauaucaacaugagcacaaaaaacagugagaccaauuuuuagagaaaaacaaagcaaaagggacagcuagucaguucuuggaggcuccucuccagcagggcaugaagcacgcaaacauucugcccacguuuugguaacugccagugucauuggcagauugaccccugccagcucaucugugaagugugauaaauauauugcugcagacccacagaaugauccagguguggcgggaaagucaguucaauauuaaucgagccuguuaaccuccauucagacuuuucauuuuguccuuuuggugguggagaugacccagcaccgccccuggagccugcugugugugagcuccuggcacaaccuggcaucuauuggcucgggagcugcaacguguccuccgcacccggcacugcccucacauaauauuccacgcaggcugcucccuugcucuggauucugggauaaccauccugcacggauccagaguuggugccuacauaccagagguagaucuccauccacaggggccacacgcaccaucuaacaccaagcacugcacaaggcugcauggcuuaggguccaccugccucccuuuccuaaagauguauguuccggagcacacacacacucgaauuaaagccuuuagcaacaguaaguggcuuuaacuccaagcucauuccacccuucagcuuuguuuuuuauugagaaugaagcuaauuucaaauuugucucuaauuuagagcuuguaacuaagccuccuuuauucauucuuuggaagggaagacuuuguucagaaucugugcuucugaucaaccgcugucuuugcugcacgaugaaggcaagaggagaagcugaccagcagugaccaggagugaccaggacagggccagacgccuccgucaccaggcaggacacugagugggcagccagccucaccuccuagagcaggccagaacuguggugcuccccugucaacagugacaugcccuuccuaaggggaggucuguauccucugggugccgugaugaagagaugucacacuauuagugacucccguggagucggaaacacaggaccccaaaugaacaacgucuggaaccaggggaaucucccaacugguuucaacugccccagacggcugugcucaagacacagagcuucugcuuccuaaagccagagcaaucacacauagucuccuaggauaagagaaaaccaaguguccaaaaaaaaaaaaaaaaagucauaagaaauaucaggaaaucaugacccacuggucaauggcauccaaagaauguguucuugagaaaauguauaaacaauucuaugguaggccaggcagcacuauuaauauuuauguaacuucuccuuuggccucaugugaauacugggaaaugggcaccuggcaggugaucacgguuacugcuucaauuacaugucugaaagcacaugccugucucagggauggagccugguuuggaguuucuagcaccguggccauacagauccauuuccaauuucccauauaauuaaaaacauacaucuucauagcagcacauugggcggggacaacccaaauguucaucaguggaucaaugaauaaauaaaauguggccucuccaugcaaugaaauaccauucagccucaaaaaggauaaaguucugacacaugcuacaaccuggaugaaacuggaagacauucggccgagugaaacaagccaaacacagaagggcgaacacuguacaauuccacuaauacaaggucccuacaacagucagauucauagagacacaaaguagaacgguggcugcuggggcuggcaggagggagaauggggaguucguguuuaauggaugcagaaucucaguuuugcaagaugaaaaaguucugaagguagaugguggugcuggccgcacaacaacgugacuguauuaaugccaccgaacuacacaccuaaaaauggcuaagauggcaaauaguaucacauaucauauaucacaccucaauuaaaauaauacguguaaaucucugaaggaggguccuuuuacggaaaaaucagauagaaagguuauaugcaaccaaauaaaauccugucaaccccucucugccccccgggcuaaccaccgagcuauggcaguguagagaguugcacgaucccacgcggaugcaaacuccccacccuuccucagaacgggaaggggauuuucugcugggggaacaaucauggcucagauuaggcagaaccaaacuuuacccgcaggaauguggggaacccuuguccguaguagccaacagcaaaauagucaggcuugggccugaucacuuugacgauguuuucauaaaacugagccuguuuuuucuggaaggaaaaaagaaaaugcauuucagguuugaguauucaagcaugugugccucuggauucuucuugcgggcucuuuaaaagcucuggcaacuucuauagggugggagggggagauggugggagagggagauggugggagaggguacugaggcuugcaccugaauuucaucucacuccaucguuuugacauuauuuuucacucauucuccaucauuccgcaagggaaucugaaccaacuagcccaaauucagcaaaaaguugugacuuauggguguuuucaauaaccaaagaagugccauagaaauggcuggcccuuaguauuuuuuaaaagguauaggucagauagugggauacguucaaagagaauuuaaaggaacagaaucguucuguucuaaauucaugacagacauucccacaucauuaaggugaucugcugaauacaaaaaugacaagguggaggagguagcaauuagaaacuaacagcauucccauggcagaagaaaggucuggucauuaucuauccaucccucucucauagaaggggucagguuuuuuuguuuuuugagacggacucucacucuguugcccaggcuggagugcauuggcgcgaucucagcucacugcaacuuccaccuccuggguucaagcgauucuccagccucagccucccaaguagccaggacuacaggcgugugcuaccacgcccggcuacuuuguuguauuuuuaguagagaugggguuucaccguguuagccaggauggucuugaucuccugaccucgugauccgccugccuuagccucccaaagugcugggauuacaggcgugagccagugcgccuggccuggggucaguuuuaaacuaguacaaauguucacagacuccugggcugucaagaccgcuauacacaaggucagcaguuguuuacguacaauuuauucauagaagccuuaagaguuugguuauaagagcugacuugggacuaaaaaguaaauauuuaugggccaaauaucaaccagcaaauuaacuaaaaccaucuuccuaggcaaaacggagggacauggccaaggucccagagugccuggggugaacccuaacauugacauggaaagagagauuccugaaaaaccagcugagauugccuguguucauuuaaauaaaaagaaauaaagacucaccagcaauucgcugaguugcucauaaucaaacauuucguucucauacugcucggcuagcuccuugcccaaggcaauggccuccucccacaucugugaguuaaaauaaagaaaagaaagagaagccgaggccugaauugugcaaagagucaaacaggaaugcaaucauucaaaauaaaacaguguagaaguacauuugaaugaaacauuaugggaauaacaccgaaaaaauacaaauauuuucuugagucucaugucuuuuggcucgugaccugcggcaucagcuggccaaagaggucaaucacuggcaugucaaucacgcaggccucuggccaugguaacagcagucugucagccaguccucacugcuccugucuuugcucuccugcugccagcuguggcccgaagcccgucugucggagcagccuuggagccagggaaaaggaaccguagggugaagagaggcuguggggugccauuuauguagaaacugggcgccugacuuggcucuuuucccaagcuguccaccuaaaaaaugcuaugucgaauaucaccaaugaucagaaauaacagggcagacuucgacucuaaacuaaagcuugcagaaaguuugauguaugugugugacuaugcuauggauauaaagccuguuaucauuuugaaaagggggaacuuuguaagguaaguaacuuuccaaauaagugauuaaaauguugauaagcuuuugacacauguggaauaauuuuuugauagauaguuggccugaauuucccuuauuuuucuugggaaaaacaaagcggauuacuggagaaaaccauggaaaaguaagaggaaccaccucuuccaggaagccuuccuagcugccgcccacucuccuccucugugcucccacaaagacccaggauccugcugccucaaaacuuuugguaagguacugaaacuagcaugacccuuugucauuccuccucagagaauauaagcccuugaggacaggggcucagcuuuaucaaccuguaaaaccucuggaccuuaauccagggccugcuuaacaagguuuagugaacagaacugcaggaugcugaguuacaaucaggaaagcuuccuauaugcugcauucaacuuccaucauucccacaagacgguagcgccaguccugaggggaaccacgcagcuuuggaaccacccaacaggccaggcuuucuaggccgcgaaucuagacuacccuuggcacugagcccccacccgccugcugcacaaaaaaagaucaaggcauugcaguaaagaaagaguuuaauugacauaaggccagccaugcuguuacagcagguagcuagucaggcaugagcggggcaggagagggcuguccugacacccuaccaggaaagucaggugaccgucagaugauggucaggcagguguacacugucucucuaaaauaauaauuggucacagacagugccagggaaaggcaguuucccaagagcuagaaacacaagcuggugaucagcagcuuccugauaagaucucaggagcugggugagugggcccaagcaugugaauugagaggcaaaauggcggaguuuaacugguaaccuuccaggggcauuccaccggaaaaggggugcacgacgcuggaaguaggccagcauaucaaacccuaaguccaaggucaaauggggcacuugaccuccaagaugucugcuuggcccucuuccaaguguacuuucuuuucauuccugcucuaaaacuuuuuaauaaacuuucacuccugcucugaaacuugccucggucucuucuucugcguuaugccccucaaucgaauuccuucuucugacaaggugagaacugagguugcugcagagcuauacagauuugcggccaguaacaccgccacgugggagacggugucauuacucaaaucaaucuccccaaagguuccuaggggaggggcuuuucaaaggcaguuugggagaaggggugguggcggccagguaauggaugcuugcugcugaugaaaucacagggggucagagcuguccucuugagcugaguugcuucuaggugggccauaggaguggggcugguggucuggguagagccaggugucagacaugcaaaaaaccugaaaagaucucaaaaggcucaucuacgauagugaaguuguauauuuugugagcagucuacaccuuagcagaauucagguuucuccccucuuccuagccugauggccuuucauuagcuuuaucaaggcagcugaguuuuagggaaggccuauuaucauuuaaaccuuaaacuagaggucucccaaaguuggcuuagccaaagcccaggaaugauuacaggagaggcaugacugggggugggaggugggugaggauuuagaucagaucucuuuuacugccaucauuuccucacuguuaauuuuuuuugcaaaggugauuuuggcuuuucccagcuuacucuauguccagccaccugugcucuccgguuuaaggccuccaaucaccuugucaggugggcaucugcauuauacccauuuugcagauaaggaaucuagggaucagacugguaaguagcuugccaaggacacacagcagauaagcggugggcuugacccagcguggccuuuuugaaaguccuugcuccugauggccacauagcagcacuuccaagcugcuuccccaccuccugccaggauggauuugaaaagaguccaggcuggccuugaacugcagguucccacaggggaggcagacugccaagccccagaccugggucacccauggcacugagcccccacccgcucacuggccuuugccuuuccuuuccaggaugaccccacugaaguccucacucacuucagagccacccaauaaacuuaagaacacuguuuuacuuaaaugcucccaaaguacucuugucauagccacgacguaaagaaaccaucugcuuuuuuuuuuuuuugaugagaguaaaaguuauucuacaaucagagcugcauuuuaauacuuugaauaacaaaauaaaaguaagcccaaagaagacaaagguuucagagcugggaccaguguccagggaggguaggagguggcccaagacauccugccuacggucccugcucugcuaccuggucccuucccagaguccccaucugucugucucccccauccugcugaagguuuaaaguugccucccauuccuggaauaucucagucugcugcucuaagucuuucguauguccucugccagagccccggcucacauuuucuaggaagggagaacuucccuacuuuuaacguuuuuuuaaagcuccagugaccacuuccucucugagcagauuuccauuucaaagagaacauuaccuuuccuuguaggucucuuacacuggauucuucuucuuauuuuuuuuuaaauuuucugcaagcggauacaaacucuguagcugccuagaaugccagggcuucuaauucauuccugaguaaaagccuaaucuguuuuuauccuaaaugacagagaagauacuuuagauacauaucaaaaguaauuguuuuuaaaagaaauacaagucaugaguaaauaucuucucagacucacccucagguugcauggugguaucuucuaucagauuuccuauaaauauauaucucucaucccucccugcuaccccuggcauguucuaaaggacucugcauuaaggagauuuucaucuacuuuuaauuggauggggcuuuaaagagaguguggguaauucauacuuccaacgugaauaccuuggaaaauguuuccgugccagagagaaggcagauucaauaugaucuagauuuagauuaucucagugaaagaaucacuuuaaccucugcgauugaacacccugguuuggcuccguucucagaagugcuacaggcuuaugagguuugccacagccccaaaugaaaaagccccauaucagcagaaagcuuuauuuucugaugcgaaauccuuaauccaauuuacggcauucuugaaauugccgguugacuugcagcacggagcacggucuccccacccugcuuucccccagaugauacgagacguguucucuugagaugauaaucuucucucuauucuucugaaccucuugguuucaggaaguuccauuucuucaaguuccaugaauagaaacuugaauaaaaauuuucuuuuauaauaaagcuccuuccuuaguucccagacagaagcagcuguagagaacacagcaggaauugauuucuuacccaugaggugauguugacaauucugauaggaugacaacacggaugucacaggacaagggaacagcagcagaugaaaggaaagaugccagccgggacagccaucccuuucuaauaauucaggcuggcgaugacucaccaggauacuggugggcgacucugguuucauuugcugacuagcuguaaguaacucaccaguggagauaccucacaggaugcuugaauuucagacauucuucuaaaauucaucuguucuguuuuuucacagcaguuauugggaaaagagucauacucaauuaccuucugaauuuccagagucccacacaggucucugacaucaaaauggauuaaaaucacuggugcggaagaaucuggaacucugggggaggucccucagcagcacaggagccagggaggcccaggacuagcaggaggcugcguucaguccguucuuugcucaaugcgugcugagugacagcaucccuuccagguguggggcuggcggcccuggugaggugggccuggaugauuccaagggcccagcuagucuugguguugccugcaacuacgcugcaaggaauggagacccuuugcaagcaucaccacucucuccaggccccucgcuuuuuccuugagccaagccucauccuugguccuccuggagugcucaaccggcacugacugaugugggugcaggauugacuuuuugcaaagaccuuucugacacagacucaggccugauucccugcaccagcaaagacggucugcagcucaaagcugacugaucuugcaguaaugaugccaaagucaccccaagugugcacaagauggaucagccacuucaaugucauacuggagccacugcaugucacacaggagccccaucacacgggaaccucugccuugccaaaucggagucacuguuguguaauacaggagucgcuuccugugucauccaggagccacuauuugugucauccaggagccaugacccaugucauagaggagucacugcccaggacaugcagcacccacuacccaggacaugcacaggucacacaggagucgcugcccgggucauacaggagucacugcccgugucauacaggagucacugcccgugucauacaggagucgcugcccgugucauacaggagucgcugcccgggucacacaggagucgcugcccgggucauagaggagcuacuaccugugucaugcaggagacgcugcugagaucacauaggagucgcugcccguguaacucaugcucagaucacauaggagacgcugcccguguaacucaugcucagaucacaaaggacacacugcccauguaacucaugcucagaucacauaggagacaccgcccguguaacucaugcucagaucacauaggaguugcugcccguguaacucaugcucagaucacauaggagacacugcccuuguaacucaugcucagaucacauaggagucgcugcccauguaacucaugcucagaucacauaggagacacugcccguguaacucaugcucagaucacauaggagacaccgcccguguaacucaugcucagaucacauaggaguugccgcccguguaacucaugcucagaucacauaggagucgccgcccguguaacucaugcucagaucacauaggagucgcugcccguguaacugaugcucagaucacaggagacgcugcccguguaacucaugcucagaucacauaggagucgcugcccguguaacugaugcucagaucacauaggagacaccgcccguguaacugaugcucagaucacauaggagucgcugcccguguaacucaugcucagaucacauaggagucgccgcccguguaacucaugcucagaucacauaggagucgcugcccguguaacugaugcucagaucacaggagacgcugcccguguaacucaugcucagaucacauaggagucgcugcccguguaacucaugcucagaucacauaggagucacugcccgggucacuuauguucaucaacaugucuccuuuauuccacggcaaguccuuauuagucaaaacagaaaacuacucacugagcuuguaaugcccuagauaaaaaaaugaagauuuuuuuuuuuuuuuuuuuguaacagagauaugacauuuuuucuuuaggccaggacauuuguaguuuugcaaagaaagaccuugaaaagacuaaagcaggcagcaagagauacaguugccucuugcucggugcuuuaacuggacagaaagagacaccgugcugcucacuccugccuuccacaggcagcuacuggccacuggugagggaguggacuccagagacaacaggaggagaggaacagcaagugcagaccauccuuuacggaguguuguagaaagaggaggagaaaugggcaguggcuggacaggggaguuggaacaagaaagaacucuucuuaaaggugagagcaauaauggcaugguugcaggugggagggugggagcugacagagaacaacacaugggugcugcaaagggagagugcagacuugcuggugagauguccugggauagggggauccagggcacaggcuggggagucaacaaacaucacugcagcugugaccuggcccaggacucucuaugcacccagcaucacugcagcugugaacuggcccaggauucuugaaugcagccagcaucacugcagccguaaccuggcccgggauucuugaaugcagccagcaucacugcagcugugaccuagcccaggacucucuauacacccagcaucacugcagcugugaacuggcccagggcucucuaugcacccagcaucacugcagcugugacccugcucauuucucccuuuccuugacacccuccauuaaaugcccugcacaggacugcucagugugcacccucgcugccuugcucaaugcugaaaggaugaaaggaccuccaucugcucucugcagcaagugaagcauucccuuccuacaucuuccucccggcaagaacucuuggcuucuaggccagugggugccccagccaccccuggcacuugcuuuucuggcuuuaacccuguucaagggucuuugacacuguggaaucugcuaacuugaagucucaugacaucacuuccaucugccacuggcuuuauggggcucaggccuggcccaaugccccaccccucgucucgucucuggcucccacccucccuccucuaagucugcugccaccauguugccagaauuacccccugaaaagaggaaaaugaaaucauuauuuucuacuuucacgaaauuuccauuggguccuuguaagccaaaucuucaggagacaauacagggccacugacaaacuagcuccaaugucuuugcuaugcucugaauauuugugucucccucaaauucacggguugaaauccucaccuucaagguguuggcauuaggagaugaggccuucgaaggugauuaggucaugacgguggagcccucaugaaugggaugaguggccucaaaacagaggcccggaagagcgccgccacaccugccaggacaugacuacucagagaaggcacuacuuauguggagcaggcagagggcccucuccagacaccaaaucugugagugccuugaucuaggaauucccagguccagaauggugagaaaugaaucugugguuuauaaaccacccagucuguggcauuuuguuauaggagcaugaagggacgaagacaguccccugcacugcuaucucccagaauggcucuacuuccccggaaaagcgagaugucaucaggagcucuuccccuucuggcgcuauucucacacucugaaauuccuguuccucccagccaucaucuggcaaacuuaauuuuacucuucaagaagcacgaaauguaaccaccucugugaagucuucucuagcucuccaaaagaaggcaucacuccugcaccugugggauagggagacccagcgcccaccugugugaugggcggaagguggguuuuguuauuuaucugcucauaugagagcccugaugcuagaaucgccucgaggugggccuggcuccaucucgguauuucacggcgcaggacggcacugggcacacugugggcuuuggguggaaaagcuuguuagugaucccacauaagcuaagggagcauuguuguuacugacucgaaaauggacuuucucaugcuuugaugaucaauuacugcauaggagcaaaucauaaugaacauaugaucucuuugaauauucaggccaaauucuggcugaauagguucugcuaauaucacauuuucaaaaauucuagaaaugccaacaagaaacccauaugagggcuucauuauguugaccugcagucccucuuaauaacaacuguguuuccaaagggaaacuuagaagaugugaaaauuucaccccaaauacuuggaaaagagaugcaaacauuugaccaaaaauggaaauuugcuccaaacuccuauuuuuaguuuacacaaugauguaaaacgcuuuuuuuuuuuuuuuuuuacauuggugcaaggcaaagugugaacuuugucaagggaagguuauuuuaagggaaaauacaacagagcuccagcugaaaauagucacagggcuucauauaucacuugggcuacaaauuauguaucgcauuugucaaccugccaggcuguuucuugauuucagagguggcugguguuggcuaauacugacugucucacucugacugcaucuuccucauagaaggacuucuauuuuugacccucauccuccacagagaagccugguaauuuucagucaaguacuuggauuaagggcuuuaucgaaaauuacuaggccucaaccaaacacaauaagacagacaauucagagcaucuucagaaaagaacacuggucugccaugauaaaaccaaacagaaggcuuuuggggcacacucaggcgggcggcaagaauggaauggaaaaagagcaaggagucauuauuagcucgggaaggaggaaacguaaaagaaugaaaauggaaacagauggaaaugacauuuugcagagagaaagaaaaagauuaagaaaccaagagcuaggcugaaagacauucaaaacuuuaaaaaacgguggaaaggcaaaaacagaagaaugauuccguggggaagaaauacagaaagauaacagaacaucauucaaaagcccguguccaauauaaaacagcagcaaauccauuuugccuugcugguuuccaagcacaaaggcagagaaacuuuaauaucacccgauucccgucucucccugcccccgcccacucucccggggagcacagagagaugccaucgcagggggccugggauggggaccccugcucccuuaacagccugcucagccuuguccagaggcaagcuuguccuggauucuggaagccccuauuucccguaggaagcuguagacauuucaaacagugaaugagcucuaggguguauauccuucccacagaguaaguacguaaugaagauuuccuuaauugcauauggaaaugggccacgaggagacaggcuggaucaguggagcuguagccgggucaugguuuugccagacugacgucccaccuggcuuccauuuuaucaucuugcaagccccgguaaucacuggucuccaagcuuaacugaggucuuaagucuccuuaccccaauacauuuguaaaacuggaauugcguuguuuccccuaaaaugaaauacauguaagaucgaaccaaggaaauucuuguaaacacuccaagggcugugggcacacgcucaggacgugagccuggugcacguggcgcucucagucaggucgguaaguucuguggaugcugacggcccucccugcaugcuugucugcccguucggucacuuaauaaacugcuguagucauuuggacggaagauuguuauuuuuaacauacaagauucuagacaggaaaauccagcccugcucuugcaagaauuugucuccgucugauccauaaccuuugcagugaaugucgugcuaaagucaaguuaguguuagccuugggaaaggagcacacugacaaaacccaacugugaugcggcacguggcagaguggggugggaucugcccccgacccggcgcuggggguggggaggugggaggcauggccuuucgcucucccaggggcucagucugagucaggaugcaagauccguuaacaaacaaaauaugccccaaauaaggaacuuuguggaaagucugggugacggccaccuucuugauugugugcuguuugcucaagugcuggccagaaugugcucaacucacuaacaaaugaccacccugaaagccccgugccuguguaugugugugggcagggggugucugggaccuggcuguacucacuguuccauguugcugugagccuaaaaccacucuuaaaaagcuauuuaaaaaaauggaguggagcccaggccacggcacagcucccucagagggagauccagagguggcagccacagccacugccucugcucucaggagcuuaagucagcacaggcccuggggacucagggauggucccuggagcagcugggacaucaccugggagcuucucagaaaugcagagccucgaggcccaccccagaccagcugaaucaaaaucuggauuuuaacaagauucgccggugaacuccaaaagccacgaaaguuugagagcagugaaauaugcccagaaggcaggaaggcagcugucauggcagccgucacacgagacagcagcaagaagcagccgguccacgccggggcagaccaugggaaggugcaagggcuuggggaacagagggcauguucagaaggccagaugcugugggugaugagaggguacaucuggaggcucgauuccuacucuaaggggccucaugccaggugagaggccuggaucgccugcagaggagaugggagaaucccugagguuugggcaucuuugaagcaguucacgcugugauccagaggccacuuuauuagaaaccagacugcuaucuaucugcaggagcggaaggguggagacaggcauggggccuuggggaggagaguggguagggaucucagacagacccaggugagagggaccgagagcuuacaaggagacacaaagugaacuggaucuagcagcagggcuucugcccagaggcccgaguuguucagaaguggcccagguagaagugggucaagauggugcagaucuuagagccagucugucagcggggaaggcucgcuauucccuaaggcacgugcauagacagauccugaggagcaaacgugacuuauccuugcuaagcccgggaaaugaaaaaugagauuauaaugggauuuauccaaagcacaaaugaaaacaacaucaccgaggcgcauaauucuaaauuuuaauaauaaaauagguaucggaaaacucugucuugcuccaacaagaagaugcugcuuuuucuugauuucuuacaccuuaucuuggcagcugccuguuucuaccucucuccuauuugccucaucuguauuuccuuaagggccaugugagaacucccaagucacccuucccuccagguucccgcugguaacugccguagucuugacagcuguuucaccacuacagaaaugaaauugagucacaggaaaaaaacaucauaucuuggugcuugugaucaugcuuuuuuccuugccauuucgacauacauuuuauucuuuccagacuugaguccccauuuuguaacucuuucagaaauauuuucgcuguuuaaauauuccuguagucuaaggaguagauaccaacaggcaggcaggcaauucuacugccugugaggccccacaggacagugggcagcuuccgcuucccagccgcaugugggcggcagugcuggucugacgauguucuuggcgcucaacaagagcaaagucuuugacucagagcagcaccguccaacaggaaccaccguccaauaggagccacauccgugaauguugcauuuccuagcugcuaccuuuuaaagaguaaaauuaauuguaguaauauugacucuaucuaaaauauuacuauuucaacaugaaaucuauacaaacaaaugaaugagacaccugguauugguauuaguuugccagggcugccauaaugaagcacugaguaggugcugggggcgucaagucacauucauucacuuccucacuguucuggaggccaggauucugcgaucaaagugucugcagggcugguuuccucugaguccucucucguuggcuuguagauggcugccuucuugcuguauccucaauauggucuucccugugugugucuguauccuaaucccccuucuuauaaggacaccagucagauucgauuagggcccacccuaaugaccucauuuuaccuuaauuaccucuuuaaagacccuaucuccaaauauagccauauuuugaaauacugaagguuaggauuucaacauaggaauuuuggggggaugcaacucagcccauaagaacauuuguuuuuuuguacuuggucuuagaaagaugguucacgugggcccaauggccgcauguggcucaggacucaguacuggacaacagugaggguuagaguccuaccaauuaauugagaguugguuucucuggugcucagcugcucagagggcuuaaagaaauaucugagacugaguaauguauaaagaaaagagguuuaaucagcucacaguuccauaggcuguacaggaagcauggcagcagccacuucuggggaggcgucagggagcuuauacucacggcggaaggcaaagcaggcacaggaccgagagcagaaggcagggaggucucacagccccucuuuuuuuuuuuuguuugagacagaguuccugucgcccaggcuggagugcaguggcucaaucucggcucacugcaaucuccgccucccagguucaagcgauucucaugccucagccucccaaguagcugggauuacaggugccugccaccacgaugggcuaauuuuuguauuuucaguagaaacgggguuuugucauauuggccaggcuggucucaaacuccugaccucaggugaucugccccgccucagcccgaagugcugggauuacaggcaugagccaccacgcccggccggucccacacacuuuugaacaacccagaucucacaagaacucacucacucucacgacacagcaccaaggaggaaauccacccuuaugacccaaucaccucccaccaggccccaccuccaacauuggagauuacaacgacuucagauuugggcagggacccagaucgaaaccauaucagggcuccacaccaaucaaggcccuccuucaaguuuccuugggcugugucaccugcccacuaaggccugugaugaccuguggaccauuuaaaaaguauuuuucccccaagauaauuacagucugggaauggaguguggaaaggugugcccugggcccucccaacuucaagcuucucaaccuucagccguggccuuugucauuccacugcauuuaggaaaggcaggaggacguuauuucucaaaugauggcacauccccaaagcagccggggauacucaggccucagccuuguuucuuaaacaaaagugauucuaaguccggcacaaaacaucacacuucgagcuucuacugugugcccccuuccuccugcacuggccaccuggugggauuccccacaucgcagucacgggggucaggagcccauucucucaggcugcuucuccugcaggguucugccuaccuaagcccccucuuuaacggaagaaggaaacuccacgacagagaaacgaggauugaggcccaacaaguuuuaugagauguuauucucacaucucuaguuguggggaagccgaguuauuugggagacuaguguggacgucgucuuucucagaauacaugcauacuuaggggauuucuagaugaacuuuuguuaaucuagauuggauggugcccuugauuguuagacucaccugucuaacaagcuguguggugcacgugggugccgcucacacucaccugccccuaagugcacuucuccaccccuugaagucuggggugaucaugugaucuccuucagccaaugacaugaacacugucauuuuggggcagaagccccagggcgggggacucuuugcuguccucuccggcuguguuccucuguggcggaaccucuguucaucuggguuccgagccaaaaggaggauucggagcaugugugagaaacacaccugugcuguuuggagccauggagauucggagagguucaaacucuagugcaggccauccagauuguuacggaagaugaauuauuuccuacugcucuuucucccagaaaauguaaugcuuguugauguuaaaaugaauuuuuugccuugcagcugaucacucagauacuucaaauuucauuuuaucaaauucuuuccagcaccuguucuucaucuuacuuuaguuuuagagggauaaggaggcuuuguuccuuuuuaacauucucguggaaauauuauggauauucagaaguggcuuuuccaucgguuuuaucaaugcagcuacuacgaagaaaauccuccuaaaacucauucugauucaaggccagccaaugaucacuuugccauagccuuuguucugucuccaccaaaacacagggacaucugaggacauuccuugagucuguuuugcuuuagcugcccauuccauuucaucacuugaauucauuuuuucuaaggagggcuuucucaaccuggacacgacagggauucugggcuauuucuuuguggugugggggccaugugugcacugcuggaggguuaacagcaccuucucuucccccagucaggagaacccacaaugccuccugcagaucucaguugagaaccacuguacugaaccgaacacauucguuuugccccuccauaugauuuuuuugaugaacuaucacaauguaggaaaagauauuuggcuaccuuugcuaaaaaaaaaaaaagacucuguuuuuugauuuaucauuuauugaaggccaccuguccugccauacaugagcauuucucaucugucaggaagcacuguuaaaugcugacuuuucauucauuuguucauucuuuccacacacguccauaauguaaugagcaugugcugugugccaggcacuguuccgagcauuagaugcaugguggggaauugacgcgugagguucuaucuucacagagcucagagccuacuggggaacucauuaaagaaacacacaagcaaaucuaucauugcaaaugauagugggugccauaaaggagaaaagaggauguuuccguggcuggagaacaggugacauuuaagcugagacaggaaggaguaugcccagggcacugcagggagacauuccuugaguccaccaugcacgcgugguccucuaccacaaaguaacagguagcccagaaugccaaucaugcccagauugagaaagccuggcuuagaaaaagcuaauucaagugacaaaaugguacaggcagcaaaaggaaaacugacucaagcaacguccucaaggcagugcagcagaaacccgcugggcaguggcagagagggcuggugcauuucaggacgcagaagggccaguguggcuggaaugcagagggcaagggagggaaugaggguggagaggucgcgggagccaacgcuggucagaggaugugcugccacaaagagagcccggcaacagccaucaacaaaugcgcacauuccuucagucccgugaccucuggcccucgggccucccggccaccccagggucccugccuccugcccugcccugcccugcccauucuguagcacugcucacccuggagccaagaagccacugccgggaagggauggcugcauuugcuccauuucuuuaccaguuugcugagaaacaggauucuccuggcuaaccuaguacaguuauaguaauuggcccuaauccucaaagcuucucauuccagagaacaaaaauauauccuguuccacuacagcagcgguccccaaccuuuuuggcaccagggacugguuucagggaggaaaauuuuuccauggaccggggugggggaugguuucaggaugauucacgggcauuacauugaucguguacuuuauuucuauuauuauuacauuguaauacauaacgaaauaauuauacaacucaccaucauguagaaucagugggagccugaacuuguuuucuugcaacuagaugaucccaucaggggaagaugggagacagugacagaucaucaggcauuagauucucaugaggaguauggcaccuagaucccucacacgcacaguucacaauagguaucauucuccugugagaaucuaauggugcugcugaucuggcaggagguggagcucaggugguaaugcgggcgauggggaacggcuguaaacacagaugaagcuuugcuugcucacccguugcucaccugcugcugugcagccugguuccuaacaggccacgaccuguaccagaggcugaggaccugggguuuggggaccccuaaacuacaggacuggguguaauucacagaacauuuccaauccuuauuuccaaccagccuuugggagcccacaugccauucugaaaacgucagacuuucucccugugucaagaauggcagggacaaauaaaggaugccgcaucgcuuacuccaaaugugagcagaaucccaagcucgugaccacggggacucugucgagucauuguuuucaaugggguuugguuuacgucaacagccacaaaaaggggcagccaucaucacucccgggcaucaguacaauuguggguaggacuguguccccagaaauauuuaaaguccuaaccccugauauuucugaaucugaccuuauuuggaaacaggguauuuggauguaaucaagggaagaugaggaccugauggaggagagugggcccucgucuaaccgcugguaccuccuaaggagaaggagacugagacagaaacucgcaugaggagaaggccugugaugacggaggaagggcuuggagcgaugugguuacagaugaccagugccagagaccgccagcaacacacccaaaggaaaaggcacggggcagauuuuccccugcagccuucagagggggcggccacgccaacacugugacaucaggcuugcagcucccagcacuaagcuaugagaauacauucccguuguugaaagccacccaguuugugcuacagcagcccuaggaugugaacgucgguaccuucauaaagugugcuagucaguuuucucaaaggaaaaaaagaaaaauaaaacagguucugaaaugaguuaggaaucuugaugaaaccaaagaaggaguuccaaugucacuucgguggcagguuuuaaaaacuucugaaacugaaacagcuuuuuuuuuuaaauaguuacugcauaccuuaaucagaagaacuacagugaucagauauaauacuggcugauuaaaaugacagcagguuuccuuuuaguggaagucaaguggaaucuauaauuuuguuuaagccaauuaaacuagaagccaccaggauggagcaauauccauccuaccaugggauuaauucuuccgugccaacagaaaaaugcaggaugucaaaggaauacauuagcucugugggcacggaaacaccuccgaaucaguguuccagacuuaguucccucugguaaggguuauaaaaauacuuggugcuuuuuuagagcaucuauaaaagggcuauugauuuuuuuuaaaagaagauuucuacuuuuaagugcaagcugaaggaacaugcauaaaacauuucaauauacaacuuguaacaaauuucugguucugcaaaaaucacacgcuaaaaaacguguuuacaacacugcagguaggugcauggaaagaggaaaacaaggacaauugcuuuuuguguuuuaccuugccuuugucgaaguaguggaugauuuccugguagagcugcuccuucagcugucccugcgugguggccugguacccgucccgcugggugaggugggccacacacacauccuccgaccacuaagggagaagcauagcaugagcggacccgaggcggaaacacccagggacgucagaauggugugagcuucgcaucggacacgcgugugggccgcgguucuggagacauguguggcugcugucaacaggcuggggacugccagggcagagccucuguccggacauaccgacaggcauaaaagacacaggggaggcauagcugcagugggguucagacaaaagaaaaacccagcagguucugcaaagcacggaacuggcagcuugcaaaugacaccuccuaacauuccgggacaaaucaggagccaggugauccagggccaucccaagagcggcaccccagggcucuggucucagugcugcguggguuggcauuuuaaucaacagcaaagaugguacauggaacacacaagucacccagaaagggacuagaaaggcugucaagcuccuuaaagauggggaggugucuuugcaccaucagccauaggcaaggugcugggcacagagucaggguuuggccaguauuccuggaagcauuggugcagucggcgugugagcugaagaugcacgaggagacaugccagagggaaggcaaggccacuuaacagauacaacgugucagcuccugaacuugggcucaacacaucaguggcauuaaguauaagguucaauaaaauucagcagcuauuugaugaggaccugcugugugccacaaaccaggucaaagaggaggcggaagaugccugacucccaggauggugcgauucuacauuagagaauaaugacacagaacaacacugcgugagcuaggaccaggcuacugcacucuagccuggacaacagagcaagacccuucuacaggaagaagaagaaaaaaaaacagaacaagaaaaagaacacugugaaaaagacuccaugggcaccuacgggcaggaggcaugugcucccacugggcagccuggaggcucacgggaggacacggugagcaugggcuugcuuauugcuggcccuaggagagggagcuugacccuguuuucagccaggccagggagggugcugcaaaggcacuaagugggaagcugggguccgggcaacggggcaaggcuccgucagcugcuuacugucuuagcaaaggucccgccccacuuuccugaaaccacgggcuggggagcaccucccgcuggacaucagggcucccaggcacagggcacgggcccuguauggcucugccuuuccagaaaggucaggcaagagugagaagccuuuaagcggucugcaagauuuuucaccuuaaaauugaacuugcauaucuccaucacaauuggacaaacucuuuaacuuugaaguuuguacaacauaauuggucuacuuuuauuggaggauggagaauaaaagcaaaacuagauucugaaauguaaccacaauaaaauaaauuaagaacaagcaaguucagaauccaaaugacuuccuugcauuuuuaaaucacuuuugcaaaugaaaacauggacuagggaagcaaaaauccucucuaccuuccacuuccacauggagauguaauaauuugauugcuaggcgaaaaacuaaaguuuuuauugcucuugguuuugacgaaagauaugccuaaccaaaaaagaagauucuauuugaggauuuucaguuaauaaacaauaauauaucugucauacugaagaauuuucgcaacaacauaaaucauguucuuuagugaggugauuagcaugaauucacauuuacaguaauaucaaaacauauuuagaaaaaauugcaaaauguaacggggcaaaagauauggagagagauuauguagcauuccccauuaaacuggaaaauucagaagcccaggggaaacagcaaugcaauugggccuaucgauuugaguugugaaacaaaccaucaugcaguuugugacaaacccaucuguacucaauaaauccaaugauuaaacaaaugaugccuuuaugcacauauauauguuuuacauucacacaugcauauaaaaguuuacguucuaugagggacggaguaaggguugagugagcaguuugucaaccccauuuuaauuucccugggguaaaagaaauagcuucacauuugcaaaaaacaccuugcuacugaaauuugaguuuugaauaaaugaaggccaucagaauucauagugggauagcugguaucagauguaccaacugaaauuuccauccuuauaaauuaugcuccuugggagagcccacguggcacggggcaaaauggguccucagacagccagccucaggaggacaacugaugaggucccuccagacugagcugagcuuuguguguuuuauuuguaacagacacugcuguuuccaggcagaggcaaauuuccauacucgcaggucucuagggcagccuguguauauuugugucacagaaacuaucagaaauuucaggaucgggccaaagauggaaagagucuuaccagaguuuuacuccauaacacaaugucuuccuuaacuccuauuaccuaauugacacuacugaaugcccauuuaauguaauuuucucugguuuucuuucauuacauuuuugguuuuugggaggcuggcuuggauuuggaaacaugacuccuugaaugagcagucuuuguggaaugccaccaaacuaaauucuaauucuuguaacuguucuuauuuauccaguucauaauuuuucaaauuuuuauaaggaugucaugagcaagaucaucuaauaacuuacugagguugugaaauauaaaacuagaggcuguauagcaauuuguccauccauccauccauccauccauccauccauccauccauacgucacuguaaacaaagaaagucaaugucugaagcuaucugaguaauaaaagaaccacuaagaguagacaguugucaugccagacuugugcuaggagcaacacuccuuagaagaaucaggcagagagcacuagcaggaggucucaacgugaacugauagagugaaaagucaugaucuggucccuaacucuuuacuaagacaauuagggguaugucucauccuaucucuuagcuguucuaccaggaaaauuccuucuugauauuguucuccaccauccuggaguccuguaguccugaacaaggaauuguagaaucucuaacuugcugucagcucacagccaagugaugggaguuuauaaugcucagugaucaccugcuaugacaucuaauuaaaucugcauucagcagggacaaaucucuaaucaaaguacuuccuaaauauuuuuguucauauccuugcauuuauuuagucaauuucauaaaaccuuaaguuauaggccuacuaaaauuugccauggaaaaauacaauucugaauauuguuagaauuuauaacaauagaaucaucaaggugacugguaauugacauuaccuuaagaagcuuugcauggagaagcaagguguaagccgcuucgguguaguuaucacacuccuugugcaggucacagagcuuguacaaauaccugagacaauaaaacagagguauguucuuaaaaugucacuaaauaauuuguguugaggauugcaagagcuaaauucuauguucaacaguaaaucauggcuacacuuccuuuuuacaauguucauaauucaaaaugccuuaaaaacuuuugguacagaaagcacuaagaaaaacucaggaaaaaaauaaagaugauacacaaagguagaauuuuccuucaaauuuuucauuccuuuucauuuucccuuaaacauuuuuaaugagacacacaauacuugauugugauuuucugcauuucuacugaguccaaaugcacaaaaaaauccguaaaaauacaaauccaucagaauaaagagcuccaaugauuacagucaaugugaucgaaagaauuucuuugccauaaagaaauaaagguaacugaguuauuaaauucacauaguauguucuuaaaaaggagaaguaaaaacaaucuuagaaauagaaaauuagacaaucacccucaguguaauaaacacaucacuaaaaacucaugcuguguagguuacauccuucuccuagucuccagagugguaaucuugcuaauuauuugacacgagacuuuagaaguaaccaagagagaagggcucaaucacagucccucacuccagggagcaaggcgaguagggaagcaaaauccagcaggcaaugcaaaauguuucucuucuucauggaagaaagacauaaaaaacacgggacuauggcgucaguuaacuaagagcagacugaaaaauuauaacuccccuaugucugguaaaguuauaacuggauuucucacuggaucauauaacuuacugugaaacauuaaaauuuaugugcuuaucuuuuugcaaaagggccacaugaguuggucaacagguacaaaacgcugugaaacaauuauuuguaguuuugcuuuugaguuggcuaauggugaccaccaagaacucugcacugguguggacaagcuaugcaagagcugagaauguaucugggagcuccaccaaacucuaccuuauacguuucacaauuuucuacaaaauaaaccuuugcggcuauaacacauuucuuagcauacguaaacauacaacauauauuauuauuuauaauuaacaugcagacaagcgugaugcauacauaccuuauauacauuucuucucuuucaauuucuuuguagaaauucugaaaaguuaaaccauaauacuguuuuaagaaaucuguuccacaaaagguaucacaugcacaauaaaaauucaagauacuucaucuugugucaaacacagccaaauggacccagcucuuuggaucagaaccauaaauucacauaaauugcaaaaccaucuuacacaguucuucacuuuuuuuuuugcuagucaaacacaauuacauuucuacacugaacacugugaugacuaaaaucaacuucugucacuugaaagucacuugucuucaauuaaaacaagguauugcccaaaaagacaugaagacaugauaucuuagccauaguaaucucaucagaauaaaugaauacauaaauaaauaucccaaauuugggaauaagcaaauaagcaucaucaacaugauuuaaagcuuucugggcccagccucagcaagagcuacaaagacaauaugauaauacagaccugaguuaugcaauacacuagccaguagccacauauauuaaaagguaaaguaaauuuaacuaacauugaauaaauaauucacuuccccagcugcacuugccacacuuggagcgcuuaacagccacaugcggcuagucuacuguaucaaacagucuacacaagacauuuccauuaucccagaacuuucugguagauagcacuguuccagacaggcaaaccuuccaaaccacaguuaaaaaaagagggcugccucugaaaaagcccccuguguauaaacacugauggagaaagcuuaauuaguagauuaaaaccaauggauuauuucuacauauuuacuggaaaauaucgucugguugagcaauaacauuucuaucaaaauuauauuucuuaaggugaacaucuccauaaacacuuuaaaaucuuuuucacacaggagccaccagagaggcacagaagucaccucacaaggccuaagguaaggaaacaucagagucacuuucaaugugaaauuuagcaccuaaaaaugauguuagcccucuagaaucggagccugaaguaacuagugaauaucaccauuacagagacauacaauuauccaagaaauggcauaggcucuuuaauuucaugagcaaaacccagcauugcuucuacaauugaugucucugaaaagaaaugauaacuaagucuagaaaauaagcgggggcacauuuagaaaaaugcaccaagauuuucaaguucuguugccucugacacuuuacuguccuccaguucauaugacacggcucaguaaugaggauauuuucagcugacaacucacugucgcaacaaagagaaucugcaucaaaggcagaggauaagcccuucauuuccaacucaaaguugccaguauuuacaagcuacgguuucacaccauccccuuuuguacucauauuuuuaauccuuucuaagguuuugaucauuuuucuuuacaauuucacaacgggaauaucaugcgaccuucauuccucucucggagauacgaaaugucuucuauuuucugccugugcugaguccuguucccuuccuaggacuucaaaaccucuccacaaccgaaguacacucaucuccaaucccaauuucuauauaaaaccuuuguguuucuuacguaaagguucacgcggugcucccacuccuccugggcuccgcgggcagccuugucucucaaguccccccacaccagcgcugacugacaucugugccaagcuugcagcucagcucccagaggaaccccauugggaccggccccccaacuccaauccaccgcuaggcauugaucuuuuagaacgcagacaucugcauuauauuuccauuuuggacuaaaacagauaccaagauuuuaaaaauacuggaccccacucugcauuuaauuagccuugccaaggggcuaugaagagaaguaacuggcaugugcaaaguaaugaugcgccuaccagucacagagaugggacguguggaugacugcacagaagcacuaagugacacucagcaacauuagugaccaauaauuaaagaugcucgauuaugagcugucagugaaauucuaguuaaagaauuacaaauauacauccaaguuccaacauacaugcagacauccuugcaggagauguccuggggacuuagguggccaagcagagugacugcugcgucucuuacuuuuucauuuucuuucuucuuuuuuuuuuuuuuuuuugagacagagucuaccucuguugcccaggcuggagugcaguggugugaucuaggcucacugcaaccuccgccucccgaguucaagcuauucuguugccucagccucccgaguaccugggauuacaggcacccaacaccaugcccagcuaauuuuuguauuuuuaguagagaugggguuuuaccauguuggccaggcugguaucaaacuccugaccucaagugauccucccuccuuggccucccaaagugcaacaggcgugagccaccacacccggaccuauuuuuguuuuuuuaagggcaagaaaauaggacaugaaggagccuacacaacuuacaauguuccacuaacuguguuuuguaagaaaccacgaagcugguucuaaaggaaacuuggcaacagacuuacagagcauugguaaauucuauguucuuuauuuuauuaauuuaauuuuuuaacuuuaggcuucauuucuucuuagugacuaacagaguauauuuuauacaucuccaauauguauacaucuauauucauuuagagaugguuauacauacccaucucuauuacacucuguuucuguaauaaaaguaccaggagaaaagggaaaaacugaccaggaaauugagcugggcagugaguaucuaugguuaggacaccuaucuaccuaucuuuaaaacucugguuucuuguuucccuuuauuccacagauuuauuuucuaaaugaaaaaacugugacaguugggauccauuuuaucauccccaggaaaugguuaagagcagaacauuugauuuuucaucaaaugauucaggacguucccauuugaagaaaguuaauaaugucagauaaccuugagaacccaggguguguuucuuaguuaaaacugagcaagugcugaccacaguaaaaguacgugggcacugagucuggcucugaauuaaagaggaacacagguucacauuagaaaccgugauuguagguuuuauuacaagaguuuguuuccugacccuagauucagguaguaagagcccauauucagagcacaccaccauuucuccacuguuucauguccuggugagcauaagagaucuugcuuaaaacaaauaaaagucucaaucaucaaaguuggaagacuaauaaacuuauugauaauucuuccuucugggcacuuaucagccucuuagauccccuuaaggauuagaaggaacacuauaaaguuauguccauaguagggaaggauuuuguaaaguucuccauuucuuucccauagaaaaauaauaguuccuauuucacgucaaucacauuggcaccaugacaacaaauuacuuugaacguuggucagaaugcaagaagacagugaaguaagcgccagguucuuuucugucuguaagaucagaccaacugaccuggggcagagcuugcugcuguaccacuuggucagucuccaggugaauauaaagacaaacacagccacagcccagaccucagggccagacaucagagaccaguaauuucuacaguagccuaagacacaugaugcaucugcaaacauucagauuuuucaaguccacagauucuguguccaguugauugaugagaccaucagaggcauucuucacacuguuacaguguuuuagauuuccagaauuucuucuugaugauuucugugaguuucuacguaguuuacccaccuucuuuuauguuuuaucuacuuuucccauuagagcccuuaggauauucaucacagcuguuuuaaauugcaggucugaugauuucaaaaccucugccguaucagagucugguucuaaugccugcucugccccuucacuguguuuuugucuuuagcgugcauuguacuaaugcguugaaagugaauaugauggacuggguaaaaggaaucuaguacuggcuccaguggugguuucuguuugggcuuccacucugugguucucuguauccuccuguuucuuugacuuuggggucagaaguuuaucuacagaucuaagaagacggaacuaauaauuguugauuguuuucaauuuguucagcuuuuuucuuguugugaggacaggagugacaauuugcaagcucuuuacaugcuggaccaaaaacugguccccuauauuuagauuuuuaaggaaaagaaaacuuguuacagaaauguuuaucauuagccuaaacaagcuguccagccaugcaaugaaggggcgaagacugcucaugagcuuucagcugugaaguuccucauggcaaagcacagauccagcacugauaccauagucgaugaaaagugaaagcauuccuuuucguuuaucuuuuuaauccacacaacucuggcuuuuuaaagagugaaugaugugucauguuccuccuggcaugaaaguccauuuccaugagcauaaagcacccacaaguccacacaagggguggauguggcagugaggacuauguauccacauguuguuggcgacucugaaauccugaggccaguggcugggcagagaagggagguaaguagagcaaagcaggaguaguguuuucuugcauucuugccaugggacaggcaaggaaacuugaggaaagcccuacuauggccacgagucagcccuuguguuucuuuauaagagaagcagcaaagggagaagcagagagcucuggagccaggcugugggaaucacaacgcugcugagagccaugaggcuggccgggaucugagcuugugguaaagcuucccaaaagcucauugguacuaauggauuuccuggauuagggaccacaaugacaucaggaaggggguguccacagaacccagcuguaucagggcaacagcaggaaugcaaaaggcagacagauggcagcagccaaggucgcccaggcgucuguucuccauggugcccagaucugguuuccuguggcugcuguaacaaauuaccauaaaccuaaaacaacagauauguuucuucucacaguuccagaggccagaaucugaaaucaaggugugaguaggacaacguuccccuagaaagcucuagggggggauccuuccuggccuccgcaggcuucugguggcuccaggcauuccuuggcuugagacugggucccuccaaucucugccuccaucuucacaaggucuagccuguuucugugucuucucuuuugucucuuaugaggacaccugucauuggaguuaguaccucuccccuccccuugcagguaauccaggauaaucccaucugagauucuuuuuaauuauauuugcagggccucuuguuuccaaauaaggucucauucacagguucuaaggacugggguauugcucuaccuuugaggccaccauucagccuauguacuacauagcacgcguuuauggucuccuaaucacaaagccuuaaggccguaauccaugaggcacuacccuggcugcaagauacggugagucaucauucacaacgacaaggagagcgacauuaaaacguccagagaugggacaauuuuacagacuuauucagaguggacgacuucaugauuccuucccugcagcagaugaggaaacaagcgaaggagauuguucugcgguggaaagcuucguggcugacugucauagauaagggcuggggcaauccccgcuucaguuucuggugugcugugaaaacugaaaaaacgugauuaagcuuucacucaccagcacauugacggugcagcucaugcgguuuucuuuguucucgucgugcaugaugguucuauaauccaaaagccuuuccauuaagcgcacaacgaguuuuacaaaaguuucuccuguuuuggcgagguauuugugcuuccugcaguguuccagaaggcugaaaaauaauuauacacaccuuguuaaucacacucagaaaaagaaacucaacagaggugcaauuuuaacuauuuuccauuauuaacacauuuuaauuauuucuggguuacaaaguucauuguagucuaauuacggucucucugucucuguaucucucagacauaaaucccacugcuaaucaacacuuacauuuuaucaaauaacacuuuguacuguucgucuccucugccuccuucgacuucaugauccagcuuggugaugaucucauuuucaaacuauaauuaaacagaggaagcguaaauaaucagcauggcgaguauuucauuuuaugacuugagugucaauagaacauaaaucggcaagagagaucaucauagauggcuacccucugccuuugaagccucauuuaagaguugccaacacagaaccccuggagguuucugaugaucccuugccauagggggaccucucauuuccuuuucugguuaauggagccugaaccugcacguccugauagcaggagcaagaaccaggggaagaaagacaaggaaaccauagggggaaaaaaaaaucaaagcgcagcaugaaaaaaagucucaaacuucaucucuacaaacacguaacaucuaaaauagcuuguugguuccugaaaugaacagaugguguuuccccugccagugaagaguucucggcaaucugaaaacauccuaggggccacuuagcugccauuccuugauagauccuagugaaauaccucacucuggcugaaaaaauguucuaaagagcaagaggagcaaugucccuaaagacagaccagcaggcaccucaagaagguccaucuccagccuauccuccauccccaaagcuucugauuaaauuuccugggaaucagggugcagaagggucgccaguaccagcuaauuaugucucagauccaugcuuuuagaaaaacucuaaauucugggggguggaaaucucuaaaaugucuucaagugucugaucaggcugaaaaaaaccucgauaacaauggacauguuuuccccauccucacugcccaguuccccaucucuggcagaguucauagccaucugaguacugggacuccggccuggugacuagccaugcugcagggggcccugagguuaccaucaacuugugccaguagcaaggaggggcugugagauuguucauucccauaaagaugagacaugcacacucuaaacugaaggaagauggacaaaggaagaauugaagaaagcugaauccaggguucagaaagcaaguacgccaugggcauguaugcaagggucuccaggaucucucuaaagccauguucaaucaccuacuuucucaggcaacaauucucaagccgccugcuguuauuaggaucccaguggaauuuaagcugagugagaggaagaauuuuucuuuggucauugcucuagccagccccaaaaccucaaacagugccuuugaugcucuaauggaaugaaugugcugugugcacauaaacuacugaauacaguuggucuuagaccaacuuagauuggauuaaagugcuuagacuggauaaagcuggagagggcuuaauaugucagcaaaggagcggucuagaggguugauaaaucacaaccugcauucuuggccaggccaagcccagucgugaaaacugcucauccagagugccugugacagacacugugggcaccagagacuuggggaugccccugcaggagcagcugacuguggaccccugagaagcaauuagcaaggaacggugaaacccaaggaggggccuccaaauggacacagacgcccugccuguccucgaucaguacacacugcccaaagccacagcuacagaugaaacaaaggcuuucagggcuggagagaaguacugauucuugccugacaucaaggacucagcaacauccccagaacccggaccuuagugaaucucuccaauuuucuucuugaucuucuccauggucuccucccccaaauaaacacuucuuuuugauucugucuggccuaagaaguucaaggauuuuagcagcacagacagaugguucuauugaagaaggaggaaugaauugcuuuagauuuuuuuucuccugaaaucucacauuaacgauuuuuacuguaaaauaacaaccuuuugauacuaaccacugcuauccugcccuuuacagaaaagaauucugcaaaagguaguucuuuuuggaaucacauacaagggagaucgcuugguaguagcccaaaaguuggcauuucaaggcagugccaucucccagauggugccaugauccagacagacuucaaagauuaaauguuugaugagggcugaugcuucaggacaaauaauagagacacaaaauuaaauuaaauuuaaucaaaacaugauucaauuucauguauguuuaaugaguacagacaacaagaaagguacagagaaugcagagaaaugugccuucuccugacaugggcaaacauacaggcauuuaaaaugcccaucaauggucaagccaaagggaucugaacacagaguguagguuaugaaaacggcauguuuucucugcuuccauguaaaucuagcugucacaaacacaggcaaugaggaagcuacagcuaccuagguaugcugcugaucaaauucugacugaugaacuuaaugauuuccaacaaagguggaugagugguaaguaaaucacaacacagcugauucuaauuuuacuaacccuaguccaaacuaaguaauuuacacaaacaccuggccacccugaucuguuuauuagcaaggauucaguaccagagauccacaacuagccucuaauuccaggauccucguucauuuuuauagaauacacucgaauugauucgcuagugugcuaugaacuguuacuauaaucagaauuaaaugauccugucccacuaaauuggagauaguacauuugcugauagagcagagcugguuuuaucaaaaucaugcuuauuaucuuccucauaaaugcacauugucuggugauuugcaacaagguucucuauggcugggauaaaauuagcaaggguuuacuguguugcucaaaagguggcagaggcucacucacguaauaagcaaaaccauuauauuuucuucucuuuucugaaucacuaauauugcuccaaaaauauucacaggguguccaacugaaaauacugaacagagagucucucagugucugauaccagcagcccucugagaacaugaaacaagagaacacuuaugaauagaaggccuuucggaaaguugcuguuaaauugacgugacggagucagggggcugugcucgaagcgauauugacgucuuguuaauucaauuaacuuaaaaaggaaacacugcuuuuaccacucacugccacagcuaaccauaggcuauuggcaccuauuugaaagaucauggagagaaggaucccaguaguagcuaauccaaaagccaauuauauuugguuuggaacgcauaauuuuuguuuugggugagauuuacuauucuuacucuaaugcaucuauaauuuuauacaucuguaauguauaaaaucagccugcacuugccagacauccaggaccaugcuuuauauaccagaagagcucuaggguucugugggagcgcagcaggaggcugggccaggguggaaagguuugcacagaccacucaccgccuugauggagggcuccgagguuaucaagagccgggugagaucugaaaucuauggacaugaucugcuaaguacauuagcagaagggcuuauuugacccuuuaaaaauaaaccuuaguacaaugcugcucuuugcccagagugcucuaguuucuccuguauuuaaagaagaaaugcucagaagauacugcaggcagagggcaccaaggaaucagacucucucugccuucucucccugggucggggccaaucugaugaaacugcgcaaccacaccuuacccccugagcaugugcagggggaggugggugggagaaaguugcuggacuguaucuggguggaaaacaugguuaagaagaugaaacaggcaagguucagcagagagaagugugacaccgcacaacccuuggggcucuaggcgcccaugcugacauccuacaagugacuggucccucccgauccaucacucagccuugaguaccugugcucagacacauucauaucuuuauguauagagcauuccucuugccuaacugcucuggaaacuuaauuacacacuaauuaaucgguggcacuucaucccacauucaaaaaccuccacauccuccuacguccgucaagcaaggggcuugcugaccuuggagcuccugugaaacacucaugagccuggaggacccagagccacucacuuggagcugccuggcuggggaugcauggcugcaucgcaggccaugacaccuugcugaugccugagacaggugcagcggcuccuuaugucuacaugacacagauuaaagagugacuuuagggcugcaugcaauuccagaggacucugggaacauggccucaaaauuaguccuguuuaaucugguuaaaggggauuauggaagaaucucuuugcuggagggcuuuuaagaaugaaauucaauauaaucgcagcuccuggagucaaggaucuugguuuccauggccucucagaccaucuuugggucuggauucaaugaaacagaagccucuugugccauauuuccucuuuaggcaagaauuauuuugacauugaaagcaaaaauaaacaaaccaacaaauaaaauccuaaugaauuaaagaauacacaagauagaauugcuaccaaacucauucacauucauauuacaguggaaaauacauuggccuuuccaccaaguggcagagccgcugacauucacccggcuauucaauuacuggcuuccgguuacuggcaugggcagugugaagagauuauucaaacaggagcucggcaacacugaugacacaaagauuauucauguucuaauacuguuacaacuaaaugggaauuucuggaaguugugcagcauuuuacugagccucacaaagaugacagaaaauagcuccaugauugaaaauauuauuuuugcugggcagcuuuuuccauuccauuuuuauuaauggucuauggcccauauggucauuugcugcaauucucagcuguuaguucuguauuuuccaaaggcguaacaaauggaauucuuuaaaaagaugccaggagggaauuuaaaaguaugcuuuuuauuaugaagcaaaauccaguaugagggugagacuuggagugcgguccacgggagggcaggguucuuggugaggcagggagagucagcuuaaggccaggagagggcucaucuccugugaccaagggcaggcucauccagguggaugggauaaggggcgcgaagaccccaaugccucuccacauuuccccugccagcuuaucaguccugaaaucuucccaaguaggaccucuccuuucaaacaaauggagauuccuagaguccugaguuuagggguaagcaugcuacucucuggauuggggugggcacagggcgagggggugggaugaacgcagcugugguggugucucgaggaguuggccagcuguaaggaaagggggcagagaaugugcccuuaggcaccaggacaggaagaagcagcaggggaggaugauuuaggagaauggcuggggcauccggaucauaaaagauucauagaaagugcuggaagagccaggaugaccacagacagcuggagcacccagagacaaaagaggcagaagaaauaagaaauggguuuuuguugaggagcugcagugagugccuuaggucagcuugacagagcuggcucuggggagguggugaugaagcucugccaaggccuccagacggaaggucucugaugcuaauggaacuuccccugugaagggccauguucuggcaggagcuuggccagacagaugccuaugagauaggaggccccagauguccacaguggccuugaguauggacagggcagggaaguggcacaagagugcccagugauggaggggguggcugacaguggccacagggcugggggccaccccaggggcauggcugcagugggcauccacuggggcuucccacauguauccccaccuccccuggcuuggaguauccacacugcaagcacuaggaggaaaagaaaccccacaggcagcagccuccuggccguacacaaacagggaugggauggcagagaggugugagauugcaagagcgucaugcagcguccagucgcugggaacgccuuccugucaacggaccggagcucuauggcuauggacccagcccacagugaagcauaugacuuugaagguaggagggacuucuaaaaagaauucaaggccgcugugcacaucuggggccucccaucucacaggcuucugucuggcccagcuccugcagaacacgacacuucacagcaggcuuccacuagcaucagggaccuucagccuggagccuuuuguggagcuucaucgccaccuccccagagcgagugcugucaagcugaccuaaggcacucacugcagcgcuggacagagagucccaggccacaaggaggacauggcccaugaaaggauaacuccaugccaccccaucccgccaccaagagagcccauucaacacauggacccuggagaagcaggauaagggcaaggcugagccuauuccgaaggaacauuugugcucuuucuugcacaaguggagacaggaaaggaguaggcucuuggggagguguaagggaaagaacguucuaaugaaaugcccgccacugcggcugaagagcacgagcacaagagcagaaacuccgggcaacguuagaaaagccaauuuguaacacaugcuuuuaaaauuccaguaaugguuuggugcaguuuaauccugaguaaaauagcagguuuuucuucugaauccagcaggucuccucucuacuccaauuguaagaguaaaauacaccuggacauauauauuauuucauauuccauaaacaguagcauauugacagcucuacuccaaaagacacagcaaccuuuaaaacauaagcucuaucacggguucaaaacacuaaaguguuguaaaaacaaaucccccuaauaucuucccccuacuccaguaggguuugcacaucugcuauaaaagcuauaaaaaaaacuuaagccccugcugacgugacuaauaaggugagguaacugggcuuauggcagaggaguuaggcagcagccgaccauccccaucccagaagcucguggauggagaagcagguggggccaacccugcaccaaugugccacacacauguccacucuacacauucgcccacaucaccgacaauaggggccaucccuugugcuuuaggaagaccagcugagagggacagguggaacuggagucagaaaggacuuagaaaacauagauagagcaagucaagagacaaauacuguggcccaggaauaauccuggacuagugcaauggugauugcgcagaggacggaggcugcagaugagacagagggaggacugaugaagcuucacaaccgacugccacggaggccaggggagcaagcaaaggccaguccagcaugacccgcagccggaaaacccagugacaaggagacuggcagaaaaggggaugaugcugcaggcuugggagauuccagcugggaagcugaggugggcacaucaaacagaagaaaacugaucuuuucccaauuacagaagcagauuaacauacaagagggauuuuuuuaaaacaaggguuaguuuuucugcccucauuuuaaagaucuuuaauguacgcuaucccucgucugcagagguucaagcagaugacaacacagagaaacaggugacucugaaccaacaguucagguagcugaccacgcucagccugacaguggguccuucuugugggugaaucugugucuucaggcuuaugcuuggauuuacauacauccaagcacggcauguuucaugcuagugaaauaguuuguuguuuaugagauggaacuaaaugugccaauuacuucaugauauuacucaaaaacaauuugguuuucuggaaagaugucuccugacgcugggucaauguugaagccccaaugggaaggcgguguuuaaaaugguggcacaaauucuguggcucucguuaacuucggaccauuuccuagcaaaccuggggccccugcaaacuggagaaaaugaagcacuuccucagaagauuguuguaagauuuuuuaaacuaccacaaggcagccaugagacaaaagaaugugagggaaaaggggaacaauucagaaaccaaacucucauucuucuuuauucuaacugcccuugaccuuauuuugacccaaagacugauuaaaaaaugacaaauagaaugauguuuuaaacacuuuugaccuuaguuuucugugccagugacauuuaucuauauaaauacacuuucccccuuaaccugauucuuuaauagcaauuuuucacaaaguccuucuuugggcuagauuuauauaaaauucaaaaagucaaaugaauuuucugccuaggaaaaagcauuuaaauuauaauuuguaguuccaaugaguuggcagugaaacuggggccaugauauagugccagcagcaauggagauggggcaaaucuuaucguauuaacaucaaaccauuuggcaauaauuucaaaaguuacaaaaauauuugaaauccguaauuacauuuauaagaauguauacugggaaaauuuucaaaauaaauucaagcuauaugcaugaauguguucacugcacaguuauucacagcagugaaaaucugcaaacaacuuacaugcccauuuauaggcgauggauaagaaagugauaguuaauuuuaugccaucauuaauaucaugguugcuauguuguaauuaagggaaagcuccuugauauauuaucaaacagaaagaacauuaauaaaaaaaaucuagguauaauauuuacaauguuguauuaguacagucuuuauacaaagacuuuguauauacacagacugacagugagccagagaaacaaaaacagcuguucuuucaaaaaugaauuaucuuuaauauuauuaaaaauaaauacagggagaccuucugcuaucauggaaaaaaagagagagaacgggaggaaagaaggaagggaggaaagaaggaagaaagggagggagggaggaaggaagaagggaggagguacuaacaccacucauuccaguccaacugacauuacacuggggaaguuaaacuaaagcccucucuacuguccacgguuggaauaaugugaaaauaacagucaccagucaccuuauaaaaaacugccuagggcugggcacgguggcucacgccuguaaucacagcacuuugggaggcugaggcgaguggaucaugaggucaagagaucaagaucauccuggccaacguggugaaacaccgucucuacuaaaaauacaaaaauuagccaggcgugguggcacgcaccuguaaucccagcuacucagaggcugaggcaggagaaucacuugaacccgggauguggaggcuguagugagcugagaucgcgucacugcauuccugccuggcaacagagcgagacuccgucucaaaaaaauaaaaaaaaaauuaaaaaacugccuaguggagcaaagugcaaaaaacaaauaaugaucuccgagccagguguuaggcuccucugcaauggguuuucaagcacagcuguggguguguagagguuaaaggaaacggcuccagcagucagacucuguucaucuccugugugcuccuccccggcuuccggaacaacccugacgaaauggccaugcccagguuuguaugcagcguugggccccaugguccugcagacacugggggcucacccugcaggcugcccccugcacuccacaaacacccagaccaagggagguuccggccuugagagaagagaagcauccacagccaccuuuuauagugccaggcaccgugcuagggauuguacaggucugauuuuauuucauucucacaacacgccuuucugguagauucuauuucaugccaauguuacaagcuugaauuggagacuuaaaagauguugagugauuugcugaggacccagauaauaccuggcuaagccugugaaucucagucucccugcccucaguaucuaaacucaacucacaguguggagacuguuuugguuucguaucucucuuuucuguucuaggaaacagcaaaaucauucuucguggauaccgccuucaugugauaugaugaagaugaccaaugaaaaucuauaaacuacucaaagcucccuuaaaugauaaacuguagagguggguaaggauaauauacccuuuaauauuagaucucaccaacauuaagcuaucuugauugaugaaguuuugauuuccuuucauuauaggaauuuuucuccaaauuccucuaaaaucuauguaaaaugcuuaguauguugacuuacuugaauugcuauaauaauuuuuaauauuuauuuauuuauuuauuuagagacagggucuggcucugucaccuaggcgggagugcaguggcgugaucacagcucacugcagccuugacuucccugaccacaggugugcaccaccaugccucacuaauuuuuguauuuuuuguagagacggagucucaccauguuucccaggcuggucucgaacuccugagcucaagugaucugccugccuuggccucucaaagugcuaggauuacaggcgugggcaaccacauccgguccaguauaaugauuuuuaaaagguaucuuucaauucagaggacucccuaguacuugggcuucucccaggucuccugcaaagcaucauggccaaaccauuaguacacuaaggagaaagucauagcaugugcauguguguguaugugugcacauauguguauauguggggauguacguguguguguguggggggaggugcauguguguguguguguggggaugugcguguguguguggggggggauguguauguguauguguauguggggaugcacauguguauguguguggggggaugugcauguguauauguguguguggagauguacauguguguguguguggggauguguauguguguguguggggauguacauguguguguguguguguaugugugggugugggugccaacccaagaauacauaaacaguauacuuauuuucuugggauccagaaggagauuuuguuacuucuugagcauaaguuaugcagcagaguuugucccucaugcuguuugucacaguauguuuugagcacuuuauauacacuuucuuagagaauuuucaucaguuccauugcacaggcaaaagaacaagacacacacuuaagagaauaaaagcaaagacuuuagcuuucaaaauaccacaauucugcaauaagcagccggucugagagaauguaacacauaacauuugauuaaacgcucuacaagagcacguaccaagaagugggagcaagagacuuuuauccagggugcaauguguaaguaaacccagauuaaaagaaguaaguaagagcuaaaaauugagaauaauccucccaaaaauugagugcaagggaugauaagcuucuucaauaaggaaaaucauaggcuuuuucucucucaagcuguaggaaaauguguuuuccacguuggcaccuuuaacucuagaacugucuacagguuucuuugaagguuuucagguuugccucccucaugucccccggccacucgcugcacaucuacguccuuaccauuuggaagcuucgggucgaauggaauucacacugcaucauaucaaagaagauggggaugguggcuuugcgcagcuccgucucgggaauuaaugucauuucuaauauugggcccaccauuucuggaaugaacuuuaucuuguguugaccuuggaaaaaagagguacaauauucagaaauaaagaaaaauagaauucuaaaaugggcuuaaauggauaaaacaacacaacacagaucacugugacuuugagcagcaggaucccgaaaaugugcauccauuucgcgucugcagaugaugauuuugaacuuucccagccauuaguauaagaaguggccuguauuccacauguuauaagugaagcucuucaaagauccgcgcgguauaagccuguaaucaugacuucucugucagagaagaugaacacuguuuuauaaguagccaguuccaucacacagauucagaacacaugcagcuaauucccaauucugaauagagcaggggcugcgagucgggggucucagccucuaacucugugcacagcgacaggaacaggagccgacaaaugagagagagcagauagucucuugaguccucuuuaucucccacaucuuaugaagaugaguuugcuaucugacaccucuguaaauaaugcagggugauuucugcaacaugccaaacgacuccaaucaaaguaaaucaaggcgccggaaucugaggcugaaacccuaaaaacagcagugauucuaccuuuucgagcuauuguuugauaggaaaaugcuuauuuaaauaacuacuuuaggccgggugugguggcucacgccuguaaucccagcacuuugggaggccaaggcgggcagaucacgaggucaggagaucgagaccauccuggcuaacacggugagacaccgucucuacuaaaaauacaaaaaaaucagcugggcgugguagcgggcgccuguagucccagcuaccugggaggcugaggcaggagaauggcgugaaccugggaggaagaggucgcagugagccaagaucacgccagugcacuccagccugggcgacagagcaagacucugucucaaaaaaaaaaaaaaaaaaaaaaaaagaacuacuuuauuaaucucauuucaccuaucuuguuccagauaugauuuuuaaagaacucagaaaaauguuucucaaaaguuuuucaaaugugaauaauacugaauaugaucauauuaguuagcauuuacaauuuacaugacaagcucaagauaaagcaucaucucacugaauuuucacgguaaccuuacgagaugguuaccuucuuaaccuguuaaacagacgaggaaagugggcuguacccaaagcuguucugugagcuguucagagaaguggagaagcaggauuugaaccugggucugagauuaugaaggcuuagcugugacccucauuuuacaaauuccuucccuguuugcuugucucaggaucuuugcauggcacucggacccuacccgacucucugaaagagaaaucguuugagcuguccacucccuuauuuguccccccuaauugcaaaaugaacagagaggucagugaucugucauuuuccaucguuuuaucccucacuguugagacaucacaaugcuaaauaagcccccagaagguagagacuggcuucucacaagcacucaauuuauguuuuuaauuucaaugguuuuuguuggaaaucuugguaucauaccuuccugggucucugucgcugacuuagaaagaugcuagcgcaggaucaccaucaggaaaucuggcgacugggcagagcagcuggcagcugggccugaugugguggccagccccucccccuccugcuaguuguggguuggccgccauugugcucaccccagccggggaccccauauccugugggugcguggcugcgguacuccugaggaucagggugagcuccuaaagagcuugaagugaaccaggcaaguucagagagaugggagagggaggaaaccacagcaacugccaagcuucuuucacugccuggacacugcaccucuggaaugaagcuccuggaagacuccuuucuaaaaauggggcugcgaaccuuaguuaaggugacauaaugaaacucagaggcagguccuaucaaaaaggugaucuuuuaaaagcugacccucuugucuuucagaaaucuugauuuuguuuucauuucaccccacugcaacuaaaaccauuucauuuccaacauauaacagaagaaugccugagaaauuaaauguuugaauaaaauaugugcaguauuuuaacaccagcaauguaucccgaauuaaccaaucuuauuaauauuucuacacaaucaggaaaccaaauucuuuaguuuucuuugcaacucagugaauauacauuucuguaaagagaaucauuaaagaaauguggcuacuauaacgauacuuaagagaauacguaauccucauaauuagacugaauuacuuuuuauuggguggacauacacacaaaauguaauuaacaucuuauuuucaacuuuuacuaaauaauuaauauuuugacuaaggcuaucauugugugauucucaccacuuucccaaaugcuuaauguuucugaaaguccuguaacugcugcaaagcauucucuugaaaaugcuauuauauuccaucucucaggugacacuuuccuuguauuaugccuaaaaaaugucagagccaauguuucagaaaacagaugauggugacagcgaguuguucaucaaccacaauuucagcgucauaaaguucugucugucaccaacagguuuuauuguuccaagcugggaaaaacauagaaagcagucacaagugguuguagaagcagggauuggaaaaagaagcuaccaaaacgacaguagcuuaaccuuuuauuaucacccuccuuauuaguacagaagacacacuggccuggagcugguacuggguucuauggauagugacagcccugggcacugacucuucguaaaccagugguccccaaggugagcaggaguggguggggaauguucucugguagccaccuuuuuuuuuuuugacauuugcauuauagauuuccccuggagcauaucuugcucaaauuuaaugaugaacucagguuuggaaccaaugaggaccaaggugacuccugcaguguagacuuaaagaaaaagaggacacacuuuugagccaaaggaaggugacgaggagaauauuuuacuuccaguccuugccggucucauagcccaucuagagucuauuuuaguuacagaacguggagcucuuuccccugggaacaacaucuuguuuucucacgaagccaaggccucccuagucagaagccucccuguggguguuuaaauuaucucuuugcaaucacugguguucaaaaaucugggacauuaaacauagacuuaucccagaaaaaucucuguauacacaagagcaggcagagcaaaagcuuccaccaccuggccacacccauuaggccacaauguauacggguuuuaaugaaaagcacacaauuugcccagucgccaaaaaacacccaugaagggaaucccugcaugaaaaauaucccaaacccaacgcgguggauaaagaucuugcuccaagcacauucguucuggcuggcuggggucuagugcucgcuccagugugcuggauguaauaaacaaaauguaaauugaggcggcacaggcaaggagaucaggugcuccggcaggcugcugcacagagugcgcuuugauaaauaacucaggagcuggguaaauaagcacauuuuccccccuuuuuucuuuugagagagagccugcuuuugauuuccccuuucagacucaaaauaugacagguuugggagggaaagaaacacaucacucugucccauggggcagugccauguuugcccuugcauuaaauugagcaaaacagaccccagauccuugcucugaggcugggcaaggaggaggcaagagcugagaugcuccucucuaugggccaugcauacuauuggaaagacugaaggaggagacucauggagcauucagcugaaggucugcucaagugacaguuuauuaauuguaagcagauaaauagaucugauuuccauuucuauuuucuuggcagagucggugcuaucauccugccaauauguucccaaaccugcacccauuuacaaaaaguaaaauuaaaauaaaaaaaaaaaaacuauguagaaaguagguuguauacauccugggaaacugagaugugcugucauaaauuuggagugugacagccuuggcaaagacacucaggcaccuggcaccauggcaggaaggaggccaccccguggugcuauccuuagccauccugaggggcugcuuggggaggauccugugggcugcaggugcuuuuaagaucaccucccucacuuugaaagauaacuuauuuuaccagcaaggaacccaagucugguggcugacuguuacuucuuguuguuuccaagucccugacccuaauuggcuuugguuuacuuuugaccucuuggccgcuucucaggccacagucaguguuccuggcuaaaaagcugcaaaacacacaccucaugcauuaaucaccauauucaaaucagccacugauaggagggaaggggggagcuugcucacuucacugcaaccuuuuccaaaucaaaagucuccugucgcuugacuuggccuaucuggagcaugacagauaacgucaagagaaccaagugcucugugucagacccaaguguauccucagaaggccaggccugcccaagcacuuggagagggcacgcggagaaacucacccuuucugggcccgccuuuccuuccuucauuguuaucauggcacguagcacaaauugaaauggagccacuuucaguggugaucaaucucagggacuacagaggugacauuaacuauacuugcaaacaaaaacaaaaacaaucccaaaucagaaaacuagaaaggcaggagcacccaucagucagggugaccucuggccagcuguggcucgagcugaguuuuagaggcucccuuggugcuaggcaaugaccuuggcacauggagagcaguggaggauccugggggugcucaggggccagggugagucaaaugguggcugcaguuguguacggggagaaggaagcauuucaguauguaaugacccaucagacccuccgcuaggguggugucucuaauuaucauaaaugaugugaaauguuaccgagccauuccagaaugagaaccuucauuugaaaguauaugugcaaguguccucuugggggaaauaggcaauucccugucuauacuuuagaguugaaauggaacaacacagaagaaaauggacucacucuuuuaggaggggccaggguaaaagauggccucagagagagccuguguccagagaagaggucuggggucugcccugagagcccaacuguggcagguggagcucauaucaccuccuucaugaacguuggugccuauaaaaguccuggacucacugaguuccaacagagaacagccccccuccaugccauugcugugaaagcccucccccgucuccugccucucucucucucucaugggaccacacugggucccugccugguguggggccugccgucuggccuaacagagcaaaugacagaugcaucugucagagcaggauuuuaacaaagaacacagagagaucaauuggaaugaaucacggaugguccuccucccuguucuaaaagccuuagcacguuauuacugagaucaucguauauauaugucauagaauuauugaguuuuggaauuggaaggcucuugaaaaauucaguccaaccacuuuaucuaacggcccagaaagacugagccaugugaaucaggccucacggggaggcaggagugggagaggaugaaaacuucaaggugggacuuaucaucucucuugacucugagccuagagccccuaccuuccucccugggauggcaggaaggccaaggacaggauggugccugguagguaucauguugcagagaucagcaggcccuuugacagcugagacccaguacucagauucuggacauaggagcuacugcagcaaaaucaugugcagagaccuagcacagagcuuccucgaggaguccuccacugacuccaggacugacacgcagaaaggaugcaauggugcagguucucuuuguacugggagggcacaggcagacagggccacucugacccgcucuucauccccacccaggagcaucugcuguggcuuuccauuccugagaaccuaacugggccucaugucaaaccaaagaauggcaaggaagaugcaaaagcaaacagugagcuagaagugaagcguggcucgcuggguucugcuucuuucuugccaugcucuccagccacugcagggagucacagcugcuugggaaguaagcaggcuggggugcagcuaaguugucccaacccuggugcaacaagugaaacccuaaugcuacgaggcuaacagagugaugcggacagaccccugccuccuucuaguaggaaaagauucucugagguagaggggagaguggaggguuucuugcaacaggccaaugcaggcuucucguguccauuugaaggaaggaagcagaggccuggagauccuggggcagaaaagcaacugaugcuuugcucaggacugaggcaaggccaccagcaccccauggccuaggacaccucggcacaaagcaagcccgagggcugacggcaggagccagagagagcuucaucucaacgaggagugaggccagauuccuagaggguaguguaaagaugcugggaagauaccaaguuauugucagucauugauuucuugaaggggcuuaucuauaagaauuacaugucacauugguuaaaauuuuaauagagaauuuauucuuacuguucaugauaaaaguaguuggaaaaaauuacuuaauuuacaaauaaacuccuauuaauuucauauacacacacagacccuucacugcuuugagugcaggagcauguuaggcugccaccagguagaucugguuuugaggaggggaauuaacccuuuagaaggcagagucuguaaaacugaauaugguaagugauggcaaaugucacagcaggaugagcuuccuauuugacgcagaaggaacugaggcaacugagggagggaggcaacaccagggagggaggagcuccaagccacguguccacacaacacaagagggugcucuguggauuuuucuuuuugccccacccgugagauuuucuuuccuugccuuuggucuucuaucucuuaauuccugaaaacaguuacuacaaagaguagcaacugcuguccaaggaacagaagccauuaagaucuuaagacaucccaacacugaugaacacggccagugccaugacccaccagggaugcaagauauucacuaugcccccacauccaggcuacucaccaagguuguaccacaugucucugauuucaaagccaaucugucuccucauaucuccguaccuggaaaucagggaaaagaaaaacgcugaaucacuccggaaggcauuugaaaaucggacuggaauuauuuuuaagugcaauuaaagccuucuagcacugaggcaaauaaagagagugucaaagcuucaacuucucuugccaccaaaaugaaucaaaggaggaggaaucuagcugggggaaaucucacuuucucaucacugaggguuacacaacaucuuccccccggugggaacguggaggaacuuguggagagucaugaaagcauuucccuuucuucaaucucuuggcuccugggcccaagggggagcuugguuccaugcaugucguuagcgucuaggcacugcagacaccacauaacauccuacugcacacaacagguugcuuuccaaaguuaaaauuaaauccagagucagggcagaccucuuccaaaguucuugcauuccucuaugucauuuuaaauguaaggaagggcuuaacaccaaaagaugccaacaaaucuuccacuguuuuuguuuaucagggaaaauaaaugcuaauuuuccucucgaugggugcauagaggagguguguguuucaugaguaaacagaauuugaugcuccagaagauaaaccuuuauuaguuugugagcaauuuaacuuuuucuuuuauugccuaaggaaaaagcugauauuaaaaauaauaauuugcaaaauuaucauacaggauuacaguugagcagcugugucaucgagccugcucugcucauccucgugucaggagaugugagaaggaaagcacugauuacagaagagcgcacugugguucuugaggcgaagauccuggccgguaaaucaacaaccgcggccagcugccaccuuauuagagaagacucuggugcccuaagcaccugucugucacucacggcaugagugggcuacagccaagagugaucaucucaaccacagaagaucaaucucaccuggcagcucugcuguggugcgugggaggccaugcgccuuggcccacagugcuggugaagaaaaggaacuggagccuaggccacucccuaccaggacacgcuagcucuaagcgcagcccuaaaccaggugagcacugaugcaggcagacucgguuaaggagggggcaucucagcuggggagacggcccagcauugaggccaugguaggagaggcccguccaugguuggggaaagcacgcaggcagcaaagcuacuggacuugggugggugggagagaggaaagcgcccugcauaacucacgccccccaauugcccaggaaacacacgaccugaacacugcuuggaggcuuguagugcuggcucccccauucccauuuugcuccugcacuaaugacaaagggaucccagcagcugcugcggccagggcugggaaaggaugcaguuggcugcagggugaccuggcaggcugacguccuugcagcauuucccaggggugggacacacagaaagcaaaacuguggugaagcccuguucuaaucuuuccucugagguuggugagguucucgaugugcaggugggugaguccccuuccagccaagcagggguuggacaagcccaggaaaguggcaucagaaagagguggccccccugaacacaaacacccccugcgcccaugucccccagcagaggugaaaugcucacagugggaucggccuagcauguacugacccacucaagcucugcacaugcuucucacaucccagcuacacagaguucuucucauucugggaugauucccucaaaauaggaaggcccaggccaggugcgguggcucacgucuguaaucccagcacuuugggaggccgaggcagguggaucaccugaggucaggaagucaagaccagccuggccaacauggugaaaccccgucuccacuaaaaauacaaaaauuagcugggcgugguggcacaugucuguaaucccagcuacuugggagucugaggcagaagaauugcuugaaccugggcggcggagguuguagcgagcugagaucucgccacugcacuccagccugggcgacagagaaagacucuguaucaagaaaaaaaaacuggccacugcuaggcugaacuucaucagugucugugccuugcuggcccccgacucaguuacuucucucaggucccagaaugauuagaaugauaaugaucccagggaaauccuaaaguucagacauccuaaaguacaugauacucagcugcaguggauuuuccacuugcgguuuggguaauucaggagugacuugcuguguuuccagagcuggcaccacaaucuggauuugggaggccaggugcauccgcuccuccccauccucuuugccccuccccaccccuccccgcuccucuucaccccuccccgaugcuucccaccccuccccaccccuccccgaugcuccccacuucuccccaccccuccccaccccuccccgaugcuccccaccucucccggaugcugcuccuccccaccccuccccgaugcuccccaccccuccccgccucccugcacagugcuucucccuuggguggugaaggaggcugaggggugagggauuuccauucucagauagacuuuacuguccuguagguggaagaugacaguugcugguaguauuugagaacugggggauuagcaaggauacaagagcccaccccucaggagagccgggccugcgggcaucaaggugcuaaagaugcgguuuuaauugucaaauaggacaagggagcagcagcagugaggaagaguggggagcugugaggggaagggccggcuggaggucccuggcagugagagggaucuuuuccuugguuuuaauaagaagggagcuuugaugaaucuauacaugccccagaguaauccccaaauaaagucacagcugucaccagaccucaagggggcuucccaagccauuucuuaguucuucccauggaggaggaaaaaaggauaauugagagcguagggcuaauaaagcuuauugccuggaagcagaaccccgggcugguggcaguccuggggaccauaacuaaguuccucucuagcaauaaacagccaaggggacugcacuagucauacaggagagaagcaaaaugacauggccauccucaccgggaaggagaguagagaauccaaguccucagacucccacacccacagcacgcacccccaggacagggacuuuccaugccuccacagcacgacacagcgucacaucuuucaaagugcuuuccuuucacuugauuuuggaauaagacuaugagcugagcaagcugacauuucugugcccauuuucucaauaagagcugagauucacaguggggaacacacaugcccgacuccaccgagccaggauggccuagagcuggggucaccgugcucugcccagagcuucuuaccugagcccacccacggugugagugagcaggagaaccuacgcuuaggaggcacacuuccuaucguccagggagaucugggaucccacauccaggcuguaacccggacauaaaaucgugugaauuuggucccuguggccuaaucuuagcaccugguuucuugcaccuucacuccaagaaacauacccccgagugauagcucaggcuuggggguaaggccagccugagccugaaucuaagcacaccgggcaauuuacuugaccacucugacccucagucuccucaucuguagugcugccagaauggugcauggugcucaauccuaggcuuuugugaacaacaagagagugaugaugucccugucuaucuggcaagcacuggagccacucuagguccuuccuuuaaaaucucaggcugggcacaauauuccucucaugguugcaauggucauuuagaucgauucauuuagugaacauuuauugagcacuugggccagacacaaagcuaauguggaaauaugaauauucauauuggaauauuaauauuacuaugauauggagaacagacaagacucacaaaccacagugggcuaugagcaugguaggagagacgaacauuaauaaaauaaucacacaagauaaacacggauagauacauagaggaauuguuucugcaaaagccaggaucauggcuuuauagggaaaacaugggaacugugagaaaauguaacagugggcucagcuuggcucuggcaggaguucucuaggacaauaauauuugcucugagauuugaaggagagacgaaaucuggacgaagaggguagggaagagcauucugggcaggaggaccagcaggcgccaaggccccauggcagggagggaguaggggagugccugguggguggggcuacagaacacagagcuggcuccuguuugagagaccagggggugaggggugcaccgugagcagaggcugcaggaggcagguuuuuuuuaaagcguccccgcugccgccacuuuuuuuuuaaguuucauaaacuuuucugacauaaaaaauacauguauuaaccagcacauauauuaauauacaugcauguguauaaaguuuuaugaaaugaugcuuaaccuuacugccugcaaugaaugcugauauuuuuuccuagauucuauuucacugaaaaaagaaaagaaaagucuauuggucaugacuaguguggguuggauugucuccccuuuaaagcuauguugaaguccuaaacccugguauccaugacugugaccuuauuuggaaauagagucuuugcagauguacucaagguaagaugaagucauacuggaguagaguggccucuagauccagugaccucuguccuuauaaggagagggagauugagagacacagacacauaggaagacacaaagaagaaggccacaggaagauggggcagggauuggaguaaaacagccacaagccacggaaugccaaagaccggggcagccaccggaagccaggagagaggcagggaauagcuucucccucagaaccuccagaaggaaccaacacugcccacaccuugauuugggaauucugcccuccauaacugugagacaaucaauucaagccacccgguuuguguucacuguuauggcagaccagccuaggaaauggauaugauggcccuuuaagugaauauucugacccaaucaaagguugagaccugcaguuugaaaaaugcuuuccuaaggaaagagaauagagugugaaggccuaagaccaaggugugcggaacccccaccgccacuugaugcuggggugcagggguaggaaucugacaagagagagcagacaccaaaaagcuuggagaaaagcucaggagaguccugagagcgaagaaaagcauguucugagauggagggaaagaagaaacauguugaggauguggggagaacaucuagggagcugaauacccuccaucugcuugggggcagccaggaccuggcugagguucuggggcaaugcagugcccagagccagcaucggagugggugggagguggggaaaggagacaaggaaagggcugagauggaccuaaaggaagcuggagggagcucauggcuggggugaggcauuuuuaacuucaugggaaagacugguggguuccuaaagaggugagagggggugggacaucaaaaacaacaccaccggugcaugugggacacagugagcuuuucugacuugaaguuggcacaggucaccacuuguuaagucuaacucccugagucuccuucuaauaagugaauuuaauuuugaauaauuucagucucuugaaaaaaaugagcacagacacaaauuaaauugaucguaucuccuguuauaaucaggaauauacaauugcagcuucugauuaggucacgcugcaaaacggcaugcauggcauguuuauuuccuguuaguuuccuuaaagguaguaucuagaguuugacauaaucuucuggagaagauucugcagaacccaguguuuggucagauggggauauuuuggucccauugugaaaccuauccucuuagaacacugcagacuucuauaauuacaaaaaaacaaaaacaaaaacaacccacccaccccgccaaaacugaaaacagccuagggaccagguggggaggucuuuguggauggucucucugcacugagcuggacuuugccaucaaacuuaaccucuugcgcugaaauuuuaagugagcauuuuaugcuuagauaugugggaggcccaauucaugaacccuguuccucuuccgguccugaacacagaagcuccuuugcagucauucaacacacugucccacaccaggaugcacgugucuuacauaacaaaauuaucaagcuggcugcuaaucaaaagucauuccuuuuacauuuuagacauauuuccugcaccccaauaauguaaaaaaggcuagggggcugggaugggaggaagagcugcuggucaggcuuagaauucuguugacaucucuguccuuccuugggagucacuagcaccaaggaugucugaagguugagccaguuaaauuuucauauuauggacuugauuccuagggguuauuuauuuugugguacacuggcgaaucucauacucaauuugggucugacauaaucaguucucugcgugguauggcccauucuuuuauuuacucccaugcacuuuggggaaugucuuuagaaugaaaauccuaauuaucuccccaaccucagucauuaggaggauggagcaggcagguuuccugaugcuggaauuucuauuguuuugagccacaaagcuguggaccaagcagaugugaggagcugcaagggcuuagcaagggggaagggaagggaugggaagggaagggaagggaagggaagggaagggaagggaagggaagggaaggcugagggguuggggaugcucccucagaugccuuagguuggauucacaagcccuagaguaagagacaggccccagauggaggcagugcugagccuacuaagugggugugucauggcuccaccuuuauaccacaugccuuucccccgagaaacagacaggugcaugcaucaagcuccacggggcuccaagucagcgcccaucguuugcccagagugugagguugacucccagaccacgagcccccacaccccgccccaagcuccaagcugcucccuuacacuucgacaacccagaucaugucucugcucauauguagauggcgccaugcccuuuggcacucgaugucccguggcaaaccucucagcugccuucaccacccagccgggaagcccaagcugccaggaggccucugucucccacggcugagccccacgggccgucuccgggcugccaaggcccuccgucaccacugcaugcgugccccacuccacucaugauuuuugcuucuccauuuaccccacuagaccaugaccuucuucgucacgaggucugugucuuuguccccggcaccgggaccauggcccgacugagcacagagugggcacugaaucccuuuuaugcggacaauuuuaaacaaaucacauuucuaggcacuguaugugccugagaaaauuuaagcauugggguaggacaucgucauguauuucuuaugcagguuuugcuauuuagaaauaaaauuugcaaauggacuaugaagggcugaaggcuuaucaaguggcaugaagacuacaacaaauagggcugacccuccacacgugugugccgcguggccugaaggucaaggcagucuuaucucaggcuccgggggcuuuguccuggaucuccugucaccuccacaagcggagcagaacucaugccccuggagaggccccucagacagcacaaagcccugaggcuguccugccagugucuugcaaagacaacuucugaacugccuggggacuuuccugggggaaauccagagucuccuguugcuaucguugugacaaagagaauacgaaagcccuaggcagaggcccuggguggcuccugagggggcgacaccagcuggcuguguguaauuuuccguggcuuugaagauucugaauccacgccacuacgugggaagcaaacguuuucuuuaguagccaaggcccuucgagguuaauguuuuuuuuucuuuucguuuugguuuuugagacagacggucucacucugucagccaggcuggagcgcagucgugugaucauggcucacugcagccccgacccccugggcucaagaaauccucccacuucagccuccugaguagcuggcaccacaggugcgcgccaccacaccuggcuaauuuuuguauuuuuuguggagaaagggguguuguuguguuguccaggcuggucucaaacuccuggacucaagugauccucccaucuuggccuuccaaagugcugggauuacagguaugagccaccgcaccgcuguuagugcaugucuugauguugccuuaggcucuuaacgcucacaccaacagaaggaagggcccagcacacagcugcccugcuggggcuugcggggugcucggccccaccacuaagaagaugccagcucuuuugaggcagauuuccaguuuaaauucaccucucuucucccgcaggcaucuccgaggccaggagcuguggcugggcucgggucccagcuucacccaauagcgggcgcuggacacuugggcagguggcuucaccugcuguggccgagcuguccuuuugcuggacgggacaacaaggggcgcgugcugaaggagguguguccgcaccugguggauuacagugcguugaagugcguugugccgcacugugcuuuguguguguuggucacuaccgucugcacuacaauucccagcacaaaggcaaaucaacaagaacagcaacaauuacaaagcaccaucccucccuuccccugggcccugagggagcgugcauuccacaaagcaggagccugcgccccugcugagccagucuccagaagaugcagccuggagaagucugucucuugaugcuggaagccaggacgagcgacagacaccugugcaggccccaagguggugggcugcagcugcugcgugccgcuucgguagucacaggcgagcacccacucugccuacaccauucucagugcuuggcucagcaagugcauuucuuguuucugaacaaugaucacuguuuacacagauggcugucaggcaggaaucacccagcugaggaggccugaaggaaagauggccaggugaaaggugaucuuuacuuagauaggugcagaccaaaagcucgaagguucuaaaagcagcccaggugaaaaucgugggcccugaaucgccuagauuagaaugcugcuuugccacauucuaggugugggacuggccaaguggcucggucacugugugugaccuuccucaucuagaaacuagggcagauacgagggccuaaggaaugguuuugcuuuuuaaugauuauagaagaaaaaugcacaugaaaugcuuagaaagucacugacauaaaguacaggcugaguaaaugauuugcugaaauauacucaugcuuugcuuaaugacagggauauguucugagaaauaugucacugggugauuuugucgucgugugaacgcugcugagugaacuuacacaaacugagauacuacagccuacuacacacaucggccauacgguauagccuacuguuacuagucuacaaacccguacaacauguuuguaauguaccaugugacuacaauaaauaccacaggcaaauguaacacaauggugaguauuuguguaucuaaacaaagaaaaguuacaguaaaaauacagcauguagucugugguuaugcaguacgugacuauaauucuuucuuucuucucuuuuuuuuugaaagggggucuugccauguugcccaggcuggagugcauggcaauucacagguaugaucguggugcacugcagccuugaccuccugggcucaagugaucuuccugccucagccuccuaaguagcugguauuaccacuacuggcugagcaccagagcccagcuuaugacuauaauucuuacucuccagagaugaugugcuuuggauuugccuugaaagugagauacagacucacaggauauaagagcagcugccaccuucugaaacucuuucuggaaucucuaaccucagcuagcagcauggaguuggccaagccuuagaacagucgagauauugcagagguauuuauaaaaugacaaacagagacugaugacguggcaacaccaaugcaauuucagaacucuucucaaaaggacuuaugaaaggaacaccgacagcagugagaaauuagugaaacggaggcagaaagagacgaagcaagacccuccggguguccaaacaggggaaggaaacccaugcaacaauggugcuucuugauacugagucaugagcggugcaugaugcaaacugggguuacagagcuggaggggccggcaaggaucucggcuuucauggagcuuuggagagguuuauuuacaaugauagaaggugccgcuucaguccauucaaagcuccugcccggaagaagacagggguuaucugcugccaagaaggaaccccgauagcucuaacuccccagugagcuguucaacaaucccaauagagccaagagcuuucaucagaagcuccuuucgaauugaagaauuaagcaauaaagucaaccacaugugaaaugacaucagaauagugcauagcaaaaggaauuaucuccggaagcugaaauucuguguugcacuaauagucuuggauuacacugaccuggaaccuuccaggaugaguccugcaauuuuagaucuugauucauggguuagaaaaggcaauaccugauuggugauuuaaaaccacccuuucauuacaccgugauuacaucucaauuuguaucaaguuggcuuagaaaugacaugaaaauuaugcgauuagaguuggaggcuccugccugcaguuucagagcuagaugagaacuuacuuguuaaggauuuuggcucucuuggcacuugaaaaauucuccaguugcagggacucuugaguaaggaaagcaacagccaggugaaaguaguuguuccacagcugaaaaccaaaaaggaggagaugcuaaguuguugaacagcuugauauaggaucucaacaaugcucucagacauuuaucauuugcucagcacacacuucugaaaaguuaaaaaaaaaacccacacucacucuauacauguugcuaaccagccacccacgguguaauucaggccuuagcgugugggcucagaggucacggugcacauauucaaaucccgggucugccauuuacucagacucuaaccucucucugccucaguuuccucauggauaaaaugugaauuucaagaguaucuaucuuauaggagugcucagaagaucaaagaaguaaauauaugcacagaauuuaaggcgguacagagcauguguaagcacuucaucaauguuagcucuuuuuuauugagauggagucucccucuguugcccaggcuggaaugcaguggcaugaucuuggcucacugcaaccucugccuucuggguucaagcaauucuccugccucagccuccugaguagcugggacuacaggugugcaccaccaugccuggauaauuuuuguauuuuuaguagagaugggguuucaccauguuggccaggcuggucuugaacuccugaccucaagugauccaccucccucagccucccaaagugcugggauuacaagugugagccaccaugccuggccaauguuaacuuuuauuaauguaauuaugaagcuccucacuuaagaauaguauagauuuccauaauuuaggacucuuuacccccaaaucacacauacacuagacaaggaaaacaaauguaaagagaucaaacauuucuucuuucaauaaacccauauuucaaggguuuauggacuacauauaugcgguuuaaaagacaacggccuuuagaagaagaaaguuguaggucucaguuuucucauuuacaaaccagggauaauauguauuauaucaaaggagauagcugcaaagaguucuauaaaaauaaagugugaacauuauauugacucuauuuuuaauuaccugagaaguaaggggaaauuuaagagcauuuguaggauuugagaaaagucuguugggcuugcauuuauccaacacuucccaugaacagcacacuuucuauaguaauacaccagcucauuugaucaccacagaauaaccaaguaggugcuguuauccccauugcagagcugagauuuagagaccagcccaaagcuacagguaacacaugaagcagaaugggggucugagccaggcacccccaaccucagagcccacaauggggcucucuuuuuuuuagcccccuuuauaaagaaaggggagugccagucaauaaaauacaagucguuccuuuuguuuuugggacugacaccucccaccgauuucagccuugccacagcaccggcaggaaucacuggcugcagccaccuguauucugagaaucauggucaggggcucagccagaauaggacccaugccugcgaggacucacaauagaucuucauuucuaccugcucccuuuaacaacaacagcagcagcagcagcagcaacaacaacagcaacagcaacagcagcagcaacaacaacaaaacacgaaugcuucuuuuuaaaugacagcuucaccaacuccuaauucuuucuuuuccuacauaggaccagggcugccuuugagccagagcacucaugguggugacggugguguuuaaauuaagaucugugcuggguacaugcagacaugggucguaugcuagaugggccccugacugugacucucagaaugcagccgacagcaggcagcgauuccugcuaaacccuccucaaacaacaauaaauaugugugucacaccugccaaggggcgacgcucgaugugggcccugaagcacguggcuuguaaggugugcgggcucacggugagaguccaaggggccauccucaugaaacaggacgaaagccagggagaaccaacauguugagaaacaggcucccccaccagagcagccacaacuaaaacacacgggaaucuacccagcaagucaugugugagaccugaccuagaaaaaaaccagaaaaauggcaaaacaaauacuuaaauagucuaguaugagauggggaaaaaaauacugcaaaguauucccucaaauaccauaaacuuacuccaaauuuauuuaucaauucaaugggauuccagcuaaaauccaagcaguauguuuuuaaaagagaaacucagcuaucugauuuuaaacuccaaauggaacaggaaaugcacaaaaacagccaagauaauucugcaguagaaaacgaguggaaaaguagcgacucugcuagcuggguacaaagguauaaggauuaagccucuaggauaauaacacagaaaauggaauuuauacacacauacauuuauaauuauguuaauuguagcauuuccaaucauuggggaaagagucaucuauucaugaaaugacgugggaaaaagugaaguuagauccuuaccccuauacuaacuacagaaaucccaaauggauuaaacaccugaaagauaaaaacaaaaacacaaaaccacacagguauuagcagauccuaacuaacacaaaacaguaaaauuuagaaguauauaauauuaaggcaaggagagauuugccaaguaaaacaugaaaccagauagcuguaaaagaaauaacagauuucacuacagaaaaaugaaauauuucuauaugauaagccuaaacccaugccuagccuauaucaagaauuccaacuuauaaaaaagacagccaaauacgaauguuaggagaagaaaugaucagagaauucacagcagaaacccacauggccacuaaguauucuuagccuaaauaaucaucagaaaaaugacaauaaaaacaaaaaucaaucauuuuaaaucaguguugaagaagauucuagauagaaaguggcugcucucaagguuggugggguggcaaauugcuaaaaucauguuaggaaggaaauugaucauuuuccaucaaacuuaaaaugucauaucauuuggccuagagaucaaccuuuuccauagcaaugcguguacuaagagacacauguaucacagcccucacgguagcacagccugugauuguaaacaccuggaaacagccucuagguuaucagugcagaaauggcugaauaaauguugguacauucauaucguggaauaugacagagcugaaaaacacaggguaugauccaguucauguuaaaggcugaaaaaaaacacacacaggcccauauaaaugcugaaagcgugacaaagaauucagaacaaugaguuaaaaguuaucccugcagaggggcagugagaggcagcaaaggguuaggaaggaauguuuccuauuuuaccugcuaaacugauauucagcacauauauauuguauaaagagaaaguauguuauuaugacauaugaaaacaggcauucagcagagaaaaugauaaaaaauuuuauaaacaaguaacauguuuagauauauggcaccugauauauuauuaucuaauuauauccuguaaugccaauacaacaaacacuuaaaauuaaaaaauuauaaaaauaagggcaaugcaaaugaaagagcauuggguaaacuuauuauuugcuauuggguaacuuauuuugggguuggaucacccaaugggugaacaaaaauccuucggguuccuuuugagagagugaaucaucuugcccaggaaauaaacaugccauuuguaucugcaugcuuuucaaaaauuuguauacuuuacuaaaauaaacuaaguaauaauaaugacagauaaaaucauuauuagcagaaacacauccagaguacaauggaagugagagccacacauuuuggaugcacaguaagaaaucaggccaggcaaaaucaauccuuacagcaugcacacacacacacacacacacacacacacacacacacacaaaucaggccaggcaaaaucaauccuuacagcaugcaugcgcgcgcgcacacacacacacacacacacacaaacacacacacucucucucucucucacacacugcauucaccaaaggagcauuucugaggaccauggggucuggggggcagggucucuggccugguaaaagccacugcuaguagcacaaggccgagagaggauauggagggaacacagaguuauaaaagcaagcugagcucgaggugcagaccugggucuccuccucugcugauccucccuccacaguaagaugggcugagacaaucuuggcagauacacacaccgggacuugguggccucccugcuugaagagucccuucuugucacucugauucaauagcuucucucugaaacaacucuaucucuuuccuugcuaaauuaagcgaauacuccaaaaguauaauuuucacuccucagguuccaauaguacauacuacaaauuccguuuccgcaucuuggaugggagaccaauuaaguucaaggauuagaaauacuguaagauacuggcucggaccagcaauuuguuuuaacaugauuucuccacaaaggucgugucuaccucuucucuuaccuguagcucaaaguuggcuugauccagaaauuuuuuguucagcauaucugcauacugauuaauugcucgcaggaagacucugaaagaucaagagaaaauuacauaauuacacacuuacgcucuggcacuucgguagguuuggcauuucaauuagauacaaucccagacugucuggaaugugaacucuccaagucuugcgcaaagcugugagguuuugccaacgaaaagaucacggaauuauaugcagauguucuccaaauuaaucaaggaaauuagcacaugcaggaugaaagaaacagaccaaaauaacagcuucugaaaguaacauuugaaaaguaugacuuaaaacaaaaucuaauuaaaaaaaagaaaaaaaaaggugcaaauuaaaucguuuucucaaguugccaugucuuaauguucuaugauuccacugaucuuugcuuagcuggcuuuuucaagcuacccaguugaaagcacucuucgcaaggagcugucaggcuuggaagagguugcugcaauaucuccaggcuuggaagcauggcuuacgacuucaguaucauuggccuacuuuccacaugcuaauuuugaccacuauuuuacuagagaagaaguuaaaagcuuuaguagacaugaaagugauuugacaagaauuuucucagaaauuuuaauuucuugauucauugauaaaguauaauuuuaacacucuauaauaccaugacuuuauauacuuuuuguaaugaaauauacaauuugggcgaucacacgugacucuagaauaccaacucucacaugcuuguucauucaacagauuuguuuuauaacgcuugaaagugcuuacaauacuaaagcuucguccacuacuuuuuaaauggcccuuuucccuuugcacaaaggcaggauguaagaggaauuaguauuaggucacagaugauaaaccuaauuccacuuucucuauuuagacagcaaggagcagccagaguagaagggaaauguagguuacuuacuaguaacugcuguccucugacagcauuaucucuucagccaagcgugccuggagaagcuccccacgcccuggccaugucacagccgcuaaaaggcagugagccagggaggagggaagaagaaauucaccaccugggguuuuaaggaggucuccaucgccaccugccaccaccaccucccgcccaucacccgcugucacugcagauucucucacgcucacacugcgugccgcucugagaaagggauucgcagacauuauuucaucaagaaaccuaucggcuagcucugggaccaaaacagcugugacaaagggccugugacagaguuugcaauuuuggucacuaaagaaaacugcagguggaguuauuugacuucuuccccggggacauuaaaauauaaccagaaaggaggaauuaguguuucuaagugacuauuaauggagggacgcaggcauugcugccuuguccauuaaccaagaacacaggcugggcagcaacauuccucagccgcaggguugccagauuuugcaaauauaggaugcccaguuaaauuugaauaaagcucuuauugcugaauucuguaauugauuagaaaaaaaaagcggaauacaggacauuuagagcauccugacaaauuaauaaaggauccaggacaaaaguugcaaaauucaggacaugcuuugcauauacgggaugccuggcaacucuaaucagccccccagucuugggauggggucuguccugucaccuucagcccccagaaguacaaaguaugagcuagagagauggucuaaguaacccaccugacccuugguaacuguguugagagagccucugaggauguacaugcagcaaccccagagaucacagaaaagcccccaagugucaguggaauacaacaccuucuugucauuacagggugggcugugccgugaugcauaaggacacggggcuucugaccacuaacacaauuuuuuuuccccuuaauuuuuuccuucagguuuagaacucugcuauuugcagaguacccuaggguccuuaugagcuuuaagaagacacucuuuccagcccucuaugacaauaaugaccaguuuacuaaaacacacauuauuauuauaggguaauuauugugccucaagauagcacccaaacaguugcaauaugcugcuucgaauuaagcucugggacaacugcagcuaguuaaauaaagacaguucucaaaaugacuuaaagaaauaugucagcugggcgcgguggcucacgccuguaaucccagcacuuugggaggccaaggugggugaaucacgaggucaggagauugagaccauccuggcuaacacagugaaaccccguuucuacuaaaaauacaaaaaauuagcugggugugguggcgggcaccugcagucccagcuacuugggaggcugaggcaggagaauggugcgaaccugggaggcggagcuugcagugagccaggauugcgccacugcacuccagccugggugacagagugagacuugucucaaauuaaaaaaaaaaaaaaaaaacuauguaugucaugcuaaaauaaugugaaggcugaacaaaaaccuuuuaagaaacugacgacugagaaagugcagggcugagagguagauucuguaauucagauucccuauaaauuuuuuuaaaugccgggacaaaaacaacguggaaauucaaguagcaugaggaaagcugaaggaaagaucaaauaaaaccauaaucagugcaguaaacaaagaucagaugaugcuugggcucaaugcaucaagggcugcgucacuugcacagaaacuuccaggacaugcauaaaugauauccuacagcccacaccugacgggacggaaacacagcuaugccccgggccaaucacccaaugaggcaaggagaaacauaaccagagacuaacuuuuagguaagaaaaucuauuagucggccgaguguggugugggaggcugaggcgggcagaucaccugaggucaggaguucaagaccagccuggccaacauggugaaaccccgucuguacuaaaaaaaaaaaauuacaggcugggcaugguggcucacaccuguaaucccagcacuuugggaggccaaggcaggcggaucacaaggucaggagaucgaaaccauccuggcuaacauggugaaaccccgucucuacuaaaaaauacaaaaaaauuagccgggcauggugguaggugcccguagucccagcuacucgggaggcugaggcaggagaauggcaugaaccugggagguggagcuugcaaugagccgagauugcaccacugcacuccagccuaggcgacagagugagacuccaucucaagaaaaaaaaaaaaaaauuagcugggccugguggugugcaccuguaaucccagcuacucaggaggcugaggcaggagaaucacuggaacccgggaggcagagguugcagugagccgagacugcaccacugcacuccagccugggugacagagcaagacuccaucucaaaaaaaaaaaaaaucuauuaguuacuguaauucauaaguuauuucuaauaaaugugaaaguagggaaaauaagaaaaucauauuagaagcuuuugcauaccaauccgcuuucuguuacagaggaauaugagaaggauugcaagcuaagccaaguguuuggaugggaggaugccuugccaaaugaaaugaggggcuccacacagugcaggaucauaguccuuugcccagcaggcaauucgagggcgugugggguaugaaugcgccugacucugcauccugacaacucuaucugugcuggacacugcuggaguuggguuuagguaagagaagcccuccagauugugaguaaagcauagguaucucgaaggcaguggcaacaccugcuuguucaccuaaguguccucagugccaagucagcauuugguacacaguauaugcucacuagguaacugacacaggaaugaaugaauaaguggauggaagaguaagugaaugaaugaauggaugaaagagcuggcucagaaggucaggcucuggcccaaaugagaggccucagggaggcuagaguauuugguugccccuggcucucccugaguccuugcagaaaaccguguagguuuucugcggugggauucagcucucuucagguucuucuuaugcaaacuucucauuagggauuccaccagaaaugccagaaacucagggggaagggaucaaccaccuugugaaccacacaaauuaugucuuauucugagccaggagaauuaauuaauuaauuucuaaaaaacaauaacaaaugcugugagaauuaaaugcuuucaggaaugcuguccuaaaaauggucaaaaucuaaggaaggauuauuuguaaucuaaaauucaggagauaaaaccaaacauacaaauaaauaauccagaaagaaucacaggcaaauuaugucaaccuaaaaagauucaaaaagccguaaggucuagaagccugugaauuuuauuuuuaauggcucaauggagagaaauguuaucucuucuugguaauugauuccugucuccagaaagucagaagcaucauuuuuaucaaacuugucauaacauuauccacuuaaaaaaaugugaggucaauaagaaagggagauggguucacucccaagccaaugcaauuaaagcaacaacaaaccaguaagcuuuccuauccuggacauuuaaccccauuagcaacaaaaacuacuaauucuugacagugucaaauaugaguuuaauuguagccuacacauacacacauuuguacaauuaaagucuuaauucaaguaugucuaucuaucuaucaauggcuucauguccauuuaaacguggagcuaccugaccuucggaacguuguucaacaccaccaagaaaugagaaguaugugagggaacagacauguuaauucauuugauuuaaucauuccacaaugaaugcauguaucacaacaucgacugcauaccauacacauacacaauuauuauuugucaauuuacaauagaauuuuaaaaauguuaaaacaaaaaaaauguugcucaaguuuucgagacccucaucuucuccacugacaaaugaaagcacucaaccccagugccucuaagcucccuggaacuuugaaccuacagguuuuguuuuuuuauuuuugagauuaaagguaaggaagaggcaucaccacaugauacaaaguuaucugaacacugauaugaucuccacugacaccuuacaaaauguaaagucgcauuugguaaaagagaaagacaagcccugugaauucugcaguucugcgcgucuuugggagacaggcugguguggccggcgaggcucugccugcaggaggcaccugccaagguccaagccucucugcagcaugaagguucuggaggaggucccgccagccuugcuuuuguucuugaacaaaaagggcggguggauggaugcagugcgugggcuccagagggagaucaucccccaaagcugccuauuuggaaagccaugugccaguaacaaaaguagcauaguccuaaauaauuauauguuaauugagcugaggggaacuuagcgagugaaaaguaaucaggaaccaauuuaacuauuccaggcuccuggcacaauuauaggcccuugcuuaugacagacccucaggcccuucuagcaccccuguuacccaguguuugcugccaauaaaacagaaagaugaggagccucauuacuacagagggagaauguggagaaaggcagggaacuuccaggggcuugcacagccccauuucucacauugugaagcuguggggguauuuaaauuccuucccuaaacuuacuuuaaguuacauaauuagcuuguacacuucaauaugagggcauuuaaaucccuugggcaugaagacaggcugcuuuggggguggagacgauguaucuuuuaacacaauguuuuacccaaaaugggugggaaaaaaggaaacaaauuaaaagugacacauuccuccaucccugcagaaaaaugagucuagcaacacauuccuccaucccugcagaaaaaugagucuagcaacaguagcugggaauuugccuucaaaugauuucugcauaauucagggaugcugggaagaggcaaguugaggugaagugauaauagagaugcagagaaugucacuucaguuccaugggaaggagagauaaugaaugcuucaucucagccgcuccgucuccuggcaccuccccacacuuggcaggguggcuccuucauccagguggugacucacauggccagaaacuuccuaccuugggaccuugacugggaaacaaaaaccauauauguggaaagaagugacuucuaagaacgucccccaguaucacaagggcaaaguaaugcaaagcugggggacugggugggaucugccucgugucuuugggauuugggaaacggugggaagaccaaugucacuagaaaguuuucggaaugaggugagagagaucaacugggccagaccgugagagacggggauguggggcucuggagucugcauauuugcuugugggcaacagggguggagggggugccugaggauuuuaaagcgaggaagggaccucuggggucaggagcagggaagccaaaagauuucauugcuauuauuuccugucugcacuacagcgaguuacuuuuuuccaagauucccuuucuuuucuuuuucaaaucaauaaaagcuuaagccuccaucaaacucuuaacuaaaaccuaaaaugccccagaccuuucuucuggucagcccugcuggacacaggcuugggcugugaugccaacaagaauacagaggauucccagggugcgucugcucuagccugaggccgugucauccccacuugggucuccaugagccgagauuacugggcccuugucuaccagucugaugccuaauaaacagagugacgugcuggaugcauaccaucccaguuuccaccaaaacagcauuccuggccaaggaauugucgugggccaaagguaagaaauccugaaaguaggcaguucccagccaccgguuccuccauccucucccacacgaccaccucuaguuucugcugcuuugcugcuaggcauuuggugagcacccccuaaguuccagacacugucauugcuuucacacagaucauguuauuucaugcucacaagucuugcgggguaugaaucacacaauauuuuacaaaugaggaaauggaggcuuugggaugcauaugccacaucguguauaccacccauuuaucuguugauggacacuugaguacuucuaccuuuucgcaacugugaaaaauguugcuaugaacaucaguguacagaucucucuucaaguccuuauguucaauuauuuuggauaaauauugagaaauaaaaauaaaauccuaaguuucccaauggacugaacagacuccuucuuggccaaagggaccccagagaagacuuaaaaacugaauccgggccgggcgccguggcucacgccuguaaucccagcacuuugggaggccaagguggguggaucaccagaggccaggaguucaagaccaaucuggccaacauggugaaaccccaucucuacuaaaaauacaaaaauuacccgggcaugguggcaggcgucuguaaucccaacuacucgggaggcugaagcaggagaaucgcuugaaccugggaggcagaaguugcagagagcuggaucgcgccgcugcacuccagccuggguaacaagagcaagacucugucuaaaaacaacaacaaaaaaaaacaaaaacaacaacaacaacaaaaacugagucagcccaugaccaugaagagaugggagguuggacccgcuucaguauacccuuuccuuaauagccuuuaaccagaauucucuccuaaggaggaagcagaaacuggcucuagaaaacaagaagcagacaacucauuccuauaucaccuuuagccacuugucugagccauaaguggacucccccucccucuuugcaguuuccacgugacagcuugccaguuugacacugcaugcccuccugcugagaggcuaccaacugcaggguggcucuggccagucgaaggaggaugugcagugaggguuuucguggccucuguuugaacuuuugacaucagagggccaaaaccuccacccuugggucauccuaaugcugguauuuuuuugaacacgggacccacgaagaggcauggcucaaucacacauguguguguuucuccuucauuaauauucaugacuucuucuauagcuuauugauuauguauacuuagccaacccacucagcauaaauuccugucucauuccuccucccuggaagugcuugcucuuggcagaagcuggaggcuacgcuuccuggucugcggaauggcuggccugcaggcugcaacccuuuaugagaaauaaagcucugcuuuccaaauuuauguaccuuaugauucuucaguugaugauacccagaaguggaauugccagaucaucugguaauucuauuuuaaaguuuuagaggaaccauccuacuauuuuccauaguggcugugccauuuuacauucccagcaacaguacacaaggguuccaauuucuccacacccucaucaacacuuguuauuucccuguuuuuuuuuuuuucugauguagccauccuaaucggugugaggugguuuaaauaaaguuuuauuagaacacagcaaaacucuuuuaguagggauuagccagccauuuccccacuacacuagcagugcugaguaggugugccuguguugguucuuuaaagaaaauuuugccaaggccugaaaaguugugauucaauucugauauguccucucuacaaauuuugaagaguucuucaucuacuuucuuuugguggggagucggagaguucacaccuguuucuaggucaucagaaaauaaaauguguugauugaaaagaccuuaaaaugcucccuccaaagcuuggagccgauuagccacuaggagccccaacgcggaguuagcaaguguuaggauaaaccagucuggaaaucaagcuuagagacaauuagccacuaagagcccuaacguggaguuagcaaguguugggauaaaccagucuggaaaucaagguaggcagguacccucagcuucaccuccagagcaccaagccugucaucacuaacagucuaauuucaggauuguguuuucaauaucauaaggccacccacucucccucuacucuccacuacuugguccuucuuauucgccucuaccuccucccaauccugccucguccaccuauuucaacuucacaaaauaaauguugacggauuuagcagcagcuuggguaaugaaaaaaccaucuccaagacaaacacaucagaaauguccagcagcgaacaucaggaagugagaagucucuacugcugggggaggccgcgagagagggcaaagccugacuguaagacuccaucccggcaaauaaagaagggucuugggucgccccagaguccccgccccagcaccccagugucugcucgccccagcaccccagugucugcucaccccagagaccucugccccagcaccccaguguccguucaccccagggauccccaccacagcaccccagagacccugcccuagcaccccagugucugcucaccccagagaccuccgccucagcaccccaguguccaucccucaggccuccuccuuccucucccaggcuccuccuguuguccuaugaucacuaauugggugagugaaggacagccauggaugggcaggggaagcaggggaggucagggugaccgugccccaccccucgggcacaggacagguuguccuggaugcucugcuugccgggguguaggaaugugugucaucagcugccacuggagucuuuuccuaguuccauauacaugggggaugggaacagggaguugagaguuucugcuuggggugaacaaacauucuggaaaucaacaguagugauaacugagcaacacuguggauguaauuaugccauugaaugauacacuuauaaacgguuaaauggcaaacuuuguaauguauguauuuuuucuuuucuauugugguuacauauauauaauauuuauuuauauauauaaaaucacaauaaaaaagaaaaaacacaagaaggaaagagggcauguuucagaaacugcaggcaugggacucauaauuuuucuguucauaucuguaccauuggugugacucaguuucaugauuaaaaaauaaaucaaaacaacccgggaauaagaaucucuaaccuucacuucccagagaaccagaucucucuggaaguagguggggcauuaauaaacaagcauaaacaaacacacacccagacgcccaaucacgacaaccagagaccucgccucccugccaucccugccaucccucucgucccugccgucccucgcaucccugccgucccuggcgucccugccguccuugcugucccuggcgucccugccaucccuggcaagccucugaucaccaaacaccacccaggacagaggucccugcaggcaauggccccuggucuacaacaauacagugaggguccaucugugcagaaucuuuauuccccacagcauccagcaacgcauccuuacaaaaacaguguaaaugaauccuagucagcccagaaaaaaaggaaguagucagaggccuugagcaaaccauacgguucaaggcagaaaugcuuaagagaaaauaggauccuuacaaaagagaaugcugcuuucaagguauuucacgcucagcauacaccagugaugcuuaaaauuuauccggguucauuuucaagaccugcuauggacacugcaaucauuuagcaugcucaugucauuugcugaaggcucauuugccauaggcugaaaacugagaccgauuuuuuuuuuuuuuuuuuuuuuugcccauuuguaggagccuaggugcuugcuaccuggcagguggugacguuguccacauuuucccauucucacuggugcuuggcaacuucuacucacuacgcauuuaguuucacucaagccaggccuggugggucucucuauguggggugugcccuuggagaagagcuacaggaaacacacaaagaaaugaagaacuagaaagagcaggagccucaaggucauaagugaucuauaagugacaggucauauugauucauguccugucacuuauaggcugugcaaccuuccucaaguuaauaacagcucugaacucauuuuccuuauugaggucuugagaagaaggagauuagaagccucagugucuauagagaggcuggguccuaccagcuguucaauaauugguagcuacuguugaaagcaugguaaagauacaagagauggcggcuucugucauuuucuuugcuauguguuuccaaagaggucuccgaaggaucuucucagcuugcagugggcaaaguuuaguggugaaacuuuuuuacggagaaaguuucaguggugugaauagaagauccaaccagccacaacauucccucaagccaaagccuaacugagagcaaggcccuaaacucuguucaauucugggaaggcugagagaggugaggaagcugcaggggaaaaguuugaagcuaccagagguugauucuuaaggaaagaagccaucuccauaacauaaaagugcaaggugaacagaaagugcugauggagaagcugcagcaaguucuccagaagaccuaggauagaccauugaugaggguggcuacacuaaaaagcagacuuucaauguaaaugaaaccaccuuauauuggaauaugucaucuaggacuuucauauuuagggagaagaagucaauuccuggcuucaaaacuucaaaggacaggcugacucuauagccgggggcuaaggcagcuggcgacuuuaaguugaagccaaugcuuauuuguuauucugaacauccuagcgcccuuaagaauuaugcuaaaucuacucugcauaugcucuauaaaugcaagaagagagccuggaugacagcacaucuguuuggagcaugguuuacugaauguuuuaagcccacuguuaagaccugauacucagaaacaagaugccuuucaaaaauauuacugcucauugacaaugcaccuggucaacccagagcucugauggagauguacaaggaggugaauguuguuuucaugccugcuaacacaacauccauuccacaguccauuaaucacgagcaauuuugacuuucaagucuuauuauuuaagaaauauauuuuauaaggcuauagcugccagagauagugauuucucuaauggaucugaccaaaguaaauugaaaacuuucuggaaaaaauucagcauucuaaaagccauuuagaagagucaugauucaugggaggaggucaaaauaucaacauuaacuggaguuuggaagaaguggauucugaucuucaugguugacuuugaccgguucaagacuucagaggaagaaguaaauucagauguaguggaaauagcagagaacuagaauuagaaguggacucugaagaugugacugaauugcugcaaucucaugauacaacuuggauggauaaggaguucccacucaugcuugugagcaaagaaagugguuucuugagaugaaucuacuccuggugaagauucugauaacauuguugaaaugacaaaggauuuagaauauuacauaaaguuaguugccaaagcaguuggccgaguuugagaagauugacucccaugugaaaagaaguuuuaguguguguaaaaugcuaccaaacagcaucacaggcuacagagaaaucuugagugaaaggaagcaucaaaugauguggcaaauuucacuguugccuuauuuuaaaaaacugucauagccaccucagcccucagcaaccaccauccugaucagucagcagccaucaacauugacgcaagacucucuaucagcagaaagauuuagauuugcugaagccucagauaauuguuagcauuguuuaacaauaaaguauuucuauuaagguauauacacuguuuuuuuaagacauacuuuucacacuuaauaaaauacuuuauaguguaaacauaacauauaugcacugggaaaccaaaaaaucugugugacuugcuuuauugcaaacuucacuuuuucgugguggucugguagggaacccacaauaucuugaauauauagcuuugacugaacauucaaagaguuaagauauaaucaccuacccuaagccuaagaacaguuuucacuacuuuguccucguaaacgaauuacucauuucccauuuuguaguuaaaaucugcugccuuuucauaucaagaccaucuggucuuuauucuuuccuggacauacaggaguucggcuaucaagaaacccugagcguccuccuuaacaaaagcccaggcuugagauuuggaaggcuggauucaagcuuugguugguguucagaagcagguuaauauggugguuaaagcagggacuccaggaauaaacacccagagaugaaauccaggcuguaccacugaccaguuggcuguguaaacacugagcagauuuccuuagauucugcaucugugaaaugggugucaagagcacaucagccuccuaggugguaaccauuaaauaagcucacauugcauagagugcccagaacaguuccugacacacaguuagcaaaacgaaagacuuaggaagucugcaaauaacucucaaguacucaaacagcgagugccagcuuaaaggaugugcuacaagcuugucaguugcuugccaaucuuuaaucagaaaaccccauuccaugagagugaccugggugggugcuucggcuauucuuaucuugaucaaaagcagaaaccacagaauaauaauaguuagaaauuauuuucuguugugagcuucguguuuucuuaaugaguguaaugauuaagagaaauggguucuccuuguugaauuccacaccaugcaagguauguggaugagcuaaaauguuucagggacucucccgggcugugcguggauuggauguguguguguaggaagcccaguguugaaggacagugcccaacgcuggacccuguguucuaguggcaagaagcugugggucuggaggaugcugguucccuaagaugacuauccaugcaaauugaaucuugccuccagaauacuuucucauuugcuucugaugaaucauuuaucaaggcucaggcagagcaccucaaaugacagggaaggggguuuuaugaagccuaagaacagacaguaugcacugauugugcaaaacuauuuuucauaaaugucuguguguguggcugacuuugaucuaagacuuucuuugauuauaaccugguagcaaaguggugagauaacaguuaacuuacacccaagucuagugaugaccaacucacaguaucuuuuaaaaaaaaaaccgaaauauugccuuugcucagcucccaacgguggggcucucccccaagagaggcgugacugggugcuggaugagaccucagccgccacaucugcaaaauggguuuagaaagaaagcugcccugagaugacauguacauggguccccaguccugcccagaagccccagugagagccaaagggguuuggagacccagaggcugucuucuccaucugcccugcaagaaaucuacuuuccaggcauuucugauuucuauuauugacagaauucuuuaacgaaugccugacuaauggcaagccugagaugacaggcaggugacgguuaaggccacuucauguuucccaggagacguggcuggugcugauugucaacugaauuugagacgggugaucuuugcucagcccaucucuugcuguuugacacuugagguccaggguggaagacaucagaagcggauucucccccaccgugggcuccugcgccagcaucuaccucacacuucuucuccauggccuugagaguaucuuuguuuccugcuguuccuucauccugggaccacucacagcugagcuggcagagccaccgcucccccuccucaagaaccaagaaccagcucuguaugcagcauccugcuccacugccugcucucccaggaggaugaagcagugcagggccuuacuccacaggaggcuuuggcaaccacacagcagugagggaagcacugaacaccagcucagaugccaaaugcagcacaggggaggagcaggcuuccuguucuucccaugaaggagaagggggcucgcauugaucaagcagcucuaacaugcuaccugcugagccaggagcucagaaaugcccucucaauuacucuccccaauuugcugguggcaacaaagaauccaugagguucaccacuugcccagguuacucagcucguagguggcagaacucaaagaagcaggcaugugacugccuguccuucugugcaccccacggaucaguggccauguggucuggggaagcgggaugcugaaacccagacucaucacccacagagggaagaccccacagaucuacucgagugccugguguuacacaaaaguacccuuuguggauaacgaccuuuggcuuuuagaagauacaucagagaaacugcaauuuaaguggcccgccuuugccucagcacaauuggcugaaaggaaccacaagcacuuugcucagccaccaaaaauauacacaggagagacguccccaccggacaggacauaucugagaggcuggagggaggcauggugcaagacacacaccagcaccacccuuaggcaaaucaguaaacucaccaggcagggcggccacggggaagauaaugucuccugugacucuggucugauguuugcgccuuaccccucauuuuuauguggaaguccucacccacgagguccucacccagcagagagggaagcgaugaacaccagcucggaugccagaugcaccacaggggaggggcaggcuucccauucuucccaugauggagaagggagcucgcauugaucgagcauugaucaaucauccagaacuugugaaacagacuggggagcacaaggggaagcacacgcuauccucuacagcaugcuuucuacacaguauguucucagguuacaucagagugauugauuauugauuauugauugcagucugugaauaagaugugcccauucuuaacagugcacuuuccauucuugacagucuagucaagggaucaguacacuucuucuguaaaugaucagacaguaaagaagucaggccuugcaggccauauggucucuucugcauucacuaauagacucugcuauuauaacagcgcaaaagcagccacugacaauacaaaaagugaauggguaugacuaugugccaauaaaacuuuauguauagacagcaaaauuuaaauucauauaauuuucaucuguuauaaaauaguauucuugccuuuuuucaauccuuuaaaaacauaaaaucuauuccuagcuugugggacacacacaugcauacacacuacagauggagggcuggauugggucaucaguuacagcuugucaaccccugguuuagaaaauuaugugugugccagcugggugcaguggcucauuccuguaauccagcacuuugggaggcugagaugggugguucacuugaggucaggaguuugagaucagccuggcuaacauggggaaaccccaucacuacuaaaaauacaaaaauuauccaggcaugguggcacaugcuuguaaucccagcuacuuaggaggcuaaggcgggaggaucacuugaacccuggaaacagagguugcagugagccgagaucacaccacugcacucuagccugggcagcagaguaagacucugucuccaggaaaaaaaaaaaaaaaagggaaauuauaaaauuaugugugugccaaucugccauggccuaucauucuugcucauuauucauucucuuuuuuuuucuuuuucugagacagagucucgcucugucucccauacuagagugcaguggcaugaucucggcucacugcaacuuccaccuccugaguucaagugauccucgugccucagccucccaaguaacugggauuacaagugugugccaccacaucuggcugauuuuuguauuuuuuguagggacaggguuucaccauguugaccaggauggucuuguaccccugaccucaggugauuggcccgccuuggccucccaaagugcugggauuacaggugugagccacugcgcccagccucuugcucauucacucuuuaaggagaaggagcauccaggucaugucuggaacugaccuggucuagaaagggugacaaaguaaauuuagcaggggcggcggggggagggguuuggcugaagggaaggacgcugcagagguaacugggugucuaccucaugcagaagguuggggagccauccacagccauggggaguggguucagagcaccuccuuggggauaggagggaccugugcucagccuuggggacccaggugaaaguggggucugggaucaggugaaggucaagaguugaagguacauuuuguacucaaucucaguccacuuauaaagaaauccuuggaaaucaaugagagagcacugaagagagauuuuagaauaagaaccuaaaaaagaaggcugagaaaagagccuuggagaaugccaguauuucuuccgggcagaagaaaaaaaaaaugagcuagagagagagcgagagaagggaggauagaggaaggaaagaagggaggaagggagggaagagaggagaggggaggggaggauagggccgaggggaggagaggggaggagagagagggggaggacggggaggggaggggaggagaggagagggagagagauagagcgagagggagagaaggaaugagacaugccagagggaaacagcgcaagacgcggggucauggaagcuacuggacaagagcacuuaacagcaagggcgccaucaacagugucugagacuggggagggcgguaaugugggcuuauugaugaggacaccauugauaacugcaguagaacagauuucauuagccucauggggagaugaagagugagugaaggcuggggaccuaggggaccacucuguguggucuggcugugaaggacaaaacagagguguccacagugagggugagggugaggucaagggagcuucccugcaguagaagaaucuggaggugaagggacaaucgacaaggaaggcuccagaggacguagacagaugacucggagccccagauccaggguuuccugggggcaaauccauucuacaccugccacaccuagugcuuaauaaauauuucuagaacaagcaagugccuaagugaauggcaucguggccagauuuuaaacugaggaucugccaccuuacuaccauuguuauucuugucucugucucuucucuccccaugucuaguuucaggcucgccacugucccugggacaccucugcucacuccauccgccuugagcccauuccucacacugcuguuggguuuacagcccccaccugccuuccccagcucugaccucuuuccgggcucuccauccuggugcacggugucugauuggaugcuauaaaaccugacagguucccagccacguggccgcgcucaagggagcccugggcaucucauucuacuuacgcaaggacuuacgcaacugcuccuuggcugcauuggccccugcguguuggcggccccugccuacccagccagccacuggaaagacuugaaauagauuuuuaaaccagcuccacaucugccucugcuuuuccugccagauuccuuuucuuuuuuuuuaaugaccccuuuauuucuuccaugcucuugucuuaaucauaaagaggugagucaaaggucagugucugcaaggccaggccccagaagcuucugcucuuagacggcuacugggacugagaggaagaaaaggaaaaaaccuaaugaguuauugugggcaccgaugagugcacaagggcucuggcuucuaacuuguugacugcucugcuacgacagcccacgaggcagauuccauggccuauauaauaugaugaucaugguuccuccaccucauggguugcuuuaagaugaaaugcgaucccagacaaguggaccacuggacaaaggcuagccagcgucuugcccucgcccucugcccaucacuggcaagcaacuccuaggucaugccagaagcacgcauggagcaaagaccaaagucugucuguagcagagcucagguuaaacacaauuaguaaggcagagccgagcagacacguggccacaugaugcucugcuuucagacagggcacggguggcccaaaagccacuuucacacuugacugugaauaugggcuuuccauggcccacaggggauggaauucagguuuuccuuguuccgucuaguaaaucguauucaccaauauaacaguuccacuuuccauguaacuccacauuuuaccacccgaauauggccacagugauggugugcauugacuuugcuauuaacaggaggcaacugagugaucaugggcuaaugaucgucuaccuucuuaaugcuaagugauuuauuacccauaaacacaugcgggaagugcucugggaagcucccgcccgccgaacacaugcaaguuaagcuucuuaauugaaaauauaaucuguauugcagagauuaaaauauauuggauucauuuuggcucaauucuuccccauugucccacauacauuuucuuuaugcuacacaauccaauuaguuccccugcuacggaaauuauuucaacacaauaaaucaauuuuauagugaagcuaugacugaauauccuauuuaaaagaaaagcaaaucagggauggaaacaguuuucuuacugaugugaucaguauuugcaccacgcgccuuuggugaucucucuugguuuuauccuuucugauuucuucguuuucuuuucuucuccuuuguuguccuuggggaaggcaaucaguuuugugugguagagaggaggcaaggaggcagaucccugccauuagggugucagagcaagucacagaggggacccuuuggcaaggcuggcuucaucauuccagucucuggucaagggacagccccagcacccacacuccaaagccuuucccagaccucccugcccacagcaaugcagccuuucaggccccucuggccccuuguuaaacuguaucuauuucuauucauaacacucauagucucugacauugcagggcccaguuauagguuugcuggauuacuaucugagccccugccuaaguagaaggcaaacuccacgaaggcagaggcuuggucaggcuuauucagcacgacauccccagcauuuaaaauaguccuggcgcaaaaguccacacauaaucaaaacaccuuacacaaugagaccacacugccaugccacacccaaagcauucgugagcuucacucucacugcaggaggcucagggagggaaagcagucaucagaguggccuugaggcccggacacaugcuuguaggaugaacccagugcugggcccccauccuugcacaugcugcugccucuccccaggaggcuacugccuccugcacacaugguuaaguccuuccaaugucacagcucccagccaucccagcccuacucgucuccucacacacucuuagagaaccgugugccucuccuucagugugcugggaucacaccugucaucucauuuggcugcucaagcaauguccagugugccuccucuccacccccaacuucucagcucccagaaaacaggcuccacaccugugcuggcucacacaguucccgucuucuagcacucugcccagcccuuagcaggcacucaaugcacaccgaauagggaaagaaugaacaaauuuugcaacgaaaauaauccagaaguauauguaucauuuucacuuugaauaucacugaacuuagcaaaucaauaucuaguuguguccuuauguacauuucuacuuaaaggugagaaaaaagaagggaaauaaguccugagcaaggaccaugccccagacaggcugccagcugcauuaaagaugccacccaccuucaguagaauggccugaugacuccccuaaggccacuaucuucuuuaaccuucaacagagugaagucagagccucuggguacaaacugcacuguugucaaugaaugcgaaccaaacaccuugaggagucaaaguaagagcucagguaucuuccaagaacaccaagaacaggcaaggcacugcuagcagcaugagaguggcacacacagaacaugcaggcacaccggcaaguuucaaaaacuuccuguuucaaagcuggccaaguucauuaucucaacuaacccaacuauaugaggcggcucccggacauguauuaaguugcuauucaagagggugcagcacaaggugguuuuggugaauugccugcucaguauuaucaaugggugaaugugcacucgaauccagagcuccugacuccggacacugugucuucucuccaccucgcugugaguucuguaauauaaauugugcugggcgagcagagaacaaacagugcccagcaugaagagcaagacagcuggacuccagguugcacaccugcaaaucaccugcaugaauauggcaaacaaacgaacacagaaaaaucuguaggauuucagcaaauccaagaauucuguguuaugccauauuuuggaaaaaacauugcuucaauaucuuuugguaaaauguuguagugaacuaagucacucuccuaguccaaacucagauguacggacgugacucgaaaaggccagggcuguuuuuaacuugggauuuuuaaauaagaauacaagguguguccucacaccaauacccacaggaucauacaaaaauacgcauauaaugaggucacagaguuauuacugaaaugucugaaauacauacuguggguccagaaaaacugucagcaaagucucaaaaauagcuuuccuaaggucugucaaguuuugggaaauaauccaggaaaaugauauggcguguauacagaaaagucagcucgcuuuagccagugacggcacaguggacaguuuggggugaauuauuugauuaucugaggggaacguuuauguuccaugcugauauuuuucuuaguguuggagaggggguguuuguucuuggagggggaguggcaauguucaagcccacccacacacauggccacgaguguaccugggauccaguggggcagagcagguguuugcagcaaggggaggcugacagguugcugcuucaggccccacucugugguccgccuugucuguacaguucuguguuccugcagaauaaugcugcucauaaacccacccucaguuagccuguaaaccgcgcccuuuugaguuaagggucauacaucuuugccaaaaucacccacagucccagaaaauaaaauaaaggcaucacaaaaaucacaacccaaacagugcuuucaaauauaaaaaggaaagaagaaaugaagcaaagccuuuuguuuuuaguagucgauucagaaugaauccaauacaaggccaaacaaaacacagauggcuuuuucuaacuuugucucaauaugauuucugauuuccagaaauaaaaaagcaacguuacucuccucccuucuaacuaauaugauggaguuuuaucgucacauagauacagugcaucagucucuguuucccccacauucuaaauaaaggcggggugaguggggaaaaugggcagauauaaguuaaacgguagaaaguugcagucuguccaugaacaagucaagagcucuuagguacagcacgggaccagaguuaauaauauuguaucauaugcuggaaauuugcuacgugaguaaauuuuaggugcucugaccacaaaaaauaaaaacugaaagguaacuaugugagaugauggauacgugaauuuacuggaagguagccaucacuucacuacguguaucaacacaucccauuguaggccuuaaauauacaccuuuuuuuuuucuuuuuaaagaguaaggauucaaaagccuguccccagcggggugcaguggcucacaccuguaaucccaguacuuugggaggcugagguggguggaucacuugaggucaggaguuugagaccagccugggcaacauggugaaaccccgucucuacuaaaaauauaaaaauuggcccggcaugggggcaggcaccuguaaucccagcuacucgguaggcugaggcaggagaaucacuucaacccaggagggcggagguugcagugagccgagauugcgccacugcagccugggcgacagagagagaccccaacccagcuauguggaaaagguauuuggaauccggaaaugcaacugaugugacuucaggggcagcucucauaacaaagauugguaauaggacuccguauuaguucguuggggcugcccuaacaaaaggccacagguaguggggcuuaaacaacagaaacuucuuuucacacaguucuggaggcugaaguucaagaucaaggugugagauguguugguuucauucugaggccucucuccuuggcugguagagggucaucuuccccccguguccucaaauggccucuccucugugugugucuguguccuagucucuucuugcuauaaagacaccagucagaugggaugaggccauaucuuaaugaucuucuuuaaccuuaauuaccuuuuuaaggguccuaucugcaaauacagucacauucuaagguacugagagguaggaccucaacaugaauuuuggauuuuuaauaguccacagaacagguucccguggauauagcucuguguacauuagguguuauuuuuccuuguuaacaccaccaccaucuucuaacccacucucacggaggagggggcagcucuccgccaugccaagugcauaaccucacugacauuaggaagaaagagcuggcuuagcccacccuaugacgaggagccucccagguuucaggcccugggccaggaggagcggauuugcuuuucccaggggcugcuccuuccccugcaggcacuccccugcuccguggugaccagcugcuguuauuacagucaugguuguuucuagauaucugucugcccaugugaguggcagaaaccuugaucuuggaguccaagugcuuucugaacacaccacugcuacuguguguuacaaugcugguggcuucagauggucucagcccccugccuccccuaggagggugcgaggucagcacacacauggcaaugagcuuccagacacugacagacaggguucuuuccaacagcuacuuucugaagaagucugggaagacuaugaaaacuggcuucccaugaauaugcuucugggauuggguggcucuucuuacuuuaagaacagagggauuuugucacauugugaccucuaauuuucaacaaaaaccuaguguuucaacaaaaacaaaacaggaucuaugagguuuugccucuauguacaugcauacauuaccgucugcaacucccuacagggccaagagggcauucaaaauaacucacagugaaugaagcccauuuacacuggaaguugcucaagcugucccggcuucuccccagcaugaaugggaugcucaucuggaggccggcaggcacugcgcagccacagcuugcccagaacccacugcuggagccacuacuggucuccagguaguccuuuaugauucauuuuccccuucuucaguguguaguugagaaaaaugaucuaucaaaucauacuuauaaacacacacacacuccugcccagugcuaaacuugaagcuaaauacucccacaaaggaaacauuuccauggucugcccuuuccuguuuucaggaggcacuaaaaauaggcauuauucggauccccaggucuuuggaggaaagucaugccaugagcaggcucaucaacucaagugugaaaacaagugcgugcagaugcuucugaguuaagagaaauauuuccagccucauuauucacgggcaugaaaggucauuuucucuagagggugcaacacuccaaaaaccaccacauaaaauacguuccacacaaagcaucugaacagaacaaaucgaugugcacaucggagggagauccuauaaaaauguaacacacacaggcccggaucaaacaaauacgagcaagcugggagccagaugggagccaaagagccaagaguucuuggaguccccucgaggggcuguaguucuagaugaaaucccucagcccucaggcgaaccugucuaacaggaaccagcauuaggcagcauauccugaaagcaccuccaaagggaaaccagggaggcggggggaaaagaggagaccugggggugucugcugcgggucgagagggguggaggaugggugaggaccaggaacgagggccuucucucaggacuccauccuucugaaaaugugcaccugcaguaagcccccugaaggguacgguuaggucuaaagcaagcccacaacaauaucagagaauaagaaaucagcucauugauugacccaaggaggaaacauuuuacuugacauuucauuguggauuucagaaaucccauuagcuauuuucucgcuauggcuuaaaugcuguucccuaaaaguccagugcuuguaguggaagguaccaagcagugauaucuauuguccauuuacccacucuuccauuccgucauugcaugccuacucgugagcuuguccugggauguaaagaugcuuaggacauugucccugcuugugugugucagggcuauugagagugauugcaucgcauauggguggcacucugaggggaggugaggggugcccauggugccucauggaaauagaggaagacgagggucuggugcuugcauccaggugggaagacuucauagaguagcugguguuuggagugggucacacagcugaggucuggcugagucaugaugucuagcagagaggauggcacgggcaauggcugagggucaagggagcccagagcuucaguuuguuugcagcccaggacugggaggggccagggagccaaggccucaauggccaggcuaggggaguggacuuaacaucucuccuaaauggcaauccuugaaagguuuccagcaggagagagaaguggucucaguguggaaaaugguuuauguggcaggagguccagagaccagcaggugaguuguucaguggaagggagggagagaaggagggaaggagggagggagugauggcugugagggggaagaccaucuggcugccaggaggauggggguggaggcacagggagaaugggaaacccuagcaagugaagagagaaaacauugcuuuugguaaauagaggagggacaggcauugcaaacucagcagcccacucaacaagcccacugggaugagcccguaagacauuuggcaggggcuaguccucaagcccggggguaaggacagagacagaguggacccuuggcccagugcacaccagucaccaaccuaaaaugcugcauguuauaaaggaagugugaagcccucacuggagaccaucccaauucauugggcuuuccuauccauggggacuuaagaaugcaagaagcagccugugcccugcagaagugcauagggccugggagcccagaucucuuguguuugcagcccccagaggggcauugagggccccaguaccagccagugcacuggggagugcauggcucugcugccccguccuaggaauccguacuggagagccuggugaucaucaccgcuauuucuauggacacugccucucaagagugcuggcugggauaccugcaaaccugcaaguuuaauagccccaauucucuucuucuuaggcaguaaugggucugccuuaggcagcucuuaggcaucaagagcucuggguucaugacagaaugccaugaaaacaaaagccaccauuugaaccacgagaauauauguugucagccuggccaacauggugaaaccccgucuccacuaaaaauacaaaaauuggccaggugugguagcgugggccuguaaucccagcuacucaggaggcugaggcaggagaaucacuugaacucaggagacggagguugcaaugagaugagaucgccccacugcacuccagccugggugacagagugagacuccaucucaaaaaaaauaaaaauaaaaaaaauaaaaaacagguacaugcaggauauauacugagcauguaggagucaauuuaagcagcccagagcaaccuucuuuguccucacugaggaugaggcaagaggggaauggguuagauagaggguguagggaguucaaauccgaucacucacaaucagcugugcagagacagggacaacaguuauguaaaggacgaaaggacgacugugaaauaaagaacaacaggcugaguaucccugaucugaaaugcuuaaaaccagaaguguuucagauuucauucuuuugcggggauuuuggaaugcuuauaggcugaacaucccuaaucugaacauccaaaauuccaaaauacuccaaaaccugaaacuuuuugagcacugacauaacauucacaggaaaugcucacuggaacaguuuggauuucggauguuuggaauagggaugcccuaaguguacugcauaaaggaagacaaugagcuguuuuugguucugccuggaggauguuccuucugcaggaugaguaagaauuucugcaggucccuucuacaggaugaaugagaauuucugcagguuccuucuauaggaugaaugagaauuucugcagguuccuucugcaggaugaaugagaacuuugcuccuucaaagcauggccccaggaacagcugccuuggaagcauggaggagcuugguagaaaugcaguugcaggcuccuucccagaccuucuggauuggaaucuacauuuuaaaagagccccaggcgauucgugugcucaaugaagucugggaagcacuggggcagacagccuuuuggccuauucuuaugcccaaucugucaucuucaaauaucucuguacuaacaaauaaaacacacugaaaaaguguugaguucaaguuuggguucuugaacuuaagaacgauacaagccugccugcaucacacucauuucaggguaauuuucagccaucagcuuuggcuguccuuuuuuuucuuuucuucuucugaaugucacuuaauaagacauaacaggagauaaaucagucuccuaguuuggggcauuaagagauuguaguaauguguucuagcagcccacuggaguuuauuuccuucuauuucacgacaacuggggcauuaaauaaucuuaaaucauugggcuguccguugccugcucuguggccacuccugcggcuuugaaaauccaauaugagaaaucauucuuuauggcaaccuccacagcugcaagcaaagcaauuuagagaacgcuuuuacgagaacaguuucuacauacucugcuucuguuacaaauuacucccucccuuugacaacacuuacaaaaugcacaguuuaaguaauacaaacggguuaucacauuuccauaauguaaacagucaaaaaaguuguuucuuaucaaauccauaauaaggcagcgacaaagcccggccaugcccuuggccucccgugauucucccuaauuuagcacucagcugccggggcagagcuuucauccaauuuccuucauuuucagaggugaucugcuuaaugauggcucggcugcuucauuucuuccuuauauuaggaaggcuguagggguggggguaagggggugggguggggguauggcauacaacaggcucucauucauagaaaaaucccagguccgauucucaccaggaucuauguaaaaaguguaaagcaggccgggcgcaguggcucacgcuuauaaucccaacacuuugggaggcuaaggcaggcggaucacuugagguugggaguucgagaccagccuggcuaacauggugaaacccugucucuacuaaaaguacaaaaauugcugggugugguggcacgugcuuguagucccagcuacuugggaggcugaggcacaagaauugcuugaaccugggagguggaggcugcagugagcugaggucgugccacugcacuccagccuggguaguagagugagacugugucucaaaaaaaaaaaaaaagaacaugguauucccuuaaccuaacacacaagauauauggggaauuguuuaguguugugagucaucucacugauuaaaaacauugccacugaaaauuaaggaaguccuccacagggcuggucucaaccagccuuaaaaaugaucagagggaucuucaacaagccaagcaauggggaaagcauucccuauuuaauaaauggugcugagagaacuggcuagccauaugcagaaaacggaaacuggaucccuuccuuacaccuuauacaaaaauuaacucaagauggauuaaagacuuacauguaaaacccaaaaugauaaaaacccuagaagaaaaccuaggcuauaccacucaggacacaggcaugggcaaagacuucaugaucaaaaugccaaaagcaacugcaacaaaagcaaaaaauugacaaccgggauuuaauuaaacuaaagagcuucugcacagcaaaagaaacuaucaucagagugaacaggcaaccuacagaaugggagaaaauuuuugcaaucuacccaucugacaaaggucugauauccagaaucugcaaggaaguuaagcaaauuuacaagaaaaaaaugaacaaccccaucaaaaagugggcaaaggauaugaacagacauuucucaaaagaaggcauucauggugccaacaaaugugaaaaaaaaaagcucaacaucacugaucauuagagaaaugcaaaucaaaaccacaacgagacagcaucucacgccagucagaagggcgauuauuaaaaagucaagaaacaacagauacuggcgaggcuguggagaaauaggaagacuuuuacacuguuggugggaauauaaauuuguucaaccaucauggaagacacuguggugauuccucaaggaucuagaaccagaaauaccauuugacccagccaucccauuacuggguauauaccuaaaggaauauaaaugauucuacugcaaagacacaugcacacguauguuuauugcgacacuauuuacaauagcaaagacauggaaccaacccaaaagcccaucaaugauagacugaauaaagaaaauguggcacauauacaccacggaauacuauguagccauaaaaaaagaaugaguucauguccuuugcagggacauggaugaagcuggaagccaucauccucagcaaacucauacaggaacaaaaaaccaaacacuccauguucucacucauaagugggaguugaacaaugagaacacaugggcacagggaggagaacaacgcguaccagggccugucaggggguuggcagcaaggggagggagagcauuaggacaaauagcuaaugcauguggggcuuaaaaccuagaugauggguugauagguacagcaaaccuccauggcaaauguauaccuauguaacaaaccugcaccuucugaacuuguauccaggaacuuaaaguaaaaacaaacaaacaaaaaagaucagaggaauaaagaagcuuggucaaggcuguguaacugggagaaagagguagagaauccuacacugaguccaaacaagaguggguccagcaucccaggucaccuccaccaacgagguggcaaggaggaggccaggccccacacugaagggacugguuagcugcccaacacaugccaugacggcaccaccuggcaugaagacacucguaaggacugacaggaggauggaggccaacaaugcugucaccccuagagagaaaggcaugugguuuccgaauuuccacaaacugagacaucaacagaauugaaggaagggacacagucugagaugcagccaauggugcugccagaaacagcaacgucauccagcagaaagaagccugacagcuccagccccuccccaggagaccccaugguucaaggcagucucaaauggagccagccaccagcccacaggggccacuugcugggacagccacagggcuacauuccccacccuccccacagaacucauucucugcauugugacaauuccaggaaaacucacggacaggagagacggggagccuucugagggguggggcucccaugagaaagacuguagguggcaagagaccaaggagacagagaggagcuuugcagcaggaugucccugagaugguggcguucacaccaggaugugcgcugaacucagagugggguuggggcaggcacucagcuauggcagggagucaaacaguacucgggguuucaugaggcgaagccaggcccacccagggcaggacuggaaacccagagguugcagagguguuugccauccuguucugccccaggccaggcccgggaaggaucaugacuaugugacaccuccucggaucggggagaaaugaggcagccugcagccagcagagcacguuuguuucuugauugggcacuguuugccaagacagcggacugaacgacagaacuccacugaggacuuguguguccaguguuagaggcuggguuaaaaucuaaaacaccccagagagaagagggcaggcggggaagaggggauggucccacagaaaaagugcagaaccugaaaagguaaaaugucgaaacauggcagcaugauguuucacuugaugaggccagcccaggccggggacaaugcugcccaacugugggccaaagcaggaaggagcuucaccugucucacaucaaaugacagcugucaacacagaagacuuaaauacaaaaacaaaaugaaaggccaggaaaauaagagguaccauaaaucugauuagcauaguuccaguaggcucuggaaaacucuuuuuaccugcucucaaaguaauauauugagaaguaauauaaugaaguuaucaaauuaacauuacuaaaaugaaaacauuuucuuacaaauggaucucacuuuuaauccuaaaacaauucccaaacuauugacagaguauugcaucuuucaauuauggugaauuuaacggguacacuuugcacauaauacauguaaguauuuuucuuaauucuuaucgagagagagauuaugguaaaauuccuuuuaagaaaucaagacuuucagauucucaaacuuccuuuauaauggcccccacugccuucguuugguuuaguuucauaauagcugaaaaacuaucacagagagauaaauuuuaaagucccccauacaguuauccaagcuucccguaauguagucaguauaaacagaacguauuucccugauaaauuccuaacaccaugccaaagucagagaaagcugauguaaugcugaauaggggauaaaccccugugugaaagaaggaaguucucauaauccucaaucucccagcgacccgagagcuccuguaccaaaagcugugcuuguaacguaugaugcugagccacgucugcagauggacgccacauucacugcuccuaaaugcaggagccaagggcauggccacagcaccaagcaucaacaguccauucagaugaaaucggugaacguggaaaccuaucccuaaaaagcccaguguucucacagcccccuuuugagguuuucgaguugauucaccaacuccaaaucaaauaugcauaaaaugggccggucacgguggcucacaccuguaaucccagcacucuggaaggccaaggcaggcggaucaccugaagucaggaguuugagaccagccugacaaacauggugaaaccccaucucuacuaaaaauacaaaaaauagcugggcaugguguugggcacccguaaucccagcuacuugagaggcugaggcaaaagaauugcuugaaccugggaggcggagguugcaguaagcugagaucgcaccacugcacugcagcuugggugacagagcgagacuccgucucaaaaaaaaaaaaaaaaaaccaggaaaaaaaaugcauaaaacguacuugagcuaaccauauaaaacccucagccucuaauaauaauauuuaaaugcauagaugccacagugcugggugccagccaucuggucaacccagcagacuaaggggcauggaggagcaggggucgcuggucuaugacaugaacagaaacugaaaaaacaaaacgaaaaacuacuucugaaaucagaggaaacaaaucaauaaacuucuaccucugugcggagaugccacagcaaauugcugucucaauucucuuagcugugcuuccucuggauucuuuucugacuguauacagaguccaaugaacccaacacgauguuccugaggaucuguguugaggcuugaguacagucacuguuccucccugcuggucuccagcagcuccuugucugagcucccugagggcacaucucauuucuuuacuguucccagaauggccccuugucucccacacugugugcccuuauggcuggaccagaucauguauauccaaguguccccuuaagguccagcaauguguguugggcacucgaggaacacaaaaauccucagacaagauuuccagggaagcaaguccuucagauaagcgaggauuugcaaugccucgggauacacugaccacugaccagugacaggcuccccuagaacaccuggacucuucugcccgacucaucagagugcacaaucccaaagucgauggguuucaccuaaaacuuacuuaauaccaauucuccuugcuacuauaauuacguaauucaaauaaaugugacaugagaaaaugaauuauuagugccaugaaaaagaaccaguuuuggaaaacuaaauggaaugcuuuacaaaggcuauaauaaagguaaagagcuaaaaaaaauaugcaaaauuagacuggggugagacaacuggaaaaccugaaaaaugugacuaacuccacuuuaaaaaauuguaggcagaacuguugaugaggcauuauagaagcucaucaguggaaccacguucaaaaagaagcauuggacuuacauaaaagguaagcaaaacaaacaaacaaaaaacaaaaaaagccuaagguacacuuaugugaguuuuuuuguuguuguuguuuuguuuuuuuucagacaaagucucacucugucacccagguuggagugcagugguaugaucauggcucucugcaaucuugaacucuugggcucaagugacucucccacuucagccuccugaguagcugggaccacaggcaugcaccaccacaccaagcuaauuuuauuuuuuguagagaugaggucucccuauguugcccaggcuggucucaaacaccugggcucaagcaagccucucaccucaccucccaaaaugcuaagauuacaggcaugagccaacacaccugaccucacuuauguguuuucaguaaaaauaaaauacaagguaugugguaaucauaaaaauagcuuccacguuuucaauuaaucagcuaacuuauugucucugugggggauuccuccuacucuggagguuuuaaaauuuaauugaaagucacaaguggacaaaagaaacuucaggaaaagggcugacauuuuucucuuugguaagguuagugaaaauacaaauauauauuagaauuucgcucaccauaaaaaaggaauuuauuuucugaagugcguggaaggccacucagaucaucccaaguaacagagggcuucauaacaagcggcuaggguaacacuccuggaauggcaugguuugggcucacuugucaaugauggaagagguuccccgacugcuccgcagccucagcuccggcccccacccccauccugugugccuuguaggccuggcuggagcucugcccccugagcagccacagaacccggcucuuguguuccccaucgcuuggcacgugcuguucccucagcccagugcucuuuccacucucaaauacucucaucccagcaaauuguuaaaaucuaagaacaauccccaagguagcuucuuugcugaauguucccuggggcccagagggaauucuucggguugauaagcccgcacuggguuuucugcacaauuccauucuugcacguuuuuacacaucgcgauuacaugaugcucucucaccugccacuaaacuauuucuuucugagacaggaucucacucuguugcccaggcuggaguacaguggugggaucacagcucacugcagccucaaccucucaagcucaagcuauccucccaccucagccuuccaaguagcugggacuacgggcacacaccaugauccggcuaauuuuuaaaaauuuuuuguagagauagggucucacuaugcugcccaagcuggccuugcacuccagagcucaaaugaugcucuuacuguggccucccaaaguguugggauuacaggugugggccucccaaaguguugggauuacaggugugagccacccaugccuggccaaccuuuuuuuuucuuuuuuuuaaguguuuaacccagugccuagcucagaaaguaucaguguugaguaauaaaacuaaaucgagcacugacagagacucuuuuugacuaaauguuagccaggcuccucugagcucucuucucaacuaggcauugacuuuggcucuauccugcuaagagaguuuggagugaauccacacccuugacaugagaucaaauuacucauccuccaccuuugcugucuaagucauuggccuguuuucaggaagaauccuauuagguucauuuagcaagacaccuccuauccuugagguguccucuuaguaauuuuccauccacugacugucaccugccccacccagguuguuggcuauaaaucccaaguuuuguacuguauuucgaguugagacugaucucucuccucuucuguggaaucuugacaccuauugcaauacuccugaguaaaaucuucuuuauccugcuaaccguugucagaauaacucuuuccuuaacaggacaugguguuuuuguuucugauuauaaacuuaaacgcaagacuuaauaauaccacauuucaguaaaaaauuuaaugucacacagguguuucaaagagccaaaaauucaaagaaugaggcaucuuuucuagugaccaugcaccugcauuuucauugcauacagggcugucugcuguccauauuucaugcuguucucuguucucacccauuuugaaguguuucucuuccauugguuuuugacaauacacacacacacacacacacacacacacacacacacacacacacacccccucuuuuccagaguuaggaaaagcugucccuaugcauagaauagugauugugccuacaaacuaucaacauuaaccacaaagacuucaacugaagaauacauuuaggaaacaaaauuguuugaauuguuccucucagcacucuacuuccugagcuacgauuucuaggcuacgguuuggacugacagcccaucaccagacaaugacggauugugugggggaaaauauguuugcuguccucaaauugccuuuaccuauggaaagcaaccauagcuuucacugggaugcagguggcugugacacagaaucacaaaccagcuucagaauucccucagggagcagcuccuggccccaggaguggccccccagggcucuccuguagucuagucccaccuggucucuccuguaguccagucccaccuggucugcacacgacucugcucuccucagcaucucccucccagaccuuccuaccuccccaacagguggcuagaguuaggggacagacacccuugggacucagguacauggcaagcucggguuggccaagccaggccaaaccugacuugaauuucucuagagcagaccagaagcaggaaacacaggcuguggaaaagcuccgggccacagcauucaaagcuuauacuacaagcagagaggacccuagauccugaggcuggccacagagggccaugcaaacccacagggccacugcaagaaaaagggaaggcacacacaaagcaggcaggcaggcuuugucgaaagcuugcauuuuuuuuucuuuuuuuuuuuuuuugagauggagucucguucucucacccaggcuggagugcaguggugcgaucucagcucacugcaaccuccaccuccuggguucaagugauucuccugccucagccucccgaguagcugggacuacaggcacccgccaccaugcccagcuaauuuuucuacuuuuaguagaggugggguuuugccauauuggcuaggcuggucucgaacuccugaccucaagugaucugcccuccucggccucucaaagugcugggauuacaggcaugagccacagcgcgcagccaaaagcuugcauuuuauguccagggaucuuuaaauggcugguucauuacauacccuugcccauaauacauuugauuuccaaauaaauacuaaaaccuagaugcauauauucaccggugaccacacagccuggagaaauuccuguucuccucaugacaauagcaaagcgaagccguuuuguaaacacccuucuuuccucccuccaccaaaagaagcgguuagcacaguacucacugaaguguguuuuacacauucauuuguauauuauccuaauaucggaguuauuuagcuaggcucaauacacaggguuagcagcucaaacaaaggaagcagccugacuuguaaaagugcuuauugcacagcacugaugugaaaagcagcccgggagaaaccuaaucauuaacccuccgauccaggccuaaccugcacuuccgccuagcacucaagugacacugacacccuguauucaagcggcacugaaacugagacucgaugccugcccaguucucacuguaacuggaaaaagcuucacaaauccuccccuugguggauccuggcuuuuacagagcucugauugcacugaugcgugcugcuaggacagaaacacugacuccucuuccccagagaguuaugauuuugacaucucucaagcaguucaaggguuagaacaggcuaggggguuaggaaaagcugguaucuguucuggagauuacagugagcggaugcgcccagcccucccggcugccggccucguggugggguugcaagcacugauaggguucuccagugcuggcacugccuucaaaauggcaaggaggaacggaugaaacaagcugagccacagaggcaaagcaaagcaaagaaagucagguggggcucucgggaggacaggcaggccaggcuccagaauuagggagagaaaacggcuggggaggccauucugugguggccccuaagagggaaaaaggcccaagaaaaacuagcucccugaaaguauucgaagauggaucaaccaggcaucucaggccugaaagggaagcagaaaguaaacuggaauauaauuuuugauacuagcaugacugguaacauuugugcuauaaaagggagggcgauaucucuuuucuauuuuuguggccugaugccaucuuccugaagggugauccccacggaccuuagacuuuguccuucgacagguccuggaaaggggcagcugucuccucugcaguccccaaugcuagaacauagaaucuuuucuacuuggccaucauugucuaagcccagucucuugguggcucauuuccuguuuggcuuuucccaagaagcuuuagaagagauccagaaagcacaagagaggagacagacaacggagagaagccgcacaggagaggcagcgcgaaagaagccuucuaaucugucuucaacauccugcuuugcaugguggucucuaggcggcaauucccaagaguucaggugaggacuccaggaaaugccaucggggaggaugccagcuggccugcggaacuucccagaaaggaaaagccaggucaguguuugcugagcagguggaguccacuggucaccuucccuuugcugggucugcuuggcuuccaauccccaaucacaucucaggacagaacucacaugggaaggcugaauuuggagaaacggagucaguucucaauggccggaugcucugagaaaugccauggagccugagauaaggaacuuugcaggaauacuuuucuuuuuuucaaauccacaucuucagaaaggcaagagaaaaggaugcaagguuugauuucacuagguugaggcaagaaugggcuccaacagcuugguugaacuaaccaaguccuaagccucucgcugaucauacccuggcuagcuccaaaguacguaggucuaggagaucacaucaagacuuaaccagucacacggagagaugacaugucaguuuccuggggcuggcaugacaagugaccacaagcuggggggcuuaaagcaauauaaaguuauucuugcaguucaagaggccagaagucccaaauccaggugcuggcaaggcgaugcucccucugaagcccgucuggaagacucugucccaugccuuccucuuaguuucugguguugcuggcaaucuccuugacuugcagauguuucacucugauccaccuccacggucacacagcauuuuuccugugugucugugucuucucuucuuuauaagagaccagccauuggauuaagagcccacccuucuuggccgggcgcggcggcucacgccuguaaucccagcacuuuggagggccgaggcagguggaucaucugaggucaggaguucaauaccagccuggccaacauggugaaacccuguaucuaccaaaauacaugcaaaaaaauuagccaggugugguggcgcaugccuguaaucccagcuacucgggaggcugaggcacgagaaucacuugaaccugggagguggagguugcagcgagcugagaucaugcuauuguacuccagccugagugacagagcaagacauggucucaaacaaaaaauaaagagcccauccuucuccaacaugcacccaccucaaccugauuauaucugcaaagacccuauuuccaaauaagguuacaaucacaggugacaggaauaaggacuucagccuaucuuugagggguucacaaucuaucuuacaauagacaccuuggcugacucuaucccaucucccuggaccaccucgagaucauccgaauuacuuuaugaauaaaacaauccccaggacaccuggguggguucucuccuuucucacaaccauggcccucagguauccuccuacgucaaaaugcagaaaagcucugacaaagguacccaaaugcuuuucaaaaaagaugaucugcuaacugcaggcccugggcuuuguaauauaaaccccgacaaguuugcuagguguuuccugcgaaaucaacugcuaacaauuuuuaugugucuuccuaggauuuaauaaagcccagcucugagcucaucauugcuuccagcuugcucaggagcagacagcaaccucagucacgagacaauuuauggcccagcugggaaagagagaaaugcuguggggaaauucuuucugguugacaauggucaaagcgauugcuucucacucaaggagaacugaaggauacuccaguacauuuaaaaaugaagggaaaacucccuccuaacugaaccaggagcaguaauuuaacaaaaagauuucauuucaguuaauggaugauuuacugaaaaugcaaauaaauucagcccucugcuacaauuaucacuagaauuucaaaauaggggacucacuuucuaauuaaucacagauucgagcuaacccccaaaaaaggggcucaucugugaaacaccugauuggcugaccugugauuuuugacacuaauuagcauauagauauuauuuguuuggacauuaaggauuuaagguuacagaacauggcauaacacaguaugcaugaacaaauacuaaaauuauggugcucauaacgaggaaccaaucugaucuuaauaauaguuuuaaaauucacacugauucacacuuaauggauuauuuucccuacagaugguuuauuacacguggugggaauaauugcuuuuccaauauuauguuuggugggauuaauuagguacuguuuguuuccccucaagauaauauaaacaaaaccuugaaaugaguaauauucagauuagcaagcagagaagaaggcaucccaauagguaauggguggugaaaucgggcacucucgcuccgacacgucugaauaaugcauagcuuugggaugcuccaagcugucaucacuuucugcuaaaaaugcuucccgcauuuccccucucauugagcugauuuucaucacaagggcuucccaugcucgugccaugaggguuugguuuauguuuucaauauucuaaggugcuaaaacauaacuagaaaguuaagaaauguauuacuguaaaguugggaagaagguauagcaugauugagaggugcuuuguauuucugaggaauauuaaucuguugguuaauuaugaaaacgugaugaaaacacaucacagcaaacgcacccuuccuuggugucacuggcauagcuccugccugguucuccucuccuccuucugugcucacugccuaucucuccucucuuuucucccucccuccaucaagaugguccccaugacgaugcguccccacuucucucaucacacauccuacucucuacaauuagggcucauucucaugacucacugacccccuaugauccagccaguauaauccauuccugcagauaccgcuugcuucugagcuauggauucgucccuccacauucccacagguuagcuuauccuacugcccuggaggcaucucagacuaagcaugugcaaaaagucaaugaccguguuccuccauuccaacaccuccuuccaucuccauuaaugguguccacccacauuucuuggccugugcuugucuuccacaacuagcuugcgggcaaaucaacagguucucccucucgaccaucccucacucccaccccuccucugcacaccguggcugaugcugaugaacugggaauagcugccccacgcucugugcuggccucccugauuccacagccaagcucacaugaggccacagcaaguuguucagaacacuugacacaggcucuaucucagugaaaagcucaaauggucccaccuccagccacugaugggccacagcucacagcugccguggcugagcggcucuuuaggacgcauuuccaggcugcucuccuucuucagcugugcccugagauucaggcuaagccucccccacaacugugaagagcacccccuaccgcuuucccaugcaugccacaaaaagccaccucugccagccucuaucuuccccuucccucaucccauuguccuggaaucagcugugcaacccacuagaccagguauguuuagaagcucagcccugaggcagacagagaagcaaacacacucugcagcaacuacuuucaucugaguuagagagcaggaaucuggaagauucuuugccugguguagacagagccucgacggcaucuugcaagguuccugaccgucacuccacacggcagguuucuuguuggcuugcuauggcagccauguaaaaagagaagagcaaaccccacugcuggauaaucuucuuuuaugcaaaacagaccacagccaggcuugcaaagaacaggccugcagguggaggcgcugaaaggggcuugaaggacuuucugggagaugggcaggugcagcuccacuacgugaggaugggucuggcuucugacaccacauucccccuccuccccugccuucccuugugaguaacugugaugcuuuguugcauuguaagaaucuaugugaaaaacaacgggcugaccugcuucgauaacaaaaucgaauggcaugcggcacagucagguauagagagguaaugcuccaucuuuuaaaaacagucagaaguucugaguaagaagaggccucagaaauuauacggcaaguacaacaacugcucauuucagaccagaggaaaggaaaucccagagagguuaagaaacgugacccaaaccacacagcaacagcaugcuguaagaaagccagagccugucuccccuaauaggccccugcuauauuuauuuuuacuuaagagcaucauuaucaguauccaauagaggagauuuaaauauuuaucuccaaccugauuuuagguuuuucauguugucaacacucuaguuacacccaucaccuucucuuaagaacaaaaggaacuuaauguaucauagcuacuuuauugguuaucuaggggugaggcaggaaucccaaaccucaauuggcacagagcugugggcuguguuuguuuaagcaaccuuggccccaaacccucccaaucacaguucuuuuuuuuuuuuuaucgggguggggugggcagugucucacuggacugcagugguauaaucacagcucacuguaaccucaaauuccugggcucaaacaaucuucucgccucagccccucaaguagcuaagaguacaggugcacacaaccacaccuagguauuucuaaauuuuuuuuguagggagggggcgauaugguuuggacguuuuguccccuccaaaucucauguugaaaugugacccccaaugcuggagauggggcauagugggagguguuugggucaugggaguggauaccuuaugaauaacuuggugccuucccuguggcaaugagugaggucugguuugauaguucacacgaaagcugguuguucaaaggaagcuggcaccuccuccucucccucucuugcuccugcucgugccaugugucauaccugcucuccuucugccuucugccaggaguaaaaguuuccuaaggccucugagagcugagcagaugcugguaccacgcuuguacagccugcagaacuaugggccaaauaaaccucuuguuuaucaaguuacccagccucagguauuccucuagagcaacacaaaauggacucacagaagggguuucacuuuguugcccaggcugaaaacuuaaauuccuggcaucaagugauccucccaccuaggccucccaaagcccugggguuacaccugaauccccauaauaauucuauaugugcuauccuuauuuaagaauaggacaacuuggccaggugugguggcucacgccuguaauccugacacuuugggagacugaggcgggcggaucaacugaggucaggaguucgaaaccagccuggccaauguggcgaaaacucgucucuacuaaaaaauacaaaaauuagcugggcaugcaucuuuagucccagcuacuugggaggcugaggcaggacaaucacuugaaccagggaggcggagguugcagugauccgagaucacgccguugcacuccagccugggugauagagccagacuccaucuuaaaaaaaaaaaaaaaauaggacaacucacaugaaacacuacauuugacugggugugguggcucacgccuguagucucagcacuuugggaggccaggguggguggaucaccugaggucaggaguucaagaccagccuggucaucauggugaaaccccaucucuacuaaaaguacaaaaaucagccuggcguggugacgagugccuguaaucccagcuaguggggaggcugaggcagaagaauugcuugaaccugggaggcggagguugcagugagccaagaugguaccauugcacuccaggcugggcaacaagagugagaauucaucuaaaacaaaaaacaaaaaacaaaacaaaacaaaacaaaaaacgacaacaaaaagcaaaacaaaaccacauuuagugcaaauaauggucucugggagaaaaggaaguucaacugguaaauaaaaucuguucuauugcauuauaaguauaucugagacaggccuuaaacuggacaccccaaguaccaugaggauggaagagagagggucaguaacacaaaaugaguugaggggccaggugggcugagacaaguggucaccugcaccugcccuggaggguaacgugggcgagcacacacuggcuuucucaagcugcauauccgcggugugcuccggguggcuucaccugaggagugaaggagcucaguacgccugcaugauggaggcagaucagaugacuaggcggguucucagggcauacuggaggcagagaguuggguggggaaguggauggugguuuuggcagaggccacauccugucuguucucaucaggcuuuuuacaaugaagagucuuuucuuuuguguugguuucuuuuugauuuccucaagcaucccacaaauacacagugggugccaccaacacguuaggcccugugcuguaucuaagggugaucuagccgcagaaucugcugccuggcuucagagggguugaucuucugguucauagggcaggcaagucgcccucaucccauguccccagacccagcccuuucacagcagguggaagaggaugagcugccaaccugcgggugggauggggucagggggaagcaugcuuuggucaaggaccuccauccaccucaauggcaaagccaucacagugcucgcugggaagggaccaggaaaccagucugggcucuguguaccaagggagaaugcaagugacacacaaaacccggugcuggccccacaguguccaaugacagcagcacuccuucauggcaccagccacagguaaggagaggcagcuacacucagcccacuuguguucucuccauggucgggcaguuuuuccuuucccacuugugcuaaggucuccuuugagauaacagauugcacaucaguuacagcaucccaugcccuaugaaaaggccauuccugccacuucugugcuucuucagaugacacaaggcuacaggagcaugcacaggagcucaacguccuugacgcuuuguggcccugggcuagcagcagcgcucuucccaggaucauguaugaguccuccacggcacccuacaacagcccccuccucucccacacucaugcuacuagcagauagauccccuuucucuuugccuugcugaguguggggccagcagccuuggcagaaagcugccuggguccuugcuuuguuucucagcaccuuucacauuacaaauugaaccugucaaguggggacuucccaccccuguuuuuaauaucccuaacaacuuggaggcagcaaacuggugaucaggagacaggacaugaaauuugucugccaguaucagcucucggcggguugaaugucacuucacaucaucggcagguuuuccucgggaagcacaaaacauuaaagcccaucacugcagguggagcugcgggaacgacuuuauuucuucuuaaauaaugugaucaacagcauaccugacaagcaggcacguugcaccuugaaucaaucagcaggaaugcaaaagcauacaaagauguaagcaacagugcaucugagaaacagggagucacagagaguaaugaucacaccugcaauuugucaguuaccaacugucuuuucuucaucuucccagcaugacuccacagccccaaggccccuguuugcuccucuccuaggcaugcuacccugaagcuccggugacaaacacugguggcccaucucccuuguaaacagccagaaaggccuccguguacuguuucacacucuuccacuucucaugaagcaagagaaaagagcuuugcagcagagguggccaguggagagcgcucccaaccaguagcagggcugccugagucacuaaggucuuagggcccagggcagaacccugagcuuccuucccuggcauuggcacagaacccacagugucuggaugggcauuuucagauagaagugggcccccccucccccgaaaacauuaaaacagaggauuuaaaaagaaaaauuaaugcagagaccuggaguggucauacuggaagugcaaaugguaaaaacuguccaacaacagaguggucuauuagaaauauugucagaggcuaacugugacucagcucaggcagguccuugaaauauaaccagaggcacuuuggacacacagacuuuccaaggaucggcugcccugugcauccuugucaagccacagauaccugcucuggaguggugccuggcacagaaccuggcuugcgacccugggucaggaggcacucugugaaggacggagggagcccagagagggccuauuuccucacacaggccuuccuaccgcaaacccacccuuguuuaaaagaugauuuaugucugcauuucacuggauaugcccugucaccagaaaugcugucugucccucuauucucucuacguaggcuauaauaaacaguacacagccagcgcaacaggagagcagaaaggccgagcucugucuccccacaaggaagcgaaaucagcaaaaccaaaggaaggaggcaaacgccuggggaugcaggcucagcugcugaugagagcuccugucugaccgugagcaacucuccuucccucucagguucucacacggaacugacccgacagggcgcuacugucuaugacaauuaccccaaagcuggcgcucccaacacauggggcugugcuguaagacucuggcacuggccaccagggacagaacuagacauaggacccaaagggacauucagaguucugccuuaggacaucuggaacucaaaugaaggggcuaguguacaucucugucugggggugggguugugggggcugagacugagaaugccaaguggccauauucucugccugcuuugaggauaaaggggacagggcaugcaggaaggaagcuggcaccugcuaccagguaaaauucgauaccacuugccucacaugugugcaaauggucuguccaguaaauccacgugacacuuaagcacggugagccucugugcugcccuuuguaagcaaaagucuugacugaagugagagggcuggaagugagaacaagggaugucuucccaaucucaaccuaagccagaguacacagacucuagacugugucuucagcugaagcagucgaggaugcaaagccccagcuguccuaugcaucccugaggccccagcaaccuuaaaguccugccucccagacguuuacaaaacuaaacaugcaauuaccaugggaucuagcaacugcacuccugggcauuuaacucagagaaauaaaaacuuuugugcacacacaaaaaacugcacacaaauguucaaagcagcuuuaugcaaaauaacccaaaacuagaaacaacccaaauggccuuguaugguugaaaauaauuaugcuauauccauauuaugggauacuacucaguaauaaaaggaacaaacuauugcuauauacaacaaccuggauggaccucaagggaauuaugcugaguggaaaagaagccagucucaaaagguuaccuacuguaugagcccauuuauguaacauucauacggugaaaaaguuacgcagauaaagaaggcauuagugguugucagaaacgggguagggcgaggaggagaaaagaggcuugaccuauaaaagagugacacaaguucuugguugugauauauuacaguuaugccagauauuaccacuagaggaaacugagagaaggcgcuacaggaucucuuuguauuauuucucauaacuguggacaucuuuaauugcuggaaaauaaaguuuuaaaaacacaauacaaaacugccuuccacucaaaacuaccacgaccuucauuuugaauaucacagaaaaggaguuucaugguauuaaacaaauauacacaacauaaaaacacaggaaauuauggaaaaaaauaaacacuaucuggaguaagauaacaucaucguaccuucaauuaagucuguauaucuuuuacauaugaucuacagcauucauuucaggaaaauccaggcauaccagaaaccaggacgugaucauaaaacaagacugacuucuucccaaaaaacucaacagaaacacauccacggaaacagaaccaccaagagucuuuaagggaccaaaagacugaauaggaaauuuuaguuuccaauuagcaaaaauaaccaaaugaaaacuccauaacagaaacagagaacaaaaaugcaugaauuuaccagcagauuauaggacagaagaaagaaauacaaaaguaaaaaauauaucagaaauauauagcuagaauaaaauacagagagaaaaugaaugaaaaauaaaguaaaaaaaaaaaaagcauaagacauguaugugaugugggccuaaggucuaacaaaucuguaauugaguuccaaaagaagaagagaaagggaaugagguagaaguaaugauaacggagauacugucugagaauuuuccaaaauauuauaaacucuaagcaguauagaaacaaaccaaaaaacauacauugagaucuauaaaacugcacucagaugccauuucucaugugauaaauuuucaaagguacaaaagucuggcaacauaauagguuggaaagguuguggagaaauaagcaggcucguuuauuucuggugagauguuacaauucaauaaccuuauggcauucaauugaguauuauuuaccaaaauugucauaugcauuugccuuccaauuacaucaacccacugcaaagaaucuaucaugaagacacacuggcaaaaccauguaaaguugugugcaugaggcuauagaugaagcaccaucuauaacaguaaaagaugaaaaaccaucacacgcccauuauuagaggacaggugcaagaaaauaugaauaugcaugcaauggaaucugcacagugguaaaaagugaugagaaauaucucuauauacuacaacacgccagucuccagaauacaaaguuagauuuaaaaagcaguauugauguucccauuuaauaagaaagggaugggaauacaaguauguguuugcacgcaucugugugugcguguuugugugguguguauuuacugauauuaaaaguuaaguuacaauauauaaacaacaaaugaauaaaagugguuuccuguagggaaagguaggggcagaagugaaaauacuaugaaaacacuugcuuaguauaucugagacacauuauucuaaauaaaaaagugcaaucacuaaaaaucaaaaacaaaauaaaauuauccuaaauaucaaauugaugaguuuagcuacaugcaaggauucaucucaagugccugagaaacaugacuugauuguguaugucugcaggauauauccuaaggagaaaacaaacuuuuaaaguaacaauugguauuguuauucugaaacuauuuuaugugugugugugugugugugugugugugugugugaaauauauacauaguauaguauauacuauguauucuauauuaugcuguauauuacaaauuauuauauauuuuauauauacauacaaagcaacaagacaucauguuugugucauuagggacccaaauuuucaguguaagagacaaauuacacauauaaaaucaaagaagguaacuaaaaucuccauaauccuaaauuggaaaugcaaauauaguaugaauucauguugauuuuuuuuccuauggaaaauguauuuccuuacuuuacauccuggugcagggaaaagagaauuaaaaaaaagaaaauguauuuccuagcucugcccacuaaaaggcuuggaaagaaugaguaacucaguugcagugagcacccucguuguccagauuaugauuucuaaauaccacuucccacuaaaagcaacuauauauucuuggcuuauuccagguuugggauggaaaauguaaaagaucaaccugagauauuuugucacaucaaaaagaaagccauuaucaaagacuacuuaagcagggugguaaggacccaggaauccaccugaaaagacuccuaguggaacaagauggaagaauuuguucagcaaaaagaaucauaacuacaacggacuuagacacaugaaaauucaugaagguauuaaagaaaaaaauuuacuggucauccuuggaggaugccagggaaccaauucacuauuuagcaaauagauaauuaaaaugaaagagacaagcauuuauccuuccuuuccuuuaauaaacacucucaggguaccaucuauuuuaugaaaaaaguuuccaucuuaugaaagaauucuggcuaaugaaagcagacagaauaacauaauuagaguaaggauuuuuuuaacuccaaaggaauaaugggucuagucaaugaucaucauuggcugccauaacaauuaggugaaaaacuacuguauauugaaggaaucuggauaaaugcuggcagcaccugaugccacuaaucaaucuucacguuauaagagacagaaaaacaugaugugcuugcuggugugaugcaaugggaagaacaccacaccacuuaucagguauucuugcuaaaaaacaacaacaaacauacaaacaaacaaaaccugaaucucacugagucuguagaucuaucaguuuacaaaaguauagcagacagaggaacacguuaaauaacaccauguggauucaaucugcaaaauccagaauguggaauuuccuacagaacuugaacaaacauugcaauauaaauuauaaggaaaaaaaauggggagccuggugcaguggcucauuccuguaauccuagcauuuugggaggcugaggugggaggaucgcuugaagccaggaguucaagagcagccuggccaacauggugagauugcagcuauacaaaaaaacuaaaaauuagcugggcaugguggugcacaccuauaguccuagcuauucaggaggauugcuugagcccaagaguucgaggcugcagugagcuaugaucacaucacugcacuccagcuuggacaacagagugagaucauguacuucaaaaaaaaaaaaggccaggcgcaguggcucaugccuguaaucccagcacuuugggaggcuaaggcaggcagaucacgaggucaggagaucaagaccauccuggcuaacacagugaaaaccagccucuacuaaaaauacaaaaaauuagcugggcuugguggcaggugcuuguagucccagccacucaggaggcugaggcaggagaacggcaugaacccaggaggcugaggcaggagaacggcaugaacccaggagguggaacuugcagugagccgagauugugccacugcacuccagccugggcgacagagcaagacucucucucaaaaaaaaacaaaaagaaaaaaaaaaagaaaaaaaguaggggugucaaccuaaagauuaucggaaacuuacuagauauaacaaccaaaggcaauauuuuuaccuuguuuagauacuaaguugggcaaacuauaggaacuauguauaaaacaacauuuucuaaggaguaauaauauagagguguuaaaaaauucuuauuuuuaagagauauuuuugaaugacaacugaaauauuuaugaacgacaugauauaaugccuaagauuugcuucaacauaauggugagaaagacaaagcugggaugauaaaucuaagaaacuuagcuaugguugacagugguaaaggugaacgaugguuaaaacagagcuguaguauauacuacauaauauaauaguaauaguauaacuacuauucuacuucuguacauguaugaaaguuuugauaauaaaaaguuuaaaaacaaagacgaaaaagcacugagauuauaucuccacuggagaaaaagauauguuaccuucaacagaaacaaugaaagcuaaaagauggugcaauaauuaucuuugaagugcugaaagaaaucaacugcuagccucaaauucuaaaucugaauuauccuucaauauugaauuuuugaaauaaaauagauuucuuuuucagacaaacaaaaagagaauucaaaaacaagcagacccagguguuucucaagcagaaaaaaaaugaccacagauggaaaguaagauaugcaucauuuacuuuuccuggaaaugaacacgauucaggccuacacauggaguuauccgagggcaacacaggaaagggggauugcaguagacgcaucgggcugagcccagugggaagccagcuggaaaaagggcaugcuaggacaccaucaccaaccagaggaaaacacuugcccugccuuuugaggaugauuugaaaguggggagccagccucaggcucgugauagcccaaugauaucagaucaguucacugaaagacugaccugcuuagguaguuucacggagcccagauagaggucuuucaggugauuccugugacaaagccaccaucucacacauaacaggucgucaagcaggaggguuagacuguggaagcacacucugaagaguauccucaaauccuccaaaucuucccacuggccagcagcagcuccauagggacuaccagugcccagaagauggcaugaccuuggcggucugaccgcaccuuccacaugaccacucccugcaugccucacucucuggacauggcucccugcuaagggaacagaugugcaucuaggguccucagcacggagucccacucccaccuccagagugaaggugcagugguacuggaacagccugugaaguaucagccccacugccaaagccugaagagagaagauaugggcacaggccagaaaguucuacaugaaacagucagcgauggccauuuauggaggaugagccauuuacuucucaucuuucacuguuuuccauaauaaacauaauuuccuucgcacaaaaggaacaaaguauguugaguaugaaaucuggcaccaaaaggugugcauguuuuaauacugagcucuaaugcaaaucuaaucaaaauuaaaauaaaaagcuauuuuugcuggauuucacagaaugauuuuaaauuacauuugguagaacaauagguuaaacuacagaagaaaaaucagaaaaugaauaguaaaacagagaagggcugccagauauugauuuauuauuuauguugacagguucucacucugucgcccaggcuggagugcaguggcacgaucacgacucacugcagccucgaccuccugggcucaagcaauccuccugccucacccuccagaguagcugggauuacagggggcacaccaccucacccagcuaauuuuuaaauuuuuuuuuuguagagacaaggucugacuauauugcccagucuaguuuugaacuuuugggcucaagcaauccaccugucucagcuuccuaaagugcugggauuacaagcgugagccaccgcaccuggccgaugccaaauaucuaaaacacaccauaaagaaaugguaauuaaaacaaugugguacuaacccaagaauaaaaggugaugaugaugauuacuguuauuuagagacagggucugacuuuuucacccuggcuggagugcagugacaugauaauaccucaccauaacuucgaaauccugcccucaagugaucuucccacucuggcuuuccaaaguguugggauuacaggcaugagccacugugcuuggccaaacauguuauuauugaagcaacaaauugcccagaaauuaucccuaacauuauguuaaaaccuuaacuggaagaaccacuuuuaaacuaugaagaauuauuuaauaaauggugcuguaauaacuaguugcaauuuaaaaaaucaacuuacaugcauuuaauacaaagcauuaaauucuagacaaacaaaaaguuuaauauaaaauaauaaaaccuaaaauggucuaucaaauuuauagagggagggugcuauuacagagaaaucauuaaaaaagauggaaagauauaaauuaaauauuuguauguaaaauaauaaaaacaaauuuuuaaaaaccuaaccgaaugagaugggcaaacaccaccacagaaaaaauaacuggaaauaugaaauagguuacuaugagcauaguauaacaauguuaagacaguucucaagaaaaaacacuaaaaccaauagauuaaugagcaaaggauguaaauaguuuacaaaaacagaaacuacauuuggaaagaaaauggcugggaacuguuuuaucuugcaaaucacugaagacaugaaaauucaguaaaaauaaaacaacauuuugccauuacauuaacaauuuuuuuaaaagacaauauugaauucuggcgagagugcaauaaaaucaguaaaauccuuuuggaaagcaauuugacaauguguaucgagccccaguaauccgacuucugggaauguguccuaggaaauaaugcaaaauauagaaaccauaugcaugaagacacucacuacaauguuaucugcaacagauacaacuugagagcaaccuaaauuuaugaaaaugauacaauguacugacaaguuaugguauacccacuggauagacucucaugcagccaauaagaaaguuggcaaugaaaaugcuggaguaacauggaaaaaugcuugugauagaaugguaaguaaaauaaugcaguacacagaugauauuacaccaugauuaugaaagaauaaaguaugcauguaaauagaucugcagaaaaccaaacugggaagaguugcaaccauaauaggauuacauugugcucuuuucacuccuucauuuuucagagaagauauaggauggcuuuauuccuucuauaacuaaugaauguaaugcaucggaaggaaacuauucaguguuccucuggcaugugaguuggaucagacagugugccuucuggaggcuucaguaaccuccuuggugacaagacuacaaaggugggcccagccccuguucaaggguuugcuccaaccucacuggcuugccuggcuaugcaguccaggccuccuuucccauuucugaccugcuacuuccagcaauugcugcuuguggcagacaaggaacccagcagucccauccaagagugaggguguggaagcacagcugggaaacagaauugaugguucauuauucaaggcagccgagcagaacuuccaacuggccuucaaggccuccuuccagagcaaagcaggaggugcagcagcuggucacagaccacguaacgcuccuuguuggcgccaaacaggccccaaagaaugcucugcucucccagcacauucuaaacucucaggacagacagcccugguggggagaccuuucccugucagcucuacgcuuacuuguucuucuguggugggagaaaagagaauggaaacacaguugguaggauacacgcaggacccugcugccccucuggcagcuccccacuaucacucugcagagacugccuauccuucuucauuuuuugaaaaauaaaggcugccacuaagaaaugacaacugguugucgccaaggcagagcuugcucucaggucucacgaagaugucagaagaaacugagggaggagaauaugcagucaacugaaugcuuguuacccaaccaagaggaaaagcagguaagagcaggcagagcaccuggacuagugugaguuaaacggagaggcgggugugugcugugguuuugcccuggugacccccuuguggguguucacuggccuuuuaaaauuaaccuuugcaacagaauucuaaccacuuuucauuccugcagaucacccugaugggcagaagugucaaugaaucugagaacaagccugcuccaagcaggcugcucaauuucuaaagcgagaggaaauccugccugugucucucaggugagcugcaggccaccuggccacaucacaggaccucggagaugcaagucaacaagucuaugccuuuguccucuuuuccauccagcacacguuucucccccaggccaaugguuuagcuuuugggacucccccaacaggacuucuuucagagugagagaugagagacagagagagagagagagagaaaagagacagacagagagagagagagagaaagagagagagagaacacaagagugcacccuuacccaagcaaccaaccaagcugaaagcugcaaguucuucuguccucuaauccaagcuuguccaacccgcaacccacaggucacauguggcccaggauggcuuugaaugcagcccaacacaaauucguaaacucuuaaaacaugagauuuaugcacagaucuuuuuauuaguuuaccagcuauuguaguauuaguguauuuauuuauuguguggcccaagacaauacuuccaacaugaagccaaaagauuggacaccccagccuaaucccaguacugaugcaacaucacugaccuacagggaggccagcauucuccuaaucccugccucccuguaccauggguggugccagggagcuguacagagcuaagucagcaucuacucaucugaauugauaacugcccugcucccaccauuucucaaaucaucccggucaaaaggaaccuggcucuugaugugagaucagaguccaugagcacagaucaacccugcgugucuucugcugaccucugacugccacaagccccuggggucucccugcagcaaugccaaugaggcaugggguccugaggcaaggaggaaccucaucucuaauauguggugaggcuccuucagagacaccaagugugugugcagcacuugugacccacucccagggacaacagauuccuugaaaacaaugaaagacuucccuccugaugccuccuggagugaaacguccuucugaguucuuccaggaaggucaagaauggucccauucccaauucuccuggcaaaggcaguguuuguuguuugugaggcucuccugugucauugcuguguccuucugcuuccuaaacucuguaucauuuucucaacaagccacaaaacuacuugagcccauuacaauuugcuaggccacggcucgaugagcuaauccuucuuucuugcuaacuuucuaccaauuaugauuuuggcaaugcauuuuaggaaagcccgagcuuuaugaguuugcuucuuggaggauguuaaacaaauccacuuuucaauuuaaaaauaaaacuguaugagugaggcaaagcccuggagccuccacuuccagccacguuggaaacacagaagcaaagucucccucacaaaccaaacaaggaagccaaggcuguuauuuaaaacaaauacuugcuaaauggaaauauauuaaauauggcuuuacuguaaauuccaaaggaguaacucgcuaaacuaaauaguguuggugauuugcuaacucaaggaauaaaauauggaccaugggcugacgugaucuucacuuccuuugcacuauuuuaccaaugguaaaguugaaaauauuccgauguucuuagcguggaguaaaaaaugaaaaaaugaaaaggagaaaaacaacaaaaaaaagacagaaagagaucugcaauucuacaccagcacaggugucgacaacaguaugaaaccucucagaacacagugaagaaugguggcauuuugcauuucuauaguaagcccuuaacuuaccugcacguagcuugccucugcagccacugauuucugaucuaugcccagaauucucugauguuaaagugcucggcaagaggcuaagugcuugcaagaacaaugaacaaauugccaacuuuguccccagcaguugucaaggaugacugagcucccuucauucuggccuucaauuuugcaagugccugagagcucucugaaugcaagaugaggugaauggguaagcaugaugcugcgugaaauguggguaugucugucaaaauaaaaaaaaccuuaaaaaauguucacuaccagggcauuuuacucaaagaacaaagguuuccccuuuuuacaacauaaaaauauaugaaggccgggcgcgguggcucacgccuguaaucccagcacuuugggaggccgaggcgggcggaucacgaggucaggagauggagaccaucccggcuaaaacggugaaaccccgucucuacuaaaaauacaaaaaauuagccgggugcgguggcgggugccuguagucccagcuacucgggaggcugaggcaggagaauggcgugaacccgggaggcggagcuugcagugagccgagaucgcgccgcugcacuccagccugggcgacagagcgagacuccgucucaaaaaaaaaaaaaaaaauuauauauauauauauauauauauaugaaauaaaauuuuaaaaccacuaaaaugucuuuaaaaaaauuaaugcauucucaaagugugacacuugccucaauuuuaaggucacuuuucucgaacucuauuacauggcgauacuaagaaaacgccacugcuuugaaagaaugagagaugauggaauaaaacaaacauugccuuugcaugugauaauccuuuauaaauuaccaggcucucccauucuugccgagggcaccagccucgggaacugaacugccaccuuuucccaacagagcugcagcccaggcaaagcacugaggucugaauacaccaggcugggaggggccuuuguucugugcugguuuuccaaagugcguugugaaaaggugaggaccagcccuguagagaacaguaacauguuucuuuauuugaauuucagcuuuauauuuaaccccaaauauuuacucaaccggcagaggguuacaauugguacagaaguucuacaucaaaacaaguagggaaaaauguuucuccaagcgauuaccuuauuggaugaccucaugccuuugucuauacagaacacggacucuggagucaagcaaagcugauucuucucugccuuauuagccaugugaccuugugugagauacuaaaucaguauugccuucagcuuccucaacugaaaaauaaagaucauaugaccugcccucuuauggcuauugagaggauuucuuaaaaugguacuuguaaaguauggccugcccuaaagacacaauaaauaugaaaugcuuugauuuugauuuucauuaccuuuaauaauaauuugugagaaauccaccuacaagucuaguaauuuggggcauuucaagcuguuuuaaggcaccaugaaugcuauuuuauugugaaaaagccacguguguggauucacacccccugauaggaaacgcuacacuggaaaauuauuaauuaacuauaaaggaggaacaacagaauuugucaauuaaccaaaucaaguauuucuggaaaacccagacuguucauggcacugugugucucucauggggacaugguaggcaccuuagggccuggacaucaugcuggcauuucuggugaugaagacuucaggagucagccugugcagguauuaauuuuugccccuaucaccuuguaaguaacagaucuaaacacugucacucugauccccugcuugucacacagaaggaagcucuuucuauuugauaaacauugcugagagcaucucauggguuugcuaacaauggugauuacauuuugccaagaaacaacacaucuuuuugaagaaaaacaaaguuaaguuccucucuccuccucucuuugccucccugugcguggccagccucacagccugaguggugcuuugcugggugaucagguacucuggcucaauagccugggcuuugggaagaauauaugucuuuucaguuaaaucagccuucuuugguaacuuccugaauucagccagcugcaacucccucacccuugcuuaauucucucagauuggaugagagagauuagcuggaaaagggagaacaaaaccuucugguccagugaauucuaguucugcuugguuuauuuuuuuccccucagaucuuaauaaaacuuagucucauuuucugaggaccugggagcucaccaaccugcccucuuugccagguaaacaaacaguuaaugaguggcugccuuacuguaccgcaugcuaacggucucuuggcuggggaaagaucuacacaauggaguuucccucucuuuccuuuuaaaagguaacuacagugacucaagggacagccaugugcaaauuugcuuacacuggacacuggccagugagaauauacuuuuuuaguuuaacagaguguuuaaaaauccaccuaacaaggacagcaugggguuccacugaauagcuccccuagugaugugaucauguggugucuacagcuaagagggaagcgugugcgcauggauuagugaguggacacagcugugugcgugcuccauaccugcuuuauaccaaauaaaucuguuauuauaacuguuuuaaugaaauauuauauaaaauagggcuaugaaaagaaaguugacuuuuacaugaaaacgaauucuaaagauuugaaaagauuaaaaagaugacucacuugaaaaacugcugucaagucagaugggugagagacaacuuaaaagacucacuaaaucuaaaaagcguucaaaucguuucaucgauugucuucaguucuuuuuuugagauggagucucgcucugucacccaggcuggaguaccgugguacaguucuggcuuacugcaaccucugcgucccagguucaagcgauucuccugccucagccuccccaguagcagugauuacaggugcccgccaccacacccagcuaauaauuuuuuguauuuuuuaguagagacgagguuucaccauauuggucagccuggucucgaacuccugaccucaggugauccaccugccucggccucccaaagugcugggauuacaagugugagccaccaugcccagcccuuauucaacuuuaaagguaugaaaacuggcucacagaaaacgaaggcaaacacucaucuauagaccuaucuuaagucaaauaaaaaaacaaaaccaagaaaaagcaaccugacaaaugcacaugcuuugugaaauggaucuauuuaucuauuggaagucaaaaugaagugugcaaggucuauauguauuuucuuaaugaucugcugccucaucaaaauuuuuuauuagcuaccaauaauguuuauaauuguauaggauaaaaugcuucuacauuuuuaaauggagaauuuuuuaaagucaaaaggccauuugaaucacugcugcucuugagaguaacauucuuuucugaaagggaaacugagcguuuaccaguucagcucaguucuccauauagaggcagcugagacaggaaucccuuagucauggccaccccaggcagcaaucacauuuccagcuggaccagagagaugaggccccuccacaucaacgugaucaguaagaugcaucuagucuauuaguuuuuccagcucugugcacacugacuggcugcucacuggcaccagggacauucaucuuacaucucugaggaacuaggaagguaaagucagcaauaggaaauggcccauaacguuuaccaugugauuucuaaauucccugcaugcauucugcaauagaggaauuggaaaaacaauggcuucauggagaccaaagaguaauugggauaauauaggaaaaauuucauuuucaaaauuuuugcugcauccaugauuucuggggccugauaaaggagcucggagcagagguguacaaucuauaccucuaaacaaaauggaaaaaagaucaggcugccugccugaagcgucccacagcuagagccugaaauguccgugucaccaguguccgagucccugcuuuguggucuuaaaggaacagagggugagaaagacaaaaagcacggguggcgagagaaggaacaggagcccuugucuuccaggaauuuccacaaucaaacagccgauaguucuggaagacaucugaguaucacagaacugcacucaaagacagaggaccagcaaaaggaugcuuaaugcugccuguccccccuguccccucccaaauaucccuaagccaagucaaacagagaagaugcauacagccacugacagcccauguauuggaaagcuuuaagaauggugcucagacacaagucaucucucuaggggcucugguuccuauguacacagccagcaucuccacccaaccucuccaguggccacccagccaugacgcaagcaugugggagcaagucugaugagggcuauuuugagagacuggaggauuuugauggcuaauaggguuuguugaagcuuaaaagacaagauccaucgagaaauguucacaggaggaugauuuagcaugaguuauuuaaagcaaucuaucguuuuagacucuucuacuugugaggccucuccagggcauuacguaauaaggcagcaugagccgcagggaucuccaacgcggccuguacgccaugcgugggcauuagcggggaaauuggugaaaggugaaauauuaauauggccaucacagagauauagagaucauaauauuugacuauucucugcaccccuucucacuaauuaccugacuucauucugcaguaggaaagcagaagucacauggguuuuuuuccaucauccaaccaccaccuacaucuacacacagguugacaccuguaccucccucuguccucuccuguugcaacaaaucaccugaccuugcuccucuccaggccagccccuccuguaccaucccuuucaucuagaacucauugcccucaugaaccuccuccaucccagcguuuccaccuucacccaucauccgcucaucuccaccaguguucccaacaugcccuaaaucaacagcaaauuccuacaaacucuccugguaucacagcucccgacacaccaucugucugacccugagcgccaugaaaacccaaugaacgcccacagccagggugccuaccuccuuccaugccuuccuccaugccgcacagcaggcuggccuccuccucugccacuccacuccacugaggcagcucugguccaugggagcagugaccacuauguggccaaauccuuugguuacuucucuguuaauuucuaugcucucucucagaaauucagcacugucuucucucuccuguguuuuuuuuuuucuuccuauuacugacuccugcucuuggucuccuuugcugacuuaucuuccacugcuaaaccccuagauaucaaagagcccugaggcauuagccugggucggcuucucuucccuagagacacugccccccagguggccugaauaucaucaucuaaaucccaaauuguaccuucuagccuuaccuuucuucugaacgucaguguagaauuuccaguugcuagcuaaacuucucuauugggccaccuccugggcaccugagaauuaaccaggccacacauccacacugggggaaacaucuccacuaagggggugaaauugauucuugggaggaggguaaagaacauuuuagauauuauucugcuugugguccuccaaagcacacccuaccccacaaauucuuauuccuuagcauuaaauuucucuucuuaauuaaagugaauuuacuucucuccuuaggagggucauaaugggaaaaaaaauaaacaggguugagaaacacugcgcuaggccaaaacagagcucgggaacacucccaccucgcaagcccgcuucuuuaucuuuaaacuuuccaccaaucacuuuuggcucaagccaaaaauauuaagacuuuuccuugauuguucauuuuucuucacuucuuacaucuaguuuguacagguucauguggccugcaaaacaugccccaaaucucucauuguuucccucuucccaaugacuaccuuagccaaagacauggccaucgcugguguagcuuauccccagggcucucgcuggcccuccaguuugcacacaaaucuccuacucccugugcucugcacaguggcccaaacagucccugaaaaacaucaggcagugacagcagugcucuguuuuaaaguuuccagcaacuuuccaucucuaaaugaaugcgggcuaucaccguaagcccagccuuuguucuguuccauggguucccuccagucccucuucacccaaaagucucuuucucauuggagguauauaugguuucuuuaagcuaaaacacaaccccaaauccaagcuccaagcagaauaucaacgguagccaggaccaggacaugcccuuucucuaccguuucugucaguauucgaaacucacuucaucaugcacuuuuuuugggagcucacaguccauggcagacaugcauuugaauacugcucugaaaugccaggaccugugaauuacaugcagaucauguuuacccccaagcguaucucauaagaaacacuuuauucuaaauccagcuuaauucucaggcugaauaucauaaauaaauacaucuaucaauuaaucagcuugcuuuuuaggucccauauccaaaucaucugcaggcuaauagcuauuuuuuuuuuuuuuugagacagucuccucuguaacccaggcuggagugcagcggcgcaaucuccgcucacugcaaccucugcgacccagguugaagcaauucuccugucucagccucccaaguagcuggacuacaggugccugccaucgcacccggcuaacuuuuuuuacuuuuaguagagaugggguugcgucguguugcccaggcuugucucaagcuucugagcucaggcaaucuggccaccucagccucccaaaaugcugggauuacaggugugagccaccgcacccagcugcuaacagcuaauucaaaauaccuuucgcacaguaugcuacagcaucagauggcaaugagauggccauuuacuuaaauaaaguagaagcaguaacauucaguuugaagaaucaaaucagaugccuggccccauaguccaagggacacuggggacagcugcaaggagccagcuuggaguuagcagggagcagggaacuuccagagucugagcuaaagcugccaccuaucaaauccugcacagcugccuagacuuccuuagcuaagguaaaggaaggcacacagcaaaagggugaagggugaaugcugggaagcuccucaaagcaauaccaaagugggagguauuuaugguucagccucgguccaaggagcccagcccuacauccacccacugcaucucaguugcagaauucaauuuguuaacuuaggauuuucuggcucuugcaggaaacuucacuuuaguguuuuccccugaauaagaauaagaaaagaaggugaggccgucuagcauaaccacagaacagaagaggaaaggugguugauaugguuuggcuguguccccacccaaaucucaucuugaauucccacguguugugggagggaccuguguccccacccaaaucucaucuugaauucccacauguugugggagggaccuggugggaaguaauugaaucaugggggcaggucuuucgugcuguuccucuugauagugaaugucucacaagaucugaggguuuuaaaaagaagaguuuccaugcacaagcucucuucucuugucugccaccgugugagacaugcccuucaccuucugccaugauggugaggccucccaagccacauagaacuguaaguccaauaaacucuuucuuuuguaaauugcccagucucaaguaugucuuuaucagcagcgugaacacggacuaaugcaggggugcuccuccaaccucuuugccaaaccucugcaucccaagcaauaucacugaggcaacagcagcaaaccagaaaagcuagaaaaagagauuuuuucugucuauaaaaaauagauugcauguugagaaaaguggcaggugcuaaaagcuacccauucagucagccagcaaaagaacuccuucccuuucgggguaugguuaauauuuauauuuacaaacauuagcauuuagcagaaucuaucucuuccuaggacucuguguguccaugacauggagccgguagcugccgagguuugagcaugaagaagagcucacaguggugucucugccaaagcauggaggaaagaggcuucagugcaggucuuuuguuuugaaacauuagaauccacugaacugaaaagaucaagcugucagaguucauuuucuuccuaaaucaaccaaacugcagaauaacgcgaauaacacaaaauauuucacuuuacaacauaauuuguaucuucaauuuacuugcagcucugggaauuugacagguacaguauuaaguaaaaaccuucucugaagucuuaugggaaagguugaccacaaaacagcaaguaaucgugcacagcagccuuccuccauccuccugcaguugugauggaacugaugucaugcaguuggcugaaacguacaaacacagaucgcccucaugcauuuuggugguaaauuuagaacaacauucaauuaaggaauuagcucuggcuaauagaucuuaaagagaauaagagguauuuguucacugcauauuuauagcugcaauuguuucuuuguggacucaaauauaaaaagaguaacugccuuuuauucuccaaaaugaacugcuacaaaaguauuucauguauuuuauugguucacuuuguuccuagaacauuuccuagggauacaccuucuuucagcccagcaguuacacagucacugccuguugagcaccuacuguguguuggguaaugggacaguguacagugcagccacugaaauguucagaagagauaucccccccagugccaaagacccaugcacaaaugcacaaaaucgcacaugacaaauauuaagugccacacagaagggucuugcaugaaaaacaauguauagaaaaugucacaaugcuguuaacauuucgguuccauggaaaaauuacaauuaaacauuaucauuuuuuuauagaccugaagauguauuacauaagugaauuuuuaaaaauuuaaguauaucacagucaggcuuucuugaagauggagaaaguauauuauucaacuuuauuuccaauuucguguugaaaaaauagcaggagcuugacaaagaaugguggaauugcauguuugguuuugaagauaauuuuauuuuuuaaacggcauuucgugaagcuuccacauagcaagcaugcugagccuugcuacccagacagucaccagcaggugaguccauucagguucuuucugcaagugucuucaaaagacauuuuaaaugucauccaacaaagaacacuauuaagugacaaaaaaaaaauccugcagucacugaguggagaaagauaucuacagcacagauaccugacccaaggaucuuaucuagaacacagauacauuuauauauguguguguguguauauauacauacacacacacacacacauacacacauauauaacuuuuguuaagcauagaaaaaagggacaagagucuugaauacaagagaaaauaaugauaauuucucaaaaauaaaaaugugcucaaccuaaucagauauuaaggaaaggcgaguuuaacacaaucucacuacacaccaccagacuggauaaagaaaaaucagucugauguuacaaaguaugacugaggcugcauagcaacaugaacacugcuugggggacagggacguguaaaaagguagaaugaacaacucuggacagcagugaagccuucucugaagucuuguuggaaaggaaguuggcagcuccuacagaagcugaagacacacagcuccccugccuacacaccacugcacauccaugagaauggcuaaaaugaaaaauaaugaccacgccacacacaggcaaggacacugggaaagaggaaggaaggaaggaagagagggagggagggagggaggaaagucagccauguggcauuuucugugcuggguggcacaggcuggcaucagcugugauucauucaguggagcacgaaaucaauagaaugggaagaaugugaaauuguauuuauuuacuuauuaagugaaaagggauagaauggaugggauggaauagaacagaacagaacagaauaaaaacaucggagggcucugcacaguaaggaauucucgcugaguuacaccuugaugggggugggaagugcaucgagcagugauuggaaauguuuuucuucauuggaguuuuguucaaacacguuuggaagucccugcuuagcuuuucuugccagacaucgggagccuguggaggugcggccaggacugagauggacacugauuucagaggaagacaccccugccacaggagagaaggauggcagcucggaggaggcgcuggggagcuggcuuccggaacuccaguccuauccacuggguccuguguaugauuggcucugagggugggagaaggagaggaggcagguggaguccccgguuccugagaggcucuguagacagugccacuuacuguuaccaaaacugagcguggucaggagcuggcauucauucacugaggaccuccucgucaagcucucuauucucguuaugccaacggggcuucccaaggacugcauggguggugggcgucacuguccacauuuuaugugccuggccuuggauguggcuuaagagcaaccaguucugcagucucuccugcuacucacacagggggcccggagccacucauucaaccccccugaaucucagaaccucaucugcacaugagggacaacacaggauccucucuggggacugcagcucuguccuuccaagaugccagggcagacaggaccaccauuuuggugacuggcuucugaacagagacaacugcacaagaccuaugcuugacagagugucagccaugucacauaaagcaauucacaaaugcugcuucuaggaaaacagcaagcaaaauggguugacuuaauuaccuauaaaucaagggaaaccgcaauuugaauauauacaaauauccucacaagaagagagugaaucuaugaaagcaaagaauuguauuuuuuuauaauguaauuucucaauacauguacaaagugcucugaaucuccagggcaaugucuaugcuucacacccuuaccugugggcucaauucucagauucagagggacaaugacacacuaucaugucaucuucauaaaaauggagggggucacagacauggcuuguugcaaggucacuggaggucaggcucugaacaaagcaccccacaugcgcuuucucauuuauucccccaaaacacuccagcgaggcuugacuucugucucuaauuuacgggugaagaaacuacagcacgggguaaaucugcccaacacuaaauuuacaaagcucauaagugguggagcacggauuugaccugacaaacugacuccagggcucagcuuccaacccuuguacugaagguggccucuggcugggagagguagagaggaaaggccuguggcuacucuuucaccccaggcucggcagaauugggguguagaggcuggcagcccaagcacccugagaacaggcucuugcuaauauuuucaacgugugucccacaugccaggcaggacuggaggcagcccuggcauguacauucaugucacugugauuccaaugccaucuugcucccaaacaccaccccaaaucaaagcccacaaaaaucuccugcaaagacacuggagccccuggcagagcgacuuggggaaaccaccuccaauucucggacaccccccuaauaagugaagaccaguccuaucuucagcagcuagcugcuauuauuuguucuagagggcgcugguuuggcugaggucacauggcagagaaggguggcugagaaauggggaaacaaggagaagagagucacugcaauaaaucacauauauuucuuucuuucuuuccucuucuuuuuuuuuuuuuuuuuuugagguggagucucggucugucacccaggcuggauggagugcaguggcacgaucucggcucacugcaaccuccgccuccuggguugaaggaauucuccugucucagccuccugaguagcuggggcuacaugcacaugccaccaugccuggcugauuuuuuuuuguauuuuuaguacagacaggguuucaccauauuggucaggcuggucucgaacucccucggccucccaaagugcugggauuacaggcaugagccacugcacacauauuucuauguauuucuaacaguuacugagcaucacugagacucuggacucuguuuuuucaucuaucacauggagacacuagugacauuauggaugaaaugacucuuugcggcagggggcugucucgugcaugaaaagauguuuaguagcaucccugguuucuacccacuaaaugccagcagcccucucuucccaaguugugacaacaacgugucuggacauugucgauuuuccucuaggggaaacaacuguccuucauugagaacuaucaaaaagacacggaagacacagccuggcaagccugcgaggacucaguucacuuggcugccucuuccuccuguucuagacguaaaagcaccacaccagaggguccuauacugcacagaccuucuuccaagucccaguagcacaggagguuaaaacuuagcaugagaggaccgggaggaggaucauaauaaaguguaucuccuccauuuugcuuugugcggagagauguuucaugcauaaaauagagagggcacuuggcuucgguccucguaacaugaagugccuccuccggcauuaagugccagcgggaugcggcaucaguaccagccaggcacucccgacgaggugcgcgugaucucugagaauucuuaaacagacuuugcccuuuucaaacuuuccuuuaaagcaagcuucccuaaauaagaguccugcugagagcucuucaucacugccacuccuuugagaguagguugauuuuucaucucugaauuaaaauuuaaaacaggcaaucugaauaagacgacacaguuuaaaauaucuaggcuaugugcaauacauugguuauaaacaaccagguaaaacucuggaaauuauuuguuuuaguuauuaagcaaagagcaaaagcagacaugaaauagaauaacuguuauggaaaguaucugaaauaauuuaugacuaggccuuaagaaugaacagaacucgaacagguagcauuuggucguaggucaguuuccaucccaaggugcagugggcucugauacaccaucugcaaccauaucuaggcccaaaagcugcugagagagaacugccaaugucccuguguccccucuaaaagcaaccucuggagauaaaacuaaaaugauagacauagcaauguagccccagugggguccuuuuccugcuggaggguccagagcaucauuacuggauccaagucaguaucugucuugaaauccugaugcaucacaauggccaacacagcccccagaaaagucucauguguuucucugggugacuugccagaaaugcacucagguacagcccaaguuaaccagccuaggaaggagaacuguggcccuggugccugcaaacuggggacucugggcugugaaaugucucagguuaggccaguuuucuuggagaggaagaaggcucaaagagcaauauuauuaagugcaugagcuguaguaaaaugcagguauggagaacucuagggaaaucuucauuccagaauguuuucacuauacugaguuucaauugcuauuuuuuucaccccaaauucucagagaccaugcacaucucaucgugagcaccuggcuggcguuaaugccacauuccacuggcacuuaaugccagaggaggcacuucauguuaugaggaccaaagccaagugcccucucuauuuuaugcaugaaacaucucucagugcaaagcaaaauguauagucaguacagucuauauauauguguguguguguguguguguguguguuuugguacuuagcuaguuguguuuugcugucaacaacugcuguauacuguuucaaaggaaaaaaauaauucuaaagugugccuaaaaucaucaagccauuggcugugcaaaaccucaauaguaagccaauaaauauuaaaaauaaauuaaaugagaagucacaacaucaacuaaaauccaggcuucaaagaaaggaaaaaagauguuaagaaguaauaauccaagaguuucucaagccccaaaugcuuuauaaccaugauuucaaccugcacaaagaauauucaacuaugcacccuuaauugggaugcagaggugcuucucuggacggagguagaacaggaaagaaaacacgcaguccuccugacuuggccauccacagguugccacuggugccaugguccugggggcaggcccccugcacgugggcacuaauuuuucccucucucccauccuaaggcaagcggugccuuuccccugauccaagcccucagcucaguguggucaacgacucaaauuccuucacggcaacgaaagcaaauggcaaaguaccuacaaacagccuacccugcaaauuugccuucugagcaccaacacgacuuauccuuaaggaacuggcaucuccaagguggaaucccuuucuagggcuuaaggcccuuuccuguccugacuauaagccaaauuaauuuuggcagaaauagcagagagcuugccauccuggacucugauacaucugguagauaauacuuauaagugaggaaaugcauucuauuuaaaaagggagaaauuguuaaguuacagaaauaagcauggacgauuuuccucaugaaaggagcugcaugugauuaugagguguccauagacaucauauauggcaggcuggugaaaauguaauaugcuacgucaauggauugaggaaaacacuuccugguugaaagaaggaugaaucauggggagaggaggagaggccacagagaaaugagccaaggugguugucaaaaugaggucaagagaucaaaauccuccauccuuugcagacugcaagcaucauccugaucuguuugggauggucuccauauggccaugauuuuuuuuuuuuaauguguaacacacagacacuggaaauaaauagcaacaugaucucacaaacuccaaaucgggaugaaauuucaaaguuugaaaggacaaguauaagauuaauugauugcagauagaacaaaaccaaacaauaguuuuugacugacaaucucugauguugaaauggucaacgacuagacaagacugaauggaucaggucagcuaaauccccuucauuugaugagcuagucuuucagacaaguccaauuauaaccaaccacuguuauaaccaacaugcugacugguaacaucuuacgcauuuccuaacugagagaauaaucucuucuguuuucuaugggcagaauuuugaauucucaacugauuccuucccuaugaucuucuccuguucagugucuccuauauaaagaucuacaucauggccgggugugguggcucaugccuguaaucccagcacuuugggaggacaaggcggguggaucacuugagcccaggaguucgagaccagccugcgccauauggcgaaaccccaucucuccaagaaaauaaacccacaaaaaauuagcugggcacggugguaugugucgguagucccagcuaccugggaagcucagcugggaggauugcuugaacccaguaguuaaaggcugcagugagccaugauccugccacugcacuccagccuggacaacagagugagacccugucuuggaaaaaaaaaaaaucuacauuguaaacugccagcuucccgugauaaauggcaaggaucauuuucaccaaccagugagaacccggcaaccgucuuauuugccuuuauguuuuauccugcagucagcuuugaguauuucaacuucuagaaagcaucguuuucucuacaauuuuacauauucuauuuuauauucauguuauaugaaccuuuacuugcaagacauaccaaguccucuaugaaagugugugggcuucaaaacacuaaucauuauuucccguaggucccagccuagccugaaaaagaacaggaagucucaaacacaaaaccuaugccaacagagaggaaugccuggaagcgauugauaaucacaguugcaaacuacacuagcucugaggaaaugcaaaugcugguuucaugucuuuauuauccugagagcagaggguacaguaggcagggaggacuagggaagcugugagcuggaguaguugaauuuuuaaaaauuccguuacaagucucaguagcugacaacuguggauaagguuuuguuacacgcuauguagucaauacgaacaagaaagucuaauuccaaaauagggaaaauuacauucaguacuggccucucucucacccaccacauguuguagaaaugccuuucucaagcaaaaguaaagcaguuaauaagaaacgguuucuucgaggugacaaagggauucgguuuaccuggcagacucacuuccuaccaggucauuccuaucacuuaaaauucuaguagggguuauuaguacauaaacucaagcacccuacuggagcacgaaggcaaacccuaagacuagaagagacacaaaaauucaagcaaguggucacauucucauuaacaaccaaggagaauucuaugauagccaugguaugauugcuggccauuuagacuaugcugcacacacaaagcgugaauccgagcaagucagcuaauaagaguuccaggauggauaccagcauguaggugccaacagggaaaggucugugcuuccaacagaaccugagagcuucagugaaaccuuagcagcugcuccccucugggaagauuauaaagcacuucugggugcuagcacaaaagcacacuucuacuguuucugugcugugcucaucuuaaaugucaucuugccaucugguacucucauauccuagagcacagcuauaaugucaggccaucgccuaucaguucccaucuuggacauaaccaagugaacaccguacuuugggauagucauuaaauccuguaauuuugauucuugauuuacaaguuauaucaccaaucuaguaagaggcaaucuauauauacacauauauggcagguagauaaagacauagaauaugguaucugcaauuuccauaagaggauuacuuuaugacaaugcuagggagacgugauuuuucuagacugcacaguaagauucgcucuuauaaaacacauugauaaauggugcauacacuucuaaaggugaagaaaguaaguagcaauguaaugaauuccacacucaaaauucacucacguaagcaguaaaccuuguggaaaaguuguuauguuuuauggacacucgaauaaagacaaaacaaaaacuccuaacacucucuugggaaauaggagaccuacuuaagaccaagaggcaggguagcuagguggcucaggcacggcucugggguggaugcucugggguuaaauuuuggcacuaacaccgcccagcucucugucuuuuggcacgugacccaaccuccaugccucaauuuucccauguguaaagugggccuaaacacagcagcugucccagagggcugcugaggguaugaaggacgugauggcacgugacauccccacagcagugccuggugcugggaggcaugcccaauguuagcucacucucagcuccagaacgcaaacgugcaaugccucacaaagaaugggaauguacagggaaagugaugcaaacccuucauuuugaagcugguauugaagcaaaggugucaaagaauacuuaagggucucucaacaagcugucuccagacaguuucaaguaucuuaccacaugaaggcaauaaccuucuucaaaaacccaccugauccagcuucuaaacauucauguuguuuauucaacacaaagggcagcauaugggggcagaaggaugugggaauaaaaguuacaguuaucagugaccaacuccaaucaggaccuaaaaugccuccucgguggcugacucuugugcugugugggcuugggagcuuguuucugcugaaugugucaacugggauaggaauauggguuuguuugagcuucugagaguaagaaucucugcaaauaaaagugucuuuacuugaaaccaacaccucagcacacagguacacacacacagccacaugcacacacaugcagguacacacacagaugagcacggguacacacacacacacacgcacacacacagaugagcacggguacacacacacacacacccacaugcacacacauacagguacacacacagacgagcacggguacacacacacacacccacaugcacacagaggagcacggguacacacacacacccacaugcacacacacagaagagcacagguacacacacacacacacaugcacacacaugcagguacacaaacagaugagcauggguacacacacacacccacaugcacacagaggagcacggguacacacacacacacccacaugcacacagaugagcacggguacacacacacaugcacacacacagaugagcacggguacacacacgcacacccacaugcagguacacacacgcacacccacaugcacacaaugcagguacacacccacacccacaugcacacacaugcagguacacacacacacacccacaugcacacacacagaugagcacggguacacacacgcacacccacaugcacacacaugcagguacacgcacacccacaugcacacacaugcagguacacacacacccacaugcacacacaugcagguacacaugcacacacacagaugagcacggguacaugcaggcacacacccacaugcacacacaugcagguacacacacagaugagcacggguacacacacacccacaugcacacacaugcagguacacacacacccacaugcacacacacagaugagcacggguacaugcaggcacacacacacgcacacacaugcagguacacacacagaugagcauggguacacacacacccacaugcacacacaugcagguacacacacacccacaugcacacacacagaugagcacggguacacacacgcacacccacaugcacacacaugcaggcacacacacacacacccacaugcacacacaugcaggcacacacacacacccacaugcacacacaugcagguacacacacgcacacccacaugcacacacaugcagguacacacacacacccgcaugcacacacaugcagggacacacacagaugagcacggguacacacgcacacacaugcaggcacacacacaugcacacacaugcagguacacacacagaugagcacagguacacacacacccacaugcacacacacaugagcacggguacacacauacagacacccacaugcacacacaugcagguacacacacaugagcacggguacacacacacacacccacaugcacacacacagaugagcacggguacacacacacacccacaugcacacacgugcagguacacagaugagcacggguacacacacacacacaugcacacacacagaugagcacggguacacacacgcacacccaugcacacacaugcagggacacacagaugagcacggguacacacacacacccacaugcacacacacagaugagcacggguacacacaugcacacccacacgcacacacaugcaaggacacacagaugagcacgaguacacacacacccacaugcacacacaugcagggacacacacagaugagcacggguacacacacgcacacccacaugcacacacaugcagguacacacacagaugagcauggguacacacacaggcacacaucacuucucugcaggaagcucccauggaggaaacacugcucaacgaccuggccucacaguacuggaauccuugauuagaagguucaggauaacauuuuauguaaaacagaaaauaaacuguagggauuuuacauucaggcugcuucccuugucaagacgucuuuccagcugcaguccguguacacgaugaacaagagaacaagguggacuuuauuaucaccaagguagacuuuauccucagaagucucauccaaucaacugcugagaggacacugagcacuguggcuucuccccagaguuucccuguccucaaaacaaaagacucucuucccgguuucuaagacgcaaaggcuuugguccaaaaugccacuguaccaaccugcugcugcagcgcggguaccucugucaggcgccauacccugugaaggggcucuagugaguaggggugcuggccagggaagguugccacugguuugcagcaaauucaugauuccaaggaauguggaucaagccaccugcucaccccagaaacaacagaauaucccaggagaagcuggacagggucucuggagaaggaaaccagaaccauagcacucccaggguugagccccagaccacuuacuguguggcuuugcaucacggccagugcugcagcaacccuuacguagcgcaggguuggcggcaggaggaagacagugaaguaggaagagagaaugaugcggcuaugauguuccaacugaaaacaggcucucaauuauaaaaaaaaaaaaaaaaaaucaugaacuaaguagauuuugacuauucccuccuaaacgggagacccucggaguaggagcgacaugaaugcaacuucagggagcccaucccgccugaccuuugucagagcagugcucacccagggccacggaauccacagccugagagccaggacgugcugcucugcugggagacccagaaggucaggucuacacguagaggagucaagagguggagagcagcauccacacgggccgccuccacacccugugcucaggcgccugcucagccacaccucugcuccuggccaaugaugucaugagaucuauggcuccaggacagcgggguuuuugauuauuguugcugauguguuugcuuguuuucacuaugugcaaaauacagccauuaaagacacaacgcucuagagcucuucagaggaaaucuagacugucaaucacaaaaguucauccuaacagagaaaaagggaaaagaccagugcuuucuauuaaguccaccauuuucuagaugacgacugagaagcugagagaaggccacaggaauaauuuaaagucacccagcagguggaagagugaggaggagcagaggucaagacccccacucugcuccccgggccagagcuaaggcuacagcaaugccagggucuccggggcuuccucaccaucuacucucagaugccaucuuugauguguggaaggagacuuccagcucaguaacaucugacgcggggugaacaucacucccucccucaugcuuaccccucggggagguuuguaggacucccgcagccacgguacacaaggccaaucugucucugcugccccagaaagcagaaaaacccagaggaggccaaaggaaaggucgugcugcuuuggauuugucgaagggaaggacaauaggcauuaaagagaggcaaagccaucacaggaaauucaauuuaacauccuagggagauacacuacacaccuaucagcauggcuaaaagcaaaaacagugucaacggcaaaggcuggaugcggagcaaccgaaucacuuacauggcuggugggaacguaaaaugguacagccauagauuggcaguuuccuacgucacgaaaugugcaauuacccaacaagccagcauuuguccaggaaggcauuuaugccacagaaccgaacucauguucacccaaaaacugaugcacgaaggcugguggcagcuuuauucguaagagccacaaacuggggauagcccagacguccuucaacaggaaaaugguucaucacacuugguccaggcguaccaugggacacuacccagcaauaaaaaggaauaagcuauugauacaggcaacaaccuaaauggaucuccagugaauuaagcaaagugaaaacagccaugcugaaagcuuauauacuguaugauuacacuuauguaacauuuuugaaaugaagcaauuauacaaaugaagaacgaaugaguggucgagagagcuuacggaugguggaguggggaggggagagguauauguggguauaauugggcaacaagaggaacauuuguggugauggaaacacucaguggcuucacgguggugguggaguccacaguauaugcaugugcugaaacuacacaacucaacacaaacacuaaugaauacaaauuaaacugaggaaaucugaguaagaucagugaaucgcaucaucgacucccuuauacacaagaucucuaugacuuccuacaacugcacaugaacccacaauuaucuccauaaaaauugcaaugagaaagaaaaacagagaugaacagaaaguucuuuuuaaaaaucccacgugauugagaauucuauggucauuguuagugcuuacagaaaugauaaaacccaaugugcuagaaaauuaaccaacagcccucacuggagauuauaaacaaggcacaaguucaauauuuaaugaguaugaagaaaaugcucaugauuaaaaaaacugaaauaugugaaaugucaacacuuugcaaaagccucuugcauggagcugacagugccuagggcugauacaaauauguggguaacaugagagcgcagagcgacgucgagcagaaccccugugcccaugaugacagcuaggggagauccagcuucaggcuguuuuucuccaggggacggagcucaaguucuuagagccagagcccuguguugucauaaggaagucaccacaaacucagagucccugucucccuagaacugucugcagcacagaauuaggaacagcguuugcagagcauuuuauugaagccagcuuggucuccaggcaacaccacuguucccagcagacaugaauugggagccauagaaaaggugagagccguuuuccccacacuuacuuauuuugcaccauguucaugaucacccagucgaagggguaaacguucuuuccaaugagguucuuaaacaugaugaauguuuccauuaggaaauccugaaauaaaaaaacaaaacacugaaauggcccacaaagaaaaagguaaacaugauacccuccugucaauuagauuauaaaauaccccauuuuaaaggcugaaugaacacauccugaaaaguaaugaagauauauuucauaggagcugugaauuagaccugucuuucuguuuaccugagcaccuccugucugagacggcuucuucaagaauauauucugaaacagucccugagcaugucucucuaauaguuaaagaguaaauccccaaagguuaggaauaggcauucaagcccuuucugcuucuaggaaaacaugauuuuaacaaacaaggcuugcagguuacagcuuuuucuuauguuugcucuaaaucaauuuuucaugaugaacaggacacaucagauugaauacgggauacuacugucuguuccuuucucuuacggaauuucaaaacgaaaggcuccaacagguacuccugaccaucugcacagauuuggcaugcaauaaaccauuugagugugcagccguguugccaaacucuccuagauggcagcuacauccccaaaagcuaccgaguuaugcuucugaugucuuagaugaugcuguguacuucgcagggcaacugaaaagaagcaggguuccguacacacccagcugcucuacccugcuuccauggaaugugccugacaucaggaagggguagccgguuccuagggacuccaguaugugucuaucagaauuagaagguuuccuacuuuccagagcuugacaggugcucugagcuaaccugaacaaaacaaguggcuaucccaaaaagcacacaucccugguagccccaagcucacucaacacucaagguaggaaaugaaaagacaaccgagaacugucuuagaaaaaugaggccauggucagggauugccaaaugaguggauauuucucauuuauuuaaucuccugaaucauaauuaggugcaauggcugugaaggccaagguggugaacagaauuuaagcagccaagaaagcaauucccaguacgaaguucuaaauaagcagcuccugcaaagaggcacaaguuaaaauugaugacacuaacaagcuaauguucaaaguuaagauacuuucucuccaacucuaauggcaaagucagguccuagcaggugaagucuguagugugaggaguuuggugugcccccaccauaaauaaaaugagugauccugaucacucuauuagagcagaugccuccagucuaggagacauuagugacccagacaaaaucaaguuggaaaagucaguccagauguccuccaaacucuguacgugggcacuguguccaccugcucucaggagcgggagcaucccaguccucccuuccgacacaacaaauggcuucuuuuccaguuuaauuauugaaauucauauuucacuacugaguuuccucacuuugucaagaguuucccauuuuaacgaccaggcugcauauuuuguaggcugaguaccguaauucagucacaucucuauuugcaugaaauugcuggcuuucuugaugauuacuucucaaagccuaauaauugagcuacagccucucguuuuuauuauucuggaagagaagcauauuuucccaauucucuuucuuuucuaagagacacagucccauacuucauuaguauggcucagcuguuaaauuuugguacuuugcugaucaaacaaaaugcugcaucuagugggagaugagguucugcaaggcguccuuguuuucugcauaauucacuagccauggcgguggccccuaacaacuguguuugccuugagcagcugaugaggcuuaccggacuguuccacuagggucuccaagucaacaagggauauuuugugaaaauuucaucauucaauguggauuuauuccuguugcauuuuuuguuuuaguuucuauuuauuuuauuuauuuauuucauucccucacccaggcuggaguacaguggcacgaucuuaguucacuguagcuucaacccugggacccaagugauccucccguuucaguauccugaguauccugggaccacaggugugcaucaccaugccuggcuaguuuuuuuauuuuuaguagaaauggcaucuugcuauauuacccaggcuggucuugaacuccugggcucaaggaauccuccugccucggccucccaaaguguugggauuacagguguaagccacugugcccggcugcauguuuuaguuugacuauucacaggaugucuuauacaauaagcaggcugcucuaauagcagccauccaucugcuucagaggcaaaaucgugucauaccucugucugcaccuuuccaucccugugcccacccacuagaauaaaacagccauccucucgcaccuggacugccacaggggacuccaaauccaucaacuuagguccauccuuguccuuucuuguccccaugcuucacuuuucaaaugacaaaucucaucaaggcaucaaugcuuuccagacaucacacugaacccauuuccccaauggcuucccaaugcucuuagacuaaagacaaagcaucuucacucuuagacuuaggaaauuuccauucugcucagccaaaggaguaaccauuauggacaaggaccagccacagauuuucaacccauccgaugaaggauuguuagggaaauaggacauggccacauuuuuguggauucaaaguuuuauccaaagauuaucugacaauugcaaagguaggaagagguacauacuuucacaauggagggaucuggaaguuaccagcuuugaacccaguggugaaauucagcaucgccaguagugggucagcaugacaagcccacuuccuguguuacuuccugaaguaacacagcaggaagcuuucgacagcaaugcugaaacacucuugccaaggaguugagcuugaaucucagaacaagcuucugguuugcagaacauacagggggauaaagaaaccagucgaaaggcauauuacaaggcagcacaaaaaaaguccagaaugggagauagucuacaaaagcuaauggauuggucucuucaaaaaaacugaaaagcaaugcuaugaaaagaaaauaaaacagugugauggugauggauuuauuuuagaaaaagaaagauuaaagagacacaaucaucaaaugcaaugcgugaaaaggacaaaaaaauuuggaaagaauggaggaaaucugaauacaaauggcaugagggguuguugcugaauucucauggagcaauaugaccaauagagaaugucuuuaguccccagagacguuugcugaacagcuuagggcaggugcaucccugucucucacugacugaaagggguuggcuguauagauagagacacuuggagacacaugacggaagcaaauaugccaacgugcuuucaacggaugaauugagguggcaggaaucaugguuuccuuuuuuuuuuuuuuuuuuugagacagggucucaugcuaucacccaggcuggagugcaguggcauaaucuuagcucaccgcagccucaaacuccuaggcuaaagugauccuccugccucagccucccaaguagcugagacuacaggcauaagcuaucauaccuggcuauuuuuuuauauuuuuuguagaaauggggucucacuauguggcacaggcuggucuugaauuucugggcucaauagaucuuucugcuucgaccucccaaagugcugggauuacaggcaugagccacugagccuggcuccauuguauuauucuuucagcuuuucuguauuuguaaaauuuuuugugauccacaguggaaagagaauaaguaaaacacuggugaaaucugaguaaggucagauaagcccuuuuccuugcagaaucugaugcuaacuccagguagauggugucagaauugaauugaauuguaggacauccagcuggugucagggaaugggaugcggugggagagacccacacacuucuggucacagaagugugagaguguaggaaaauguaguguguuuuccaaagccacagagugggaauuugugacaaguggcaagacaacauucuccgcuagaaguaccaaagccgucauuguucccuucuagcuaacuacagagaaucggggcacauucucugcuucuguuacugagacguggacacguggcagccagcagccccuugggcaggucagcaucuccaguguagaagauucuacagauucuuugugguucgaauccaaaaggguugggauggucucuguccucagaguucugagcugaacaugucuauuguuuuucucuucuggaucagucauuccgcuugugcucuauaugcucacugucacugguguugauaguaagugugauuuuguaugaaaaugacucacucaaccaaaaagggcuaaauuugagaaccugaauuaguacuuguuaaaaggaaauagucucaagaaaauagaaccaaaaaagagcccgcaucgccaaaucaauccuaagccaaaagaacaaagcuggaggcaucacacuaccugacuucaaacuacacuacaaggcuacaguaaccaaaacagcaugguacugguaccaaaacagagauauagaucaauggaacagaacagagcccucagaaauaacaccacauaucuacaacuaccugaucuuugacaaaccugagaaaaacaagcaauggggaaaggauucccuauuuaauaaauggugcugggaaaacuggcuagccauauguagaaagcugaaacuggaacccuuccuuacaccuuauacaaaaauuaauucaagauggauuaaagacuuaaacauuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaaaaggcaaccuaaaaaaugggagaaaauuuuugcaaccuacucaucugacaaagggcuaauauccagaaucuacaaugaacucaaacaaauuuaaaagaaaaaaacaaacaaccccaucaaaaagugggcgaaggacaugaacagacacuucucaaaagaagacauuuaugcagccaaaaaacacaugaaaaaaugcucaccaucacuggccaucagagaaaugcaaaucaaaaccacaaugagauaccaucucacaccaguuagaauggcaaucauuaaaaagucaggaaacaacagguguuggagaggauguggagaaauaggaacacuuuuacacuguuggugggacuguaaacuaguucaaccaauguggaagucaguguggcuucuagauccucagggaucuagaacuagaaauaccauuugacccagccaucccauuacuggguauauacccaaaggacuauaaaucaugcugcuauaaagacacaugcacacguauguuuauuguggcacuauucacaauagcaaagacuuggaaccaacccaaaugcccaacaaugauagacuggauuaagaaaauguggcacauauacaccauggaauacuaugcagccauaaaaaaggaugaguucauguccuuuguagggacauggaugaaauuggaaaucaucauucucaguaaacuauugcaaggacaaaaaaccaaacaccgcauguucucacucauaggugggaauugaacaaugagaacacauggacacaggaaggggaacaucacacucuggggucucuugugggguggggggaggggggagggauagcauuaggaguuauaccuaauucuaaaugacgaguuauugggugcagcacaccagcauggcacauguauacauauguaacuaaccugcacauugugcacauguacacuaaaacuuaaaguauaauaauaauaaaauuuaaaaaaaaauggaaaguguuuuggccacuuucauauugaaauacgaaauaacaucaaauaauucuguacaaaauaaucuuuuauuuaauaguugucagaguaagccgggcgugguggcucaugccuguaaucccagcacuuugggaggccauuugggaggccgaggcgggaggaucaccugagguugggaguuggagaccagccugaccaacauagagaaaccccaucucuacuaaaaaauacaaaaaaaauuagccgggugugguggugcaugccuguaaucccagcuacucgggaggcugaagcaggagaaucgcuugaacccuggaggaggagguuguggugagccgagauugcaccauuguacuccagccugggcaacaagagugaaacucugucucaaaaaaaaaaucguugucagaguugaaaaacagucauauacucgguauaguuaacaaacagaaacacauuuuacaaaaguucugucagauuaacaacaguaaaaaaguucacauacuuuccagucuaaauuugugguauaaaaaaccacaaacgucauuuuuuuuuuuuuuuuuuuuuuuuuuuuuuugagacggagucucacugugucgcccaagcuagaaugcaguggcccgaucucggcucacugcaaccucugccucccggguuccagccauucuccugcuucagccuccccaguagcugggauuacaggugccccccaaccaugccuggcuaauuuuuauauuuuuaguggagacgggguuuugccauguuggccagguuguucucgaacuccugaccucaggugacccaccugccuccaccucccaaagugcugggauuacaggcgugagccaccacgcccggccaacaucauuucuuaauggaagucaaauugucuacaaaucauugauuuuucuaaacuguugugucuauggaaaaacauccccugggaaauugggaccacaacacacaguaaacaucugauccugggaugugagcaaagacagagggcacacacuuggaauucagcaagcuacaguaauuuuuaaaugccauucggcaucaucgcuuuucacuuaccuugaaggauccuuaucaauuacagcacuuaauaguucagauuacauguuugcacguggggacuuuuaugaagugauuguucugaaaaagggcaaaguacuaauuggaguccugacuuuuccaggugaguaauucuucuauuucugaagacuuuauuauucaaccuggaacguuaucugcaaaacuguuccucuagcuuuaagcuacaacuaugcuuuacacugaccaaagcagggggucggguguaguuuagauucaauuauggaauaaaauguuacaaauguaaaauuugauuucgcuaugccaugauuuccaaagagucaugggauauaaacaggauacagguuacacauuugaauauacuccuacuaucaacuacuuauuaauauucagggaaaaccagacacagaaauacaaacauauacauauucuuguucccuuacuuuuauuuagaggaaacugcuagagcuuuaaggucuagauccauuuuuguucuccuuagaaaucuugaaguacagucacgugcugcguaauaacauuuuggucaaugacagacuguguauaugucagugguccaaaaauuguaauggaacugaaacuucuuaucaccuagugacaucauagccauuguauuacaacugccuauaguauucagugcagucacaugcuguacagguguguagccucggagcaacaggcuagaccaucuagccuagguguguagcaggcuccaccauccagguuuaaguaaggguacacacuaugaggcuugcacaaugaugaaauugccuaacgaugcauuuggcagaauuguuaagcaacacacgacugcguguguguguguguguguguguguguguguauauauauauguacauguauauauauauguauauauguguguauauauguacauauguguauauauauguauauauaaguauaaaaauauuauuuuuucaaaggaucauuucuaauacauaauuugcuuauugcugccacuauagauauauaagaaaacuaugcauuauauauauaguggcaacaauaagaaaauuauguauuagaaauaauccuuugaaaaaacucauacagaucauucucuucuucccauuucuuaauaagguacaugucaagugcaacaaccccuguucuagaaacacuaguacacugccauguucugcagguaucuaugaguauucuuuuacagcgguccccauccuuuuuggcaccagggaucaguuucguggaagauaauuuuuccauggaccagggggugguggggcagguuucgggaugaaacuguuccaccucagaucaucaggcauuagauucucauaaggagcaugcaaccuagauccuucgcaugcacaguucacaauagcguucguacucuuauuagaaucuaaugcagccacugauaugacaggaggcagagcucaggcacuaaugcucccuugcccaccacucaccuccugcuguguggcccagggauuggggacccuguucuacaggaccuuacagauccuuagaaauggaaucuuagaguucaagucaacauguaaucacaaagucugccaacaaguuugguugcagcuuugcagaggauauuugccauauggcaauguaauuucaggucauuagggagguaguucauaagcaauaaauuccccucuguuauacuuuuccuaauuaaguuguaucauaguuuuacugaggaugacuagagaauuauuuggagaaaugcugaugagcuuccaugauuacagcuaauuaauaauggaguacaacuuaaagcugaaaagucacucuggcuucugcuauuaaaaagucaaccaauaaaugaauaggaguuaaugggagacuauccauggauaacaucuccaaauuuccaauuaucccaaagcacaggagaagaaacugucaccaagaaagacaagagauuucccugggcucagccccugagucauucuccauucagcccuagaagcaagucugcaaguccggacccuugucuuguuagaaacaaggcuucagucagaccuucccaggaggcauuugaaaucaaucagagacaaguucucaugcaaaauccuauuuuaaaugaauauauugauaucaggcuuuugucuaaagugcuggcccuaaaacaugguuaugugaacagggugaaagggacacuuacuaccacaucaguccucauuuucccaaaagucuugaucaagugggcauaaugguaaucuuccauuugucguaaaauagcugucaugcaagccacgaaguuucccuguaaaugaaucaaaagauagaauuagaugagacagagcaacacucaugggaaaagccgaaaucaucccagauucugggacuugaaacugucagggagaagcaacggggcaugggcagggagcccuggguucugcugccccucucucagggaagaucagcauaaggcaugggucacuuccaaccucaggaauguuuuuugguaggggguccuuagaauaucaaguugaaaguagaaagaaaagcaaaacccuugagggggucucacaaugcugaggacaugaguacacaguaacaugaaugagaaacacuggugcacucacacucagggcuguauuuuauucucucuaacuauuaauaccucaaguguuuccugauacaggguuguccagacuggaaaaauaagcuugaaauacuuuugcauuaaauacaagaaaauuaaagacaggauggaaaucaugggaacuucuguuuugugcucucuuggaaacuugcugcccuuauuauccggcaaaaugugugugcagccucuccucuugggccauggcaaagaaaggccucuaauuucucaaaaucagccuguaucccccugugcccgauguggaggcaaucaccacaacuccacaaugaguuauggcccaauucuccuccccgagaagaaggacaggaggaaugugggcucaucagaaugucaagugggagagcugggaguuucucagaccagacggagcuggguggaaaggaaaagaaggaggaaaaaagaaagcaacacagaaaaucaagaauggggaagguaaagggccaaagcugaaacgucucuccggcuguugcaaauggaggcagccaguauguguguggacgugggugugcacacguuuguuugcgugcccugaaggguguuugcuuugguggcggguugugagcuaggcaguucuguugccauuaacugcaauugcucacugcuaggcuuuguagcuaacaacauuguaaagccuuccuugcuuuuaaauauugcccccuaaguuaaugacauuuuaagaaacacaggauauauauuuuuucccauuaagccaguacaaguuugguaaaauuauagcaugaaacacacuuugagacaugucccuauuuuuucucuauuaaaugagcucucaaauugcauucuuuuacuaacucuccuuuuaccagcaauauaucagaaugccuaaaugucuuuuauauuaauuuggaauacaggcuuuacagugaaauguuaaaauccaauauuuucuccaauccauuuuauaccuauaguacacauaucuacuuccaaaugaguccucgaaggacgcauuacucaaauugaacaaacacaauaaugaugauaugauaucuuccauuugcccagaaauauaaauuauuugugaaugaugauaauugcugagauuuagauuccaaguugguguucagggaaacagcuaaauaaugcuuguuuuccauugaggcaaugauuaguaaaauggcaaaauuugugaacuuuugaaacauauaaauauuuggcauaccauucagcucaagaaaggcugccuuuguaucuugucuacuccuuaugacaaugagaugugucccguggauaaucgucuuaauaacaacacugucacuuuaauagaauacgaccucuuucaaucacacacaaauuucucuuccugugccacuuuacaggcagugaaacugaggcuuagagguuucacucucugaaggagugaauggcaaagcuggguguggaggcuguacucuaggacuauaagacagguacuuacuggcugaccucauuucuuuaccccucauccagaugcacauuuuaacucuuccucuaaggaaucugaagccacuucugaugaccaacacaagguagagauucacuuuccucuacgcuugcagucaucagagaaagcuggaagagggugaggaagaagaggcuucgaaguacucugcccacaauugacccugaugcagucgcugacccggacucuuccccuugagaggaggagcuuuucccgcugaagaagaggccuauaucagccuaggugaaccuaguaggugcugaaaucaauuuucugcaggucaaaccaguuacacaauggagacuuacacauuagaauaaaugaaaucacaaagucagcuauuuaucaccagaagcaauguaucaaugugcuuagcuuaaaugaucaggcugaaaguagaaagaaaagcauaauccuugagggggucucaaaaugcugaggguaugagcacagaguaacacuaaugagaaacaucagugcagccagacucaggccagaugacgugaacaggugacguggacauacugaauucaggcagcagacugucacgucaugcggagaaauucaugcaaggcaacaaaugccaaaaccguuguaacacagaaaacgaaaaacugaagcgaacacagcaauuuccauaaaacaaguccugggaggauguaaaugccccguggggaagucucucuggaagagcauaucagagaaggcaaccacgcggccccuuguuuaacugcgauggggauuaauuacaggaggcccagaagggccagaaggaugggccaucuccacaaguuagaggcggugcugccgggcacugugcgugcccucuuuaccaaacuuaaggaaauguuccagaagucaugugcaucguucagucuuuccuuucuuagcgaaaguaagucuugcuuuuucagcucuaaggugaagcaugaacuccauuaggaaacggaugaucugcauauuaaaauucacugaaaugccccuccccuuccucccugcccuuugggaauggagucccauccuuggguuaucaguauuuuuuugggcaaauacugcagauaccaugaagccuuaugguuuccaugaacacagcagaacccugcagcauaucugugggcuuauaaggguggauaaaacggguauuuauggaagccuuuugaaaccagucauuuauuaggaacaaaagugagcgagcucugugaaaauaaaacuuuaauucugugugcucagaagaaaauuacuauucugugcuuuaacugauuuauuuuaaaugcauuugggagaugacuccuaaaugaagcuuuuaucuucuagacaauggguaggcuagcagguaggcugggagcaaaagccacugugcagaaccaucccugagccugaacauagggacuaggcuccagcaccagcagcugaguaaaaauaagucaauaaguaaaaauaagacauauuccuuauaacuucaaagcaaugcaaaauggggccacagaagucaggauauacuugcagaaaauuuaaaaaccaggacacuaaaugccuaauaaacaacaaaaaaaagugaaccucauuaguaaucaaagaugaaaaugauacaucauuauuugccugccaaaauagcaaagaaguauuucaaugaugauaaugugagcaagggugcagggaacgaggacucuugugugcuguuggugggaacauaaauugcuauaaccuuuuuaaaaagugauuuggagauagguuugaaaagucuugaaaauaaauacucaucuccuaaguaauucuacuucugauaaucuaccaaaggaaguaauucaaaauagaaaauuucauacccaaagauguccauagcauugcugaaaauucuaaacauccaccacaagaaacuguguaaauaauaugauauuuuguaggguugcaagauaaaguacaggaugcccaguuccauuugaaucucagauaaacaaagaaaaauaaauaugucccaaacguugcaaugaaauauuacaugagagauacauauacuagaaaaaaaaaacuguuguuuaccugaaguucaagcugaacuggggguccuauauuuuuauuuggcaagucaagcaaucauaacuuguguuaugaugaaauauugugcaaccauuaaaucaagaaacauuaugcaaauauggaauauuuuaauagcaugagaaaauaauugaagaggaaaacugcaguaauuauguauacacauuugaccaauauaaagaauauauaguacaagaaaaacaaaaaaugacuagaaaagauaccagauagucaugaguggagggagacuaagcccagauuguuuuuauaaagagaaaguauguuaauauuuuuaaaggugguccagaaagaaaaggauccaucuggcaggagggacaaacucucccugccugccccugaucuaguuccauuucuuaagcuccugucuuaaaaaaucucucucgcagggcucccccuguugguguggccuuggcuacugccuggcacugcuccuggagggagcccuggacagaagucguccccgcacacccccagcccuccuggaaguaccucagugccccaguuuuaaauguguuugggcccccauuucacuagguagguugauaggaaaaauggagaacagguagaacugagcacagguagaaggaagggcagguggaauugagcacaaguagaacugaggcuggguagaaggaaaggcagguggaacugggcacagguggaagugagucucaguagaaggaaaacagcacagguagaauggggugcuggugguggagcagggggacauucagugacaggcaaguugaaugcaggaugucauugcaggauauaaaaacaaaaggcuaacaaaagcacagacuggugaauggaaacucaggaugagacauaucuuuuaaacagugccuuugucaacuaugccuaguggaaggucuaaguaugaauuagaagaaaaaaauccaaaggguuuuaauucauauucuugaggagcugugaagguguaauaaaaauggacuuagccaugugacuuggauagcaggguauaaaauugcuccugguaauuucaucagccagacaagagcugucucaaucgacccuggagcucacacuuuguacaaagcacagauuugcucucugggacacacaacacaggcagaaauuuuaacguucuucuaaguucucuaaauuccaaaggaucucugggcaguucccagccucagaagcuguuggagcuguaaacagagacacaggagugacgaguguggacgguaggugcccgguuucaauaaaaggagaacccugaagacugaauccgggauuaugcuucaugauuucaacugaggucuuguuacaaaguuuaaccguguuuucacuaaggcaaggacuuugaagaggaaaucucacucaaaugcuuaaauuucaaauauauuaaugaaaauaaacccaucuuauaaucaucauaaaaagcaaugaaaaugaauuauccaguaacauuuuaaaauauauuacuaaacaacaacaacaaaaaaaacauaauggugaugacuucuggaugauuuuucuuuuggggcgcauucaagccaaagaaucaauacuguaaagcaauauuaugaagaagagaauauaggaaaagggaauguaacugagagucaaguccuucuuuaaaaugauuugaaauaaauccaaguaugagugaguucuuagagcugauaagauagaaggccaacagagcacaauggcuuucucuuuuguagagggaaagccaauggcaaaauguucauaggugguauuuucugugagaaaauaugaaagagaaaaacagggaguccaaaaaacaaacaaaaccucaaaauguuauaaauuagccccaaacuccugcaaagucugcacagagcugaaguuuuucaaaauauacuuagggguugccuacaucacaaauuagaaacuauuuaaaacaugcauucccaguuccucacauuaaaugacaguaaggcacauauuaaaacugcacaagcccacaaggaccaggggacucugaggagaugcaacuaaagacaagagaauucuggaagcaggaaagagggugaugaguggguaccaacugcccucaaggcaagaacguggugacauuuaacaggaagucugugaaucccuggugcaaaacccaaggaaggcccagaaacuggagggugccagguacucaggaggcuacaugugagaugaaaaacaacagugcugauggcuuugaaaugugacccuauauccagucugccuaugcccagcauguccagugaggggcucuccaacucacuccuggggagaggaccacauguuuacucucuggacaagggagguaccugaaaagcagaagaaaaugacaagaaccaccuggaagaaacaccuguuuaguuugaugucaaaccaaacaguauacuccccucucucuuuucugcucagcucccagcauaucagcaaggaggcuuaaacuaaccccuccuaaccuuagucccaaaccaaaccuagaaagaagaccagaagaauccucuuuggugaaaaugaccagccaaagagaacauaagcacuaauacuaagcauggagguuccaaaaguaugacagcucagcccauccaggcuugccaugcaggaaagcccaugcgccuccaugcucugugcacaaacuuggagacagagggucugagcaagaguacugggccuugugaaaaaaauucauccagcauuaauaaaggaggcccaaacaaacaaaaacagaacccagaggaaaggaagaacauuuagaaaauguaagagaaguaaaaaaacuacaauaauaauaauuauuauuguuauuauuuuugagauggaggguugcucugucucccaggcuggagugcaguggugcgaucucagcucacugcaaccuccgcuuccuggguucaagugauucuccugccucagccuccggaguagcugggacuagagguaugccacgccuggcuaauuuuuuguauuuuuaguagagacaggguuuugccagguuggccaggcugaucucgaacuccugaucucaggugauccacccgccuuggccuccagagcauugggauuacaggcgugagccaccgcgcccagccaaagaacuauaauuacuauccucagguagauaugagauuauauucaugaucaucauaucuuccuuauauuccucccccagcuuagugauuuucaggacaagucaaacgauuugcccuuauaacuaucauauuucucagauuuaaaauaauaacauacuuggaaaaaucuugcaaaauucuauaauccuuguaacauuguucuuucacuuauauuuguugaaauagaaaugagauagcuucuccuuguugcuuugauuuucucacacauguguuuucauauuauauagaauuucuuuaaagcuaccucaaaauccuuuuaagauuaagggggcggggaguauaagaaagaaagaauaauuaaaaauauagaaagaacgauguuguaaaaugaggacagaggauagugugcagugccgcauacauugaaugucaggagucaucgcugugcccucaaaaaguaugucacguuuuauuaauuaaauauuugauuaagcauaagacauaauaaaaaggcugauucagguauuauuguuaaaacugaagcucaccggaaaauggguguccauucucaucagugaacucauaaaaccuuucccauauaaacaacccauggugaaauuguuccuuuuuucauuuaaagaugaauucauucccaugaugccuuuauucaauauauaauuaauuuuuacucauuuaaucucccaaauauuacaauuucuuuauuuuauaaagaacuuuagagugaggaauguuuguuaaaaaaaaaaaaagccaaaacuauauaaaacagaaaauaacuuacacuaaugucaucuuuuagcuauuuggaacuacuaacaacaaaauuaaaccuguaucuuaaauuuaaacugagugcuuaguugaauuuauagaguacuaguaucucauaccauuccaggcacuauaaggaaagaaauauaauuuaaaaacaaaaucgauuucauuuuuauaguggcaguaauugcagaagauguuuauuggacaaauauaccaaaagggaauaucuggaucuuaaauuacccauaacaguuauuugcuacuuauaaaguauaauaauuuaaacacauauucacauuuguuaugaaguauaaaaauaaauuauaaucaaauauuacauacaaaauuauaguuuaugguguaaugaggacuauauacuuuguuugcagcuucuuaauauaauucauuugauccuaaagcaagacagcaaagcagaaaauuuuauacguuauuuuuauauacucaauauaucacguaauaauagagccuuagagaguuuagaauuuucgaagucuuaucgcaugauauagaggaucugaaaacacacuauaauagaaacgagcguaacucggucuuaaaaaaacucuuauuauugaagagaagaucaauaugucuauacguguuuuuaaacugacuuucauagauaaaggacacuacaauuaucauuguuauaaaugaaaguugaaacucuuucuuagcuaaaauggaaugccuuacauaaaucauaaaaggauacuguccucaacauuguuaacauugguuggaugauguauuaaggagaaaugucacacacaucauuaaauauuaaguauuaaauguuuaugaugauacuuaaguauuauaaaguauuaaaacauuaaauaaaugaaucguaaggagaauaaaagauacuuugaaauaugagauuauaguaaauaaaaacauagauaaucuuuuaugguauuucuuauaaauauguauguacucauaauacauacauauguuguaugcgguuguaugcucaaacacugcacaugacaagugaucauccaauagcuuaucuacuuacaacuacauaagcuaccaaagugauuuuagucauaaaugccuaaugcuuauuuucaaaaucgccuacugugguggacugagacucaauuugugggaacccacgaggaauucugcaguagcccuguaccuguccagcagggugugcaggaaagcaucaacacaggaagcacaacccacugagguucuacuuccaccccuugucucacuuuccccacaccccaggggaaauugaagcuucccuaaauggguccuucuagaaugggucaugagaaauggaggggauaaggcuaaaaugacaagaagauucaaaaccaugaagagcacugccaagugcaacacucaaccaacauucaaugagugugcaguguguugacaucauugaguucccaagaguaggucagcaggagauaaaaacagccccugaccagaaugaccucagugggaggcugggucacgucuuucuucuaggcuaguggggccaugucaaaaggacacaggaggugguguggggaggcuccccuggccacgugugggaugcuugagacaaucugaauaucaaaaugaacgaugacaacaaacaaauguagcaaauugaaugagaaaaaaauccaugugucuacacagacauauaggcgacguggcaggguugagggcaaaaguaaagcugugaccuacggaagacuaugagccaaaaaaacacggaaugaagaagagaacuugauaacugaagguuucaacuccuaaaggaaugguugguccagaggaggcuccucaaugggcacugaaaccucgagguaaaaggucuuuggggacgaagacacucacucaaucugaaaacaacacccuauagauucuuccuaauuauaguaugggccuuuagguagaaugcuaagcacacaggaucacuuaaguaguuacuuuuuuugccaaaaauguuccaucaugaggaaaugaauagacagauucagaguauacagcauuugacaagacaaaugguggggacccuuaaggucaaagggaaaaccucacagggaagagaucuuacauucuauucgggaaucauuguucauuuucauaggcaucauaauauuccugugccuacagagcaguuauucauaggaguugcaugaagcgaggaaugaugugucccugugucugugaccaacuuuuugguaugucagaaaagaaaguuuacacaugcagggauaaugcagacauggcaaaauguuaauauguagugaauuuagguggguacguguguuuaacacuaauacugauucaacauuuuuguacauaugaaacaucucaaaaagccaaaggaaaacagcuucuacucacaaucuagugagaagacuuauaugacaacaauuaauuaagacacaauguuacaaauauuauaaaagggaguuauuacagacugccagggaauucuaaaaaggagguauuucuuuuccaaucaaaggaacuauuacugaauacaauaauagaacuacaaccaaugauuuagguauuuuaacuugggcaaaagggaguaguacagagauuuaagcagcaggaauaaucacucagaaaaguaucugaggagcuaaaauauaacuagagggcuuuguugcuuuugcacauaaagcuccaccauaugcaugcuucuuaaguacgggaauggcuuauuuauuuggacuguccacuguagagguguauucaggucuuaacaaaauacaguggaaguuguaagaaagaguacaaauaucuugcuucccugccaaauauggaucccaacaucacccucgcucuuuucauuaguuuauaauacucuuugucuuuuuuuuuuuuuuuccugagauggaguuuugcucuuguuacccaggguggagugcaaugguguggucucggcccacugcaaccucugccucccgaguucaagugcuucuccugccucagccucccaaguagcugggauuacaggcacccgucaccauacccggcuaauuuuucauauuuuuaguagagacaggguuuccccauguuggccaggcuggucucaaacuccagaccucaggugaucugcccgccucggccucccaaagugcugggauuacaggcgagagucaccgcgcccggccaauauuuuuuggucuuaaggcaaaaguuauauagauaaaugauacaaaauuaguuuaggagucaagaguaaagguuucaaaggcagacaauuuggaauaaucacuugaccaaggguacguuugcuguauaaauuuuaacaggcuauuuaaccuuucugagccucguuuuccucaucuguaaaacucggaucaugauucuaaaaucuggaauucuugaaaaguuuaauuagauauguauuuaaggauauuugcacaguggcuggcuacauaaaugaaugguggugaugaugauggugaugaagaauaaaacacaaaaccauauacagaagaauauuuuaaagucacaaaauuguauacugaaacacacaaaacauugacacgggagucaaauaagaccuaaaaauuggaggaauauaccauauucauggaauggaagacucaauaugguuaagacuuauuauaaaacuacagauaucaagacagugugguacuggaaaggacagacagacaaauaaaacaaacuggcugcacacauaggguuaacugauuucaaaaaaaaaaaaaaaaaaaaaaaaacccgugucaagaaggaucaaugugcaaacuguacuuucaacaaauggugccgaaacaguuggauacccaaauaccaaggaaggaagggaaggaaggaggaugggagggagggaaguagggagggagcaaaggagggagggaaggagagagggaaggaggggaggggagagggggagggagggagaaagaaaggagccauaccuuaaaccguauacaaaaauugacucaaaauguaucauagauuuaaaugcaaaacuuaaaacaacaaaacuuuuuaaagaaaacauagaaaacuuuugugaccuaggcauaggaauauauuucuuaggauacaaaaagcaugaaacauaaaauuuuaaaauugauaaauugaacuuaaaucaaaauuaaaaauuuuuggucuuugaaugacacuauacagaaaguaaaaagacagacugcagaacuggagaaaauauuuuuaaaaacaccuaucugacaaaggguuuccauccgcaguauaugacaaacucucaaaaaccaauaagaagaaaauaacccaccaaaaauuggcaaaaaaugugagcagauauuuaaucaaaaaaggaacacaaauggccaagaugcacaugaaagcauggucuaucuuacuagucaauaggaacacgcaaguuaaaaccacacugaaauauaacuauauaccuauuagaauggcuaaaauuaaaaaaaaaaacaaccaccacaaagaugcagaacaauggaaacucauguugcuggucugaaggcaaaaugguaaagccauuuuaggaaauaguuuggcagcuucauauacagcugauaauauacucaccucaugacccaaccacgcugcuucuaagaauucacccaagagaaaugaaaagauaugcccacacagagacuucuauacaaguauuuauagagcuuucuucauaauugccacacauaggggacacuccaaacaccuacuaccuacuaaauaaacaaauaaauuauggcauaucugcaugaugaauaguacucagcaagaaugaggaacaaacuacugguaaauaaacaugagugaaucuccaacacaucaugcuaagcaaaauaagccagauacagaaggcuagacacuguaugaauccauuuuuaaugucguucuagaaaaggcaguacuagagugacaaagaagagagaacugacuauggaggggcaugagaaauauuuuuacggaaauggaaauauucuaaaucuuguauuugguaguggcuacacaacuguauugucugucaaaauuuagaaggaagaagaauggauguuacuauauaaaauauaaaguauaucauuuauaauguauaaaauauacguauuuuauacuuuauaaaguauacaaaguauauaauguuuaaaguauacauauauaaaguauucuauacauacaaaguauauaaaguauacuuuauauagauuuauguauaaguauauaugcuuuauacaguauauauacuuauauguauuuauuauauauguauaaaauguacauauauuauuuacuuuuuauguauaaaauccauauacuuuauauguauaaaauauaaaguauauauuuuauauauuuuaaaauaaagaagaaaaucugaaaaucaccauguccuauaagccauauguaauuaauguuguauuugaaaggauuccuucuugcucuuacacuuauauagaaacagaguacuuucaauuuaauuaauacuuuauuguagcuuucaaaugguuuugcuauucaguauugcaaggccuacuucacauuacccuuguuuuucacauuuuucuugaguauuccugccaauuuauucuuuugcauguacuuuagaaacacauuauugagucugaaacaagguccuauugggauucaaauuggaauuccauugaauuuuuaaauuaauugaagaggcuuacaauaucagccuucccacuuagacaugcaaacugucucuccauuuguucaagucuauuuuuaugccauuucaggaauguuuugugguuuucaucauacggaucuuuaacagcuccuuuuauuuuugugucuuuuggagggagugcuuuuuuaaauaacccuuugaacauuuuguguauuuuuauuuguauauuaggguaaacuauugaauuugauguguacauuuugcaauugaaccuacagaauucuccuauuacuuccaaacuauuuuucccccacuuuggagaggguuucuaaauacaucaagccaacaucugucaauauuuuuguguugucuuuucuaaucacuguaggucuuaauucugcuucuagacuuacuccucaggccgcacuaucacgguaaugucaaauuauaauaaugacagcaagcgccuguuuucuuaagugauuuuaaugggcacgcuuuuagugucuaauuuuuaacuauuauuuugaauguugguuuaauauacuguauguaucaugucaaggaaguauuccuaaccucaggaucagcuauaacaaagugccucaaguuaugguuauggauauuauugguuaacaaacaugguauggaaauuauuauaaaacaagaguucuauuauugaagaacaaguagaucaacaauaaaauggagcagccgaaaucacaucguauggaugcuguuacauuuuuacuaagaagggaagaaugguaccuucaaaacacaacuuauauguaaggucaaacuauaauaaaauuaaacuuagaagaucaacauuuuuuauaauucuuauuuccuagaaagggaauguagccacaguauuuauccguucgcugaaaccuuugcgaaggcacacuguguuuuggacauuguucuagaagcccgcauauaacucacauucuauugggagugcucugacagagaacuuacuggcagcugaauuuaaacauuagcuucacuugucagaguugacauuaauuaguaucuuaauaagaccaucugguaccuggaguaaguuaauaguuaugcacuuggcaaguauacauuguagauguuucacaucacauuuugugggggaaaaaaaucucuugaaugucugcucauugagaaaaauaaucaaggggauaucaauguaaauauauagcuuuguuuguagcuauauauuuguuuguuguagcauguccacuguuauguagacaaaauucauauuuccaacuucuaaguuauguuuauacggacauaaugaaaauaugagaagaggccauuucaucaaucuuaucaaaauuuagagcuugcacuuccuaauuaccaaauaaacacuuagcauugaucauacuggugacuaccauaauucuaauuagggaauacaaaacauugguuuauagagauuaaucuccuugaacaaaauucaaauauuuuaaugauauuuuuucacuuaugacaaucagggacauuucaguuauuugccucauacauaaaauuaaaaagggaccaugccaaaucaaaucaaauccccuuaaccuaaaccaaaaacucuaaucaccagucacauggugaagagccaaauugaaagucacuuugcaacagauguuuagucaagauuuuuuauuuuuuauuaaucuugcuuagaugagaucuuaacagcaugcagugggagguaaauccgcaaaguaguacuauaaugacuaauuuuacuuuccagaaucacaacuuguuuguaaaacugaguauguuuuucacaagcuaauuaucuggcuacacaguuaaaaguugucaaaugcaaugcuccuauuuccuguuuaaauaagaagcacaugagaucaugaaaugaaguccacuuguuuugaauuucaacccacuguguuggugucaugaaggggcaaaaagcagaaaucuagguugauugguuaaauggaaacagggucaacaggaggcauuuguucgaaagaaucagaaaccucagacacuacuacgugguaaauaugguaggaauaucaccauuauuuaguauaaaaucauuaucacaaauaaaaacaauaacugcaguacgaauguggaccaaggcgcagaccuauaaggccaugaugagugccccagccccacaucaccucccggacucugccucuguugcucacauugcuccagccacaguauccagcaagggauccuggaauuugcuguauggaaaacaagagacuuuguacagcacccucucuaaauauacaagacauucaaaagagaaaccugcauacauuuugauauuaggaaaucauuccggggauucuuccacuccugaaaugaguugacuugcagauaacucacaacuucuuaagcuaaaugguauuuucauuuuucucaagcucuuccaauacauaugaccaccaagaugcagaacuaaaaggucugcacccuucaggauuguacucuaccuguacccucuacggaacgcuucucugccagcugaccaccuggcucacuuccuucccuccuuuucugccuucuccaugcaccaaucagguugacacaaauugcauaaauuguuuaugucucuccucacuagaauaugaacuccaugugugcagggaccuugguuuugcuuguugaaggaccccuagcagacagccuuuaccuaggugacacacgaacugucucuccauuuguucaagucugucugaaaaaauggaguuuauuugaacaaaugaagaugucugagcgaaugcacucagucuucuauuuguuugaaagaacauuaaaaggcaaagaaaagaagaaagccuaacacaaacaagaaggaagggaaaacauuuauuccaacaaaagccuugagucuaaauaaggggacaaugauucuaucaauuaaugagugaaugugcuucugacaaaguuauagaugucauuucuaguauuuuuaaagauccccaagccucuagcuaaauggcacucuuccaaagaaauguguuuagccaggcaugguggugugugccugaagucccagcugcuggggaggcugaggaagaagaauugcuugagccuaggaaguggaggcugcagugauccaugauugugccacugcacuccaaccugggcaacagagagagaccucaccucaaaauaaaaaaaaaagaauaagaaaaagaaauucaugcacugaauauucuuuuuuacaauacacuuaaaauauacauuguaagacacugacuacaccaacauuuucuuguaucgaauaguacugaauucguauuuucaaaauaacuuugugguggggcuuguggagagggcauuuaaauguuaaaaaaaaaaaaaagccuuggauucagucuacccauucgcuaaagagaguuugaucuccaugugaucauuuucaaagcaaacuuuaacccugcucugauagaaaagaauuaccagaugagucuuaaaacaaaaauuucugguuguuuaaugaaaguugcauuaauaaaaguaaucaaacgugugauaaaauaugcuucaaaaaauaaaagacuuaggaauaauuaaaccaagaaagagagagaucuguacacugaaaacuauaaaacauugaugaaacugaagaugauaaaaauaaauggaagauaccuuauguucauggauuagaagaauuaacauugcuauaauauccauauuacccaaaguuaucuacagauccaacgcaaguccuauucaaaauuccaaugacauuuuucacuaaaauuaaaagaacaauucuaagauggguuuggaaccaccaaaaacaaacaaaaaaacaaaaaaacaaaaaacaaaaaaaacaaaaaacccagaauagcuaaagcaaucuugggcaaaaauaacaaagauggaggcaucagacuaccagauuuuuuaagaucuaauauaaagcuauaguaaucaaaacaauauagugcuggccauaaaaacagacucaucgaccaaugaaacaggauagagagccuggaaauaaauccacacacuuacagucaauugauuuucaacaaagaugccaaaaacacacaaugaggaaaggauaaucuucaauaaugaugcuggaagaacuggaucuccacauguaaaagaaugaaauuauaaccucaucucauaccauauacaauaauuaacucaaaauguauuaaaaaccuaaggccugaaacuguaaaacugcuagaagaaaacauaaagaaaaaaaaccucuugaaauuggucugagcaaugaguuuuuggauauaaccuuaaaaagcacaauaaaaaauaaggcuaaaaauagacaaaugauguuaaaucaaacuagaaagcucuuguacaguaaaaggaacaaucaccagagugaagagacucccuacaaaaugggagaaaauauuugcaauucauauaucugaaaggggauuaauaucucaaauauauaaaaaacucagauaacuuaauagcaagaaaauaaaugaccuguuuuaaaaaggggcaaaggaaauggacagacauauuuaguacauguguggcuaaggugaucacuggauagauauuuuucaaaauaaaaaguggccaacauauguaugaaaaaaugcucaacaucacuaauaaucagggaaaugcaaaucaaaaccagaauaaauuaucaccuuacaccuguuagaauggcuacuaucaacaaaaggaauaagaacaaguguuaggauguggagaaacgggagccccugugugcuguggaugggaguguaaauuuguaaacagccauuacggaaagcacaauggaggguccucgaaaaauuaaaacuaaaaucaucaaaugaugcugcaaucccacuucugagaauauacccaaaggaaaugaaaucaauauguugaagacauauuugcacucccauguacacuguagcguuauucacaauagucaaaauagggaaacagccuaagcgugcaucaauggauggauacggaaaaugugaucuaaaaacacaguggaguacuguucagccuuaaaaaagguggaaauaccaucauuuggaacaacauagauggaccuggagggcauuauuuuaagggaaauaaguaaggcacagaaagacaaacacagcaugaucucacuucuaaguggacucuacaagucgaacucauagaagcagaaaguagaauugugguuaccaaggacuggagagcggggggaccggggagacgauggucaaagaaaacaaaauuucauuuagacaggcagaauaaguucaagaagucuacaucacggugacuucaguuaauagcaauauacugcacacuugaaaacugcagacaguaguuuugugagguuuguuugguugguugguuuuguuuuguuuugagauggagucuugcucugucacccaggcuggagugcagugaugcgaucucggcucacugcaaccucugccugguggguucaagcgauucuccugccucagccugggauuacaggugcgcaccaccacgcccggcuaauuuuuuguauuuuuuaguaaagacaggguuucaccauguuggccaggcugcucacgaacuccugaccucaggugauccacccgccuaagccucccagagugcugggauuacaggugugagccacugcacccggccaaagacgguaguuuuuaaguguucucaccacacgugaaaaauaaguaugugagagaaugcauguuaguuagcucaauuuagcuguuccacaauguaagcauacaucaaaacaucaugucguacaucauaaauauacauaauuuuuauucgucaauuuaaacaauaaaauuuaaaaauguugacauaaugacaauguaauaugcuagagaaugugugugauuuuccacauggaacaaaaacacauggcuuugcguuugacagaaaaggggucugcgagacuauucaaucagcaguaacaagguucugcuccagcaugcaagcacagccucguggcugcucaccaccugcagagcuccaccaugugucucaggcaugucacaucaucaaaagacauggcaaaggcuacgaccaagccacagacugugccugguacccacccagcaagcauaaugcagacguggaauucagccccuggaagcagaaauccucauuuugcaaacaggcuuuuuauagcauuggaaagaacaguccgcucagugcucucugcuggucaccacccagcagaugaaaaacaaagugagacuuccagccaccuccgggccgggcagcgugggggugacgcacauacacguucuggagaauuuagcaagagcacauucaucuaaauuccaugaggaacgagggaagguggguccccagugauuuaacccuucucacucuaccaccccacagcauaauucccucauaaggaaaacaggcaggaggcaaauauggcuuguuuuugaaguauuaaagacagauauuuacugucugcaaacuacugauauuuuuaccauuuuaccaggauggaaaaucguuuugauuuuuaacaaauagcaauuauaaggcagccaguaaaauucaagcuaggguuuagaggcaauggggaagaaagagucaaagcuugagaaauugccaacauaucagguuucuggaagguucaaaguccuacuuuaguacacugggaggcagaugaaugggaucacugagaauuuauucucagcuuaguccuaaugccacccuaagauuuggcuucuaagguuuggcuuccagauuugacugucugagccagugucaaaccccaaugucaaugccccagcagaaggggcaaaagucaaagaagguuucauuuugauuucagccagcauggaaagacgugccaaguucuuagugccuggaaccucagggcuguagggaaaaguugcacaucccuguggcuuccccacuaacuaugcacaagccuuccuuuauaaccgaacuugaagcaaaccuuuucuaaucagagggaacccuuucaggugcagaagggguaggguuguuucugcauggaccagcaucuguguagagugcucagcccaucuuguguagcuagauguuucaguuaaagugcuacuggaacguggcuuggaaugcagguggcaggaggcuagaggcuacggcccauaugccuuucgugccugcuucuugccaggccagaugggugcucaggacacacugggaugcagcucagaggcacugggaauaccucguuccaaggcacugaggcaggcccgcacuggcagggucuuaccagccuauccuccaucucccuacuccccacaggcauccuuaauggugguagguguccucauggccucaccuacuaaguguauuugugcugccauggcccuaaaggggccacgaugaaaaguucuggagcagcaaggccgaagacuacaggcaggcaucaggugaggaacagggcuggccacggugucaaucccaggucagcugugggagucaaggguggccacguggagaacuggacuucaacgagauuccugggaucguguacucauucguuaauaaaaacaagcauugucacuugcuauaggccaaguccggugcuggggcuuggggcauggaagaaaauacgcaacauggucucugccccugugucuagugagaaaugacccuuuaaaggagcagugguguaugcagcaugacagagccaugacggggugacuugggugcuguggggaacgcaauagcaugccucccaggugaagguggggaugggagcgggagaaaggcaguccagguagaaguauuguguaaucacaauggcgaaggcaucaggagccccacccacucuuuuuuuuguuuguuuguuuguuuguuuucauucugagacccagucuuccccugucaccgaggcuggaaugcaguagcacgaucuuggcucacugcagccucugccuccuggguucaagcaauucuccugccucagccuccugaguacuugggauuacaggcacgcaccaccaugcccagcuaauuguuguauuuuuuaguagagaugggguuucaccauuuuggccaggcuggucucgaacuccugaccucaagcgauccauccaccucggcucccaaagugcugagaugacaggugugagccacugugcccagcuucccacauacuauuuaugggggcugggcagagagguggaaagugaggcaggagcagagacaggacgccaugagcgccuggcaugggauguagugggccugcugacagcauuacccaacccuguucuuguuugauccuucacugaccgccaagaaauaccuguagauaggguaggguagagcuaaggaguauaaaucaauuuuaucugccuucaaguuuuucuugagccuuaugcauaaucauucaacuugcaaauucaguccuauuccaggaagcucaaaaugacagagaaaaaaacugaugauuaggaaacuccaacaacuugggugaucacuuaaggagaagcauaugcuauuaacuacaucuuuuuuuuuuuuuuuuuugagacagagucucucgcacuaucgccccggcuggagugcaguggcaugaucuuggcugacugcaaccucugccucccaaguucaaucgauucuccugccucagccucccaaguagcugggauuacaggcacccgccaccaugcccugcuaacuuuuuguauuuuuaguagagacagguuuucaccauguuagucaggcuggucuccaacuccugaucucgugauucaccugccucggccucccaaagugaagggguuacaggcgugagccaccaugcccguccaacuacuucuuauggguacaucagguuugauauggucuucuacuuuuccacuguuguacauaauuucuauuccugcccauuacagaguaaaaaauuaaaaaggguacugguaacuuucuaagcuagggauccaacaguuaaaacucaaaagacuagcuucucgcuauuauuccaaagcaaccccaaacuccuuggcuagaaauccuucagucugguguguaguuaauuagcuauaacuaaugaagcccuucauuugguugcuggcagucaggagcaauaugagauguucaagagucuaaacaaggaaaaggagggguuccauuacaaccuauguugugucauuugccugggaucucaaaggaaagaaugaaacccacggaaaacaucaaggcucgcaagccaggucaugucauggguuaccugcucuccuccgugcuuugcuucaggaaguuacugcagacccccuccugugcccuuggcauugaugggguaagucggggaacacuguuugacuaagauguauuuguuuucugucuuuaccaauaaaacauaaauauauauauaaaacaccugucaguuuaguacuuagaaaauuacaugcgccuuaguaauguaucacaauucuuguccuucucauaaauuacuuucuauauuuuuggcacguaacaacauaagaccuccaaaccucucuaguucagguuuccuggcaggaagagaauagauuuaaugguggaaaauaugaacuucaggauauauuuugaaaaagaauguauguauauuuggguagcaacuuacccaacaguagauucuucuaugguuuccuuaaacaauuaaguauggcuuuuucauucuuuucuagcagcccagauaacauucacauucauuaaaauguacucaauggcuccaucgucuugacccuaaaggaauguuuaaugcaugcacuccuuuuugccucucccuaaaacuccuacuucaaauuucuacugaaauaauuuaaauuauaauauaaaaauauacagauauagauaauauauagauacauaugaacauuaauauuucuuuucuuuucuuuuuuuugagacagggucuugcugucucucccaggcuaaaguauaggggugugaucagagcucaccacggccuuaaccuacuggguucaagugauccuccuaccucaggcucccaagcagcugggacuacaggcaugcacuaccacaccaauuuuuuuuuuuuuuucugaagcagagucuuguuuugucaccuaggcuggaguacaguggcaugaucuuggcucacugcaaccuccucccagguucaagugauuuuccucccucagccucccaaguagcugggauuacagguguguaccaccaugccuggcuauuuuuuguauuuuuauuagagacaggguuucaacauguuuggccaagcuggucuugaacuccugaccucaagugaccugccugccucagccucccaaaguacuaggauuacaggugugugccacugcacccggccaaacauuaauauuucuaaauagucauucuccaucuuaaauaacaugauccaaagccaucucuggauauaauuaaaucagaaucucuucuuauuaaauacuuuauaacucauugaaaaaaaacugguuuuccauggaugaaaagcaaauaaaugaauuuuaagaaagagcaugucuauauaagcucaaaacaugauuauaaacaaaacccaagaaaauaucaguaucuucuuuuugcugugagucacuaacuaacuuugauagccuaaauagcagaaaacaaacaccagaguuaucauggcagaaagggcuuaauuaacucauuucucacccacaagcacagcucagcauccuuuccccugauccugucccuugaugcugagacaaguaaccaagcuccacccugagccucacugucaccuaagauuuccuggguccccucuauagacaaggagacagugaucagcuuaaaaaggugcuaaggccuaaaaaggccacuucuuaaaaagccucacuucuuuauacgaacaaacagcacucccaaaaaaguaaagugcucaucuguagcuuucacuugaugcuugaugucuucucuggugguuucuuggugaauaagaauaaaaguggaguaucccuuauucaaaaugcuugggacaagaaauguuucagauugcagauuauuucagaguuuggaauauuugcauuauacuuaccgguucaauaucucucaucugaaauccaaaaugcuccaauaagcauuuccuuugagcaucauguuagcacacaaaaauuuugggguuuuggagcauuuccgauuucgaauuuuccaauuagggaugcucgaucuguaauauuaacauucuacuaaguaaguagaaauugaagguacauuagcaagauagaauuacuaaacucaagaaaauaaauuaaaaagcauuaagagauaauuuugauaggaaaaauagauuuuuaccuuucuaaaugauaaacacacacuuugaguugauuugcuuuuguauacauuucuaagcuacuuucuuucagaaaaaaaccuugaaaguugcugauuuauguuguuccaaauuuugagauuaguaaaacuaaauaaucagacauuguuauaaauucaaagagauuuucaguauugauuuauuaguugugaccacugugacaugguaacacaaaaugucaauaaugagggcagagacugaaugaaggauacaugggaacagguucuacaauuuuuuaaaacuuauuugcagauccaaacuauaaagucaaucuuuuaaaaccuaggagaaacuggcucggcacagcggcucacaccuauaaucucagaauuuggggaagcuaaggcagaaggagcgcuugagcccagguguuugagaccagucugggcaacacagugagaccuaaucuccacaaaaaauuuuuaagaaagaaaaaaauuagccaggcguaguggcaagugcuuguagucccagcuacuugggaggcuaaagugagagaaucacuuuagccuaggaggucaaggccgcagugagccacgaucauaccacugcacuccagccuggguggcagagcaagauccugucuccacaacacaacacaacacaacacaacacaacacaacacaacacaacacaacacaaaacaaaaacacaggaggaaugaaaugucgaccaaaaagaaagguggucucuauguacagaaaccacaaaauuuaucucccaaggaaacuuguuuaugauguuaccacguuaacaugacaauuugauauacucugauucaaccguuuuuuaaaaaccugacuacaauuucaaaaacuaauguuugaaaagagguauucaacccaguauuuguggguaugcugaaacuucuguaguuccuacaacauauugagagagagagaguaagccacagugauaugggggcuguuuuucagagaugugaagagacugaggaagaaaaggugauuuaguaggcuaauuacacaauuccuuuuuaacaggccaucgguaagcgcagauccugauuaaaaauaaaugcuggaaaugcuggcaugagugaaauuucacaucugaacuccugcacugcugcuggcagcucagaugcagccacuguccuccccacaugugagccuuuaaagacuacagggacaaaaagcaaugaacgacgcuauuaaaacugcaucucccugauagaauuucauuaagcuaaagagucucugucaaacacccugccauaauauuacuuuguuacgcagcaagcaaguuuacacauugaacauaauuuuacucuccuuugagugaggcuaaugucucuacugcuuuggagaacagaaaaucuugagcaucaaaggaugcagaauguccucccaaacauuuaccaucaauauuuuuuaauugaaauagcacuaaggcauuccauuaaauuaaggaaauaaaugaagaaaaccuacuaaaggaaagauaagccauaauuugccagcuucauacaagagcucauuucaagccacauucugacuugguucucaccaggacaccacuuccccugaguugcaccggacagcucugcccagagugacaccucaaaacaaaggacacaugaccuugagcguugaugcacuuuuuggacauccacguuuccaaccaauuacaucauguauuaugagcccuggagcaauugaucaaaggauaaaaguagcugacacugaagggaugucacaaggaugacacaugggcacauggaugcccagagcucccugagcagacuggagcugaccaugagugaaagcacagccacccucucaccuggagaggcccuccacacaagacacacaugucucucacguuaacauacaugaggaucaauaucuugaguuaagaucuugauguuaguuuccuaggguugccauaacaacacaccaugcacuguguacucuucuuuaccucauaaaucacacccauaaugcauuuucugcaauuuccaguuucaguuccuuuaaagaacuugaagacauaggaaaaacaacgugaauauaaaaugcuccuccauuuuuacgauuucuuccaaccuuugauaaugguuccacccacauccaauucaacagaaauugcuuagcaacuugauuuucuuguacuuuccauagcuaauugaaaaauaaaauaccauagcuuccaguuacacuuuuuuguuuauguauauuaaacaaagcuaaacauggaccaaugguaccaacagguuugcaaacaaauaccgugacucuuagcaaccacacaucuaaacuggugagugcacaguuauccccauaaaaccuacugccuuccagcugcuauucugaggaugcugaaagcaucggcauagagagaggagagcucugcuccuccauggagccugugaaguggaggccauuuaacagcacuuguuuaggaaauaaaucuauaagcagaguauucaaaagagaacaacuuaaaaacagagggaaaaaucaauuaaagggaaaaaaaaaagggcaaauucuuuaaagguagaagauggaauucuacggcccccaucuuugcuuguaauucuuguaaucuccacccuccgcccuccauauuacugaacuggacuggggacaccgaucgcuccuccauccaugccuuuguccaaugcuuggcucuaccccacaaagcuccuucuucccuuuacagcuaggguugcaagacaaaauccaggacacucaguaaaauuggaauuucagauaagcaacauuuuuucuaguguaaguauauccuaaauauugcauggauagacuuaaguuuuuuuuuuaccugaaauuaaaauuugacugcauaucuuauauuuuuauuuguuaaauguggcagccccacgugcaguucauucuugcccauucacacucaaagcugcugcaacacacacgucccugggccuccugguucucuguuccuuccuccccacuccugccuccucuucauucuccuguauccucagucuagggacucaucaaguuucccuacuuagcuucuccacacucuuucucugcaaacuccaaacucugguauauuuaaauaucacaucaacugagacagacaacuucccauuuaucuaggaagacacaagaggggucaaucuaggaugcaaaaguggaaggaaugaauguuuaacuacaugaaaucuuugaacauuuuuuucucuguaauuuucuccuaaugcucccagcauugauuuugaacucaugcucugugcugaagacucugugaaggauggaggauacagaaauguaaagauaaugaucucaaaacuguagauucucaaucuguaaguaagacuauccugugaauggugcacaggacugccaggguguaagucaacacuaagagacauucugcaccugcugaagaugugggcuggggccauggugggugucaccaaacaggaugggcugaagacggggaugggauagaguguaggauagagcuccaugggcagggucaugguuggcaauggaaauaaguauguugggaagaggauuccaccucaagaaaggcugucaaaauuggcccaauaaccuagaguaaccaaacucauagagacaggaaguagaauggugguucuacaggugcugagaggagggagaaaugggguguuguuauuuaauggguagagaguuuuagucuuauaacauaaaaagaguucuggaauuuagucaugcacaaaugugaauguucuucacaauauugaacuguacacuuaaaauggcaaaggugauaaauucuaugugauauauauuuuaccacaauuaaaaauuuuugagaagaaaaaaucagcccugacaugaccuagcaugcccacauagacaaaauggccaaggacuaauuggccuaagcaaguaggccaacugcugaugagaaaguuaauauaaagcuaaguaacucagaaauagccauaugcucaaccaaagccuuuccuucuauaauauaauacugcuuugauaagauggcaaagcacauucacaauuguugggauguguagaauauauucagaaacugcacuuccacccaagaugaauuuaugguuucuucuuuacccauuuauucuacuuucuccugaaaggaaaacuucagaacuaaucugcaguccccacuacuuaauuuggggaauuaaauaaacaauaugcuagaaguuaguccuugcuacaguuugaaugugcccccuccaaaauugccagugccagugugauaguauuaagaagugcauccuuuaagaggugggauuaaggcccuuaaaaaagagguuucacuuagcccuagguuggcuucccuuuccaucccaccaggaggggacacagcuuucuccccuccagaggaugaagcaacaaggcgccaucuuggaaguagagagcagaccucaccagacgaccaaacuugcuggugccuugauuuuggacuucccagccaccagaaccacgagaaacaaauuuuuguucuuuauaaaugaccagucucagguaauuuuguuauaacaucacaaagugaacuaagacagaccuuaauacugguuuuacuuugauugggaaauaacaacagaaaguggagggaaaaaaagguaagagacauuguauuuuaauauggcaccaacugugcagaguccauacggucaugugugagcuuugaaaaaccacugcuucauuucagcacaaacagucagaagucauuccaagggaacauuuuugguuggcagagugagaaaagguugauaaucacagguaugauggggaaaauacugaacagacugggagucggaaaacuucuguucuagucuuaacuuuggccaagaaguaaugcaagucauuaacuuauugucauugaagaagauuucccuaucaccaccuccaaccaaaaaaaaauggaaaaaucccuugaaguucaaaaguuuuaugacuugaugauuccauugugaaccaaaguucucuggcucuaccauugcugguguaaaaaggaaaugagcagauucuguuuagauaaaacaacaauuucaauuguuaagucucauguauacuacugcauauuaggucaaauuauaguuguauuucuauaaauaucuguauucaaauacauuaacaaggauucucuuagauuaaugagauuaauuacuuuccacaauuuuuagauuucauaaagauacuuuuuuaaaaauuucaacuuuuauuuuaucagauauuuagaacagcagaauagaauggaaaacucagaaauaaagcugcacuccuacaaccaucugauccucaacaaggcugagaaaaaaaaaagaaaaaagcaauggggaaaggacuccuuuucaauaaaugguucugggauaacuggcuuaacauaugcauaaaaauaaaacuggcccuuuaacuuccgugauaugaaaaaaauuaacuugaguuggauuaaagauuuaaauguuaacaccucaaacuauuaaaauccuagaagaaaaccuaguuaauacccuucuugacauuggcuuuggcaaagaauuuauggccaaguccccauaaagguauuucuauguggcauguuuuucagauaaauguuacuagcauauagacaaccuuauucuucaagaugcagaagcauauuugaauaugcucagauuuuuaguauguuggccuuauauaucugaaacaagacuuuaucauuacuuccaugugguucugcaaacagauaagaaacuguuaagugaacucaaaauuuaauaacugaaaauaaagauauguuuuugcuauuuuuuaagagaaggaugaaaaaaucuuaggagcucaaggucuccuggccaaguccagcaagcugaacagacugccaauacacaugauaggcuucuugucaauuugguuuccaguaaaucagcauauuaucaguuuaugagaauuacaauccauacagcauaucacuaaugaaauaaagcccagugugaaacuacuuaaaccgcuuauguucugcaguuucacagggguaaugugcagaauccaauuaaaaaaccuguuuucaucuguuaaagcaggaaaccaaaaacuaaccccagguaaagugaaauaagaggguguuugcaagagucccauuagcacagacacugguucuagcucuaauguccugagacauggcuuuggaauguuccuauucuuuuccugccugugccccuucccuucuuuucucuuucuuucuccuccuuuccuucccucucccucucuuccucucuguuauaauguagccuccaugaaacuaaaaagcaagggcucugcccugaucucaaggcaggaugcagaggcucggauuucaaccaaauggaaaugaugccaguugugacaggccccaugcacugcccacgacauguacucaccacaaaaagaaaaagucacaucugugguaaaacgacuuucuacuuggucugacucuuuuauucaacuagcaaguuuauuaaaucagcaauuuuuuuuaaguacuucagaacuucaccaaccuugaaaagucaugagacaaggcacugauuuugaaaauuaagguaaaggguacuuugagauaugccuauguuuccugaacagcaaagcucuggggcgguugggaugggugcauuacuauuauuauugagauggagaaaucacgacuuuaucaaaaggaaccuuuugccuacauaugagagugggguuuauccucuucauuuuccagccaauggaaaggugagguugcccagcccaauggcuguaaggcacacgcaucaagaacacucuuggggcggagacuuccaggacaagcuagcucagaaagaauuccaccccucuaagcaggaguggucuucccagcaauagcuggcaaugcuuccaaagacaggcaauagucucucucugcccauaaguaucuguauccugcgcuuucagguugguuucgagggcuuguuuguucuuuuucuuuuuuuuuuuuuuuuacuaaauuaucacuuuggcaugaagacugguagaaaagcucacagauagcuacuuccuaacuuggguacuuaaaagcauauauaaugaaagauacaaacagguuuuugcucucccuaaagcagcuccaggacguggcagacuacauccucucuagaaaacauucucauucaugcaugucauugucagccccuucccuaccuccuggggaucagggauucuauuacacucagugaaggcccgguccuggcaaagcuaagauaguuuacuggggagcaacaucucugaaggcuuacguuucagauggaaagcagcaguuagauaauccagcaaugcaaacacaaacgaauauucagaaccacauuuaaaugaaguggugcaguuccuuuuggcugaagguacuuaguaauaaaggggaaaucuuguuucacugcagggauuauuuugauguuuuugcuuuuguuguuuucuggggggugaggggggguguuguuugcuuguuuuugcuaugguaaaguuggguugugacuauuuugaaaauguccauacaucaucccauauguagguaggacuuuuuuuccuacuuauuuuucuuuaggucaauuuaauauaucuugaaaucaaccuugggcggcauauuuuaagccuuugaaugggauuuaguuacaaaaagugcccaucagucaaaaagcauuaucaaagccaaucugucuauuucagggucuaaaaaaacaaggcagagcuguuuguucacaauccaucauuauugguaccugcuagcaggaacucaagauaaacagguacagaauguagcuacagcuucugcucuaaauuaucuugguuagaugccccggcuauccgugggaacuggaccugccaugcuuggcgccaaguaacagagacccuccuuucaguaguagcaccaggcggaccacagagggaucacauggagcugcguggcugggucuucccuagugcuccauggaugcugcaggaaacccgaggccaguggaccaggggaaggaagacagggcagggcaggaagacagggaaagcuuccugagauuuacaaacagccacucauggaucccaggacuccuagggaugugggagaacaugauuacacaagcuguccauuggguguggaacguggcuggggauguauucuaaagaaggcugauagcgaggcaggaagggaggcaggaguccuggaagaggcaaagaacaaaacgagaaccaaagggaggcccugggugaaacagaugcagggcucagggugcccgagggagacuguacacgaugauuaaaugagggcaaccauccugcacgugaggcggaaaggagcgggugaccaggcuggauacuuagauucucacuaccauauuccaucacauagaaacuacacgcauauguuuaaaaugacaauaucauaaauaugauucuggguuaggacaagaggaggaguggcugagaaggaaucacgguagcugagucuucauauuacuauugcuguguagaccacacuucugaagccuaagaaacacugggggccucuguuucccuaagguaaucaucugccuuaaggaccuguuggccuggcaauccuaccccgggguguguuuccuggaggcgcucucccgcaggugugccuggagaucgcuaaaugcaggaucuaacacgcuguccuaauagcaaacacuggcaucacccagguacccauccaugaagagggguuacgcuugcugccaucuauuccuacaacaggaguauuauucagcuaagaaaacgaauggaccacagcugcacccaucaaccuggagagacugcaaaaccacagugcugaaagcuaaaagcaugucauggaaaaauauauauuguuugacucugcuucuauaaacggcaaaaggaagcaaggcuuaagaacauauuguuuaaggauacauuaauaugugguaaaacuaaaaagagaagcgagggaaaaugaaucccaaaucuguguagagaccacaucacaaagaagaagacgugcacagcugggcggggggagcuacucagggacuggagcgggaagcauuacagagaggcccacugaaugauuugucaucucuacauauguauuucuucucuuguaugaaugaucuguuuugauuuaaaagugaaaaaaaggucgggugcaguggcucacaccuguaaccccagcacuuugggacgccgaggcgaguggaucacaaggucaggugauugagaccauccuggcuaacauagugaaaccuugucucugcuaaagaaaaaaaauacaaaaaaauuagccaggcaugguggcgggugccuguagucccagcuacuugagaggcugaggcaggagaauggcgugaaccccagaggcggagcuugcagugagcugagauggcgccacugcacuccagccugggcgacagagcaagacuccgucuuaaaaaaaagaaugaaaugaugcugaugaauauuacugaucagcuggaauaaggcagaaacgucuacaggggaagcucacagccccuugugcgcuacacagccaaaggagcgucauuucccaaaguguguuuccuggaacgcuggccacggcagccuaacaaaaaauaaauaaauaaggagccugugaguaaggaaaguuaggaaaacacuguaaugcugagcccuaaucccucuucuacaaaugcuugguguacauuaauguauucacguuucugaaagcacugcuauagggaaacauuuuucauucuguucaucuugguguuacccaaucucacgugaucaaucucuuuaaagagaacuuaucacuauuccaaucaaacauuuugaaaaacacccccaaaaaugauuccaaaccauguaaauuccacccuagcucagaaguacacaaaaguacuuuaugaagaauaaaucagaccuuucuugggaacauucuaggcauagaaccuuuccaaagcauuagaacauaucacugauugcuuugaauaaaaagaaaaacuacccaucuuguucuuucugucucuagcauccuacuucuuacuuacacugaugcccacacuuaacuuccaaguacugucuuaaaaaucaaagaaaacauuuuucucucucuucccuucccaacaauauucugagcuuuuugaaauacauguaaaagaaauaucuaugcauauaaaagcuuucauggguacacacaaacaagaaguaaggugucuaaagacauacagcaagcugucgacauuacugaguaaucuaaaggggauggauagaaaggggaugggggagaagaaugauuaauuagcuuugacuucauacauccuuauuguauuaucuucacucauuacaaaaagcagguauuacuguuaaauuuuuuaaauagggagguuguuuaaaugaaaacauuuuuccaaacgugaauugaaaagcaagaaaucaucacagaagagacgcugaagcaaaaaugagauucuccauccuuuuuuuuuuuuuuuuggcaagggguggggagaacaugaaaaaauguugacaaaauaagucaaguaauuaacaagguacuuuccaagcccuuaacagagaagcugccaucauggucagguguaauuauggauuuagaaaauucauccuucauugagaaaaaaaaaacaacacuccuaaaggaaaugagagcuucggccuugcugggcaucgggaaaucacuacaaggagaggcuuaacucacgcaggcucccugaaagcacagagggagcuaaagaaaaauaauucgaggugucugcaagcgagaagcacaguccuccaccguucgcaccugcccgcugaaucaaaggcuuugaauacuagaggcucuuuaccuucuaauggaaacacauucucaacuucuguauggauuagaucucacgacgcuugcauauuccuucaagcauacaugaguauaaaaucaugugcaaaaaauaaagucucacuuuucuugauaugcagccaguguugucacacgauggccagguagaaguuuccuucuaaaaccacuuuuacuugagagcaaagaccaaaaugauucuugaaauaauuuaaugccuuacccaagcagacacaucacggaaagccgccuuguaaacaacucugagaaaucagugaacugggguuaaauaacucugcuuccgugaggauaucauccucggagucauugaaaggaugcacagagcuggaaugacacacccacuugugaugggugauugaauaauuuuguaauauaugcuuauucaccaaagcaucaaguccuucaagaaggaaaacacauuguauucucaaaugcaaauuuaauuuuauuugcagguuuaaaucuuuucaaagggcacuacuuugaaacucuggaauauuggcgcacucugcagagcuuucggaacaugcagugggcuggcugacacucacaggaaaugauuugcaagaguccagcagcggggaaaggcaggugugugcagggaccuccuuguaucucagcgcacaucccaugaggauucagggcucccauccuggggguggccuggacagcagggcuggacccucugucaugacgucuucacuuuucaccagguacaugcguuauuuucaguauguuuagaaaaacaaugcugucugaauuuuucuuauuuggccaauuaucugauccauaauuucugcuaugaagaaaaaaucaaugucuucaaaauucaauaaaugaaagcugugaaaugucagcagcaaacaugacaauaauaaaaagcacacagacaguuauauuuccucugugaaacagcagguccucaucagaugacgucucaagaccccaaauucacuaacaggggauggcgaugucuauaaagacaccaaaucggagacacaaacggcagcuuugcuaagggcaguagaugaauuaggagcaugcuuaucagggguauuaggagcauggcugagaggagugucucuccuuuuaugaugucugacagcaucagcccagaacccgagucuaggagucugcugaguacacugagacaaugucuugccugauagaugagacaugaaaaucccaucugucuggcaaguugcacuuggcuuuccuuagcugcccuuccugcaguuagagugcaggacucagcagcccagcuaaggcuuuaagaaggaucacagacacaauuguacaguuucacuuccacaagaugaguaaguucuagacaucugcugcacaacaucguacccagaguuaacaguaccguaacguacauuuaaaacucugugaaaaggguggauauaaaguguucuaaauaaaacaaagacaauaaaauaauaaaguacaacaaaaugcuaaacaaaauauaauaaaauaucauggguccuauaccaagagcugcuggcuguaauacguuuaagucauuacgccacgugucacauucagaaaucagucacaagaauauucugaguuuuuauuuuucucuuuggagaaauucagugacaccuagaacaaugcagcggagggagaggaucugcauuaggcuuuaaacuucaugaggcugaggaacccucagaaaaggaaaacaaaaagaggcagggggagagagcagaggccaugcugcacucaccagaggggcagagucaccagcuaugugccuggcacccaugcaguccauggcuggagccacccagggaacaggcaguggcucagaggcaggacucagggacagauagaagaaccaagguucaacgagacagagcaagagggaaaaagaaaccccucugcuucggcuccugguagacgugcauuuccugguuucccgggcucagccugagaguuauuccaccguaaucacaggaagcccuccucugacugcauuaucauccaaaugcacacgguucuacauccugcagaagaaauucucaggcaucggucccuuuacagccccucuaaugccgccugccaccuucguggcucuccacagcuuccgugggagucauuugccgagacaagcaggggccauucuuccugggaugagcacuggggccaccuuauguggcaccgccgaaguccagagcgcaugcugauggcagcacugugaggucuuuacagugguuuccauagguaaugggccaauaaccaccaaauguaagacuucauaaaaaaucucauucucacugugagggaaccaggaaauggagaaaaaucuuuucuuauuucuugauugggguuuuggggaagucuggcaucgcaucauaauguauccaggugacuagaaagagagaaagaugauuuguaccagcagccuagcagucaaguuuggaauuccuuaaccuaagucuccaaguccacgggacuuaccaacuccugcagccuuacuaaggugaauaaaauuaaaaugagguuuauuaaguaggcucucaacggaaugucucugcugagagauucugcguauuuaggugugugugcuaacaggaagaggugagcacaugcauuuauaaccaccuuugcaaucccugggacacuccaaaguucuuuccauaaauucuauguguaaccuuuaauugcccauuugugggacauguugauuuuuacuccacaucugcuggagcaccuacugaugugaaucauuuuccugcauuuucacuacuuguccguuuuucaaauccaucauuuacaaaugaaaggcaccuccacucaagguaagaaaaauggauuugaugaugcccuuuaagcacccagcucuagugguauaaugugaaauacaccccagggcuguacuguugccucugacaguaaggaugagaugggcccucacccuugcgucuaugauguccugaaagucaccaggugcccaaaggacacacaggcaccacccaguccuuagcucugcucuccaggcggcuacuucuggcccuugcuccuauuuucaaucuccagucucggaugagguuuucccacacagggugaccucagauuuugcuuuauuuuaugaaaauccaacuuaggcccuaaaauaggcacaugcacuugcauuuucauucuuaaacuccaaaagcaagcucaaucuucuccuaacuucugggaguuaaacauucagacucauccacuggaaucucaguguaaagaacugaaaccuucucaaagcugccacuuguuguggauggaaauaaaguuaaaaaccaaggaacugauucuggaucaucaaauaaauuucaguguuuccaguuaugcagugagaagauaaauucaaagauguuuccuucgguuaaacacacaugaaaaaaaugcaguguagguuaagcuuuucaucgcuagguaaacaaaaagccaucaccuaagagaggcuguauuaacgaccacuugguaagugguagcaauauacacagugaacuaaauuuaauuaauaaggaagcuccacagucuuaaugacaggcaacacaaaaauacugcaauaggaaauuaaauuagaacuuuauccuaggucuuuagagaauaucucaacguuauuaucuuagagaacaucucaacguuagauaucaucuaacagaugauaucguguugacaaauuugaaaguggggugcuaauccacaaugaagcucagugaucucaauguucacuaugucacauuuugucauguuuuuaaaaaaaugaaacggggucuugaaaucuuggcuuccugauaauauucaaaucugaggcauuaaauauaauauucaaaaggauaaccaacugauuauugauuuuuauuuuagugaaaaaacucauguuaagcuaauauauaaucauuuuucauaugguuacagagaacaauuauagaaacuuaacuauucaucucaauuguuuggaaaccaucaauacaggaaacuaaauuacaucagucaucauaauagcuccaguauuaaaacccuacagcaaagauacuccauuggguugcaugaaauacuaaaucaaucagcuggagaugaaaauccaaugcugacuguccaggauugucuugucaagucuucucucaggggaacguggugaauaaaauuauuggacuaaggagccaaacauauaugaccguccauuuaaagcaauuacugcacuuuaguucccauaacuggagcauucccauaacuaagacagcaaaauucuuccguuucacaaugacaaagacauuacuauucccaauuguuuguauggaacuguuucuuacucaaauacuaacagaugaauggccccuucaccauauccccugccagaaguaauucuugauaggauauacugcucuaauucugcccaaaucgcagaggaggccgggugagccuacaaucuagcguauguaagaagcaaaggggaaaaacacugaauucuccugugaucaaucaaacgcaucaauucauucuuaaaauuugggucuacauaugguaucaaaauucuguccaacaacuuaugcuauaagccaggggucauaaaacuauagccuguggaccaaaucuggcccaccuccugguuuuguaaauaaaguuuuguuggaacucaguaguugcccauuugucuacauauucucuacagcugcuucccugcuucaccagcagagcuggguuuucaugaccuuugaaauguuacgauguuauggccuucaaaguccaaaauauuuauaauguagcucuuuaggaaaaacuuuuaacaccugcuaugagcuauucuuucaaucaacacguagauaauaaagucaguugccuauuaagacaauccuaaaaugugagaauuguccauguucucaauauguacaggaaugaauacucucccauuuuccugggaaaagaggaagaguacguccaagucuuccaaaaguguuauugguacauucagguacaaguuaaacaaggccaaaauaugccuaucuuuugcuucacuaaaauuugaacuguuuaucugguauuucuggagacaauuccuaaucaccccccaacuuccuuguaagcuuucuacauaagauuccugacuuagucacauuuagggaccgcccuguacuugcugccucauuucacaauggugcugauaacagugcccaguuucacggagauuuuaggaggauuaaggugagaucaggauuuaauucucauaaagcucuagaacuaugaccagcaagaacugguuggcauaaauugaguuagcucaauuaagacuggagaaugagggaaggcuguauuuuucuuuuucccccauaaagguucaguuucuucuggcaauugcgguccuauucucugugaagugcaggcagguuuugggagagauuacaccuccacugccaagaaaaaacucaaaagcauuagaaguaaaauacuuaauaggccacuaagucuguuuauauuaggaguagcagggagcuggauaugguaaaaacaggaauaaacugauuuaaauugaaaaagaccuucagacguacugaaagacagcacauuguuaaguuccaauggagcaaagcuuugaaaaauggagcagggaaggaauccugcacuauuccguaagaccagcucuugauuuuucauguccuaucaauauuucauaguucauaauguugucaaaaaaugaaaauuaagagauguauguauaaagcagcuaacacagugucuggcucuuugggaaguacacgagguucuuuauuuauugagcucggauucuacugaauaaaugccauccaggagguggagggggacuuuggagaacauagagcaccuaaguucugcucucacagcgcaaaucacaucaagacucucuuacccaaggaacaugugcagaaauccacaacaaacaauucuguacauugauagcguauuaaguaaaugcauauucuuauacacauguauauauaagaauauacaguaggccgggcgcgguggcucacgccuuuaaucccagcacuuugggaggccgaggugggcagaucacuugaggucacgaguuugagaccagccuggccaacauggcaaaacccugucucuacuaaaaauacaaaaauuagcugggcaugguggcgggugccuguaauuccagcuacucgggaggcugaggcaccagaauugcuugaguuugggagguggagguugcagugagcugagcuugcaccacugcacuauagccugggcaacagagugagacucugucacaaaaaaaaaaaaaaaaaaaaaaaaagagaagaagaauauaugguagaugacaauguaauagaugauguucuaaaaagucaccuuuuaaauuauuuuggaaaacugaaucccucuaagugcaugauaaacagugguuaucugaagguagccuuaaucaaaaugagcauuuauuugguaagguuuacuuguugauaagucauacuugcauguaaagaguuugcuuaaagugcauuauacccauagaugauaacucuuuuaaaauaacugacucuacucuguauucaaacagagagacuauucaugcuugucaagaaguaaagaacaggggaaggcuaugggagaccauugugucuuacaugguauauagacauuucugcuuuaacggagcuuauuuaaauuucauggcaaacaucacccuguuucaacacuugucauaugaaucgcaauuuaagcugauugcacuucagcaauguuuaaaaauguccuuuaaauacuaacaaaauauguauugucaucgaagaagcaaaaguccaacaaggaacuuuacacaggccuaacguauggaagaggaacauuucuucguaaagccacaugguguuugcuguggccaccugccuccauccacuuacgccaucaagagugggugguugccaaacacgugucugaguucagcuuuaaucugcuuacccuauuuucucaguagagguucuguaaaauaucaaaucgaaugcaucaugcaacucgcccaccacaacagagauggaacguggaaaucccagggcugagagacccagaggaugaaccaggcaggccagaagcugcacuccuucauccacgcuggagucggaagcagagaaagcuccagagugaaaauguucauuaacacccacggaccaaaaaggaaagagccaauaacguaugaaucugaaggugaagauguugguucucuaccauuuucauggugugaaugaaucacaagucuuauuuuaagggacucagaaguaucaucagcaguuccaugugacaauauuuacucuguggggaaggaaaaaaucaguaccuuuaaaauaaauuuccucauugucauauuuggguucagagaagaaaaaaaaaaccaucaauaaauguuauuuucuauuagaacuuaggggcauccagcucagauagcccaaggcaugguaaugaaaggguaacuuuauugcucauggucaucaaacagagccaggccacccacagucaaauggggagggugacugaucuggaggcgggucauaggauagcaagucaugugcaaggauggcuuguccaacaggccaagagcagccauugaggguaucggcuaucacggccucucaaagccacauuuacuucuuaccuacucaacccuaggugaucuucuucaauguuuaacaaauucugaaacaaaugucugggaugcacacuggaaacacaaauaaaaugaauuuagguuuccuuucaacuuuguacugaguaacagaucugugggacaaagcuacuucaccuuuugagugacucaguuuccaaacgcccaucucuauuuuuuuuuaaaaaaacggucaggcacgguggcucacgccagugaucccagcacuuugggagacugaggcagguggauugcuugaggucaggaguucgagaccagccuggccaacauggugaaacccuaaguccacuaaaaauacaaagauuagcugggugugguggugcaugccuguaaucccagcuacucaggaggcugaggcaggagaauugcuugaaccuggcaggcagagguugcagugagccaacaucacaucacugcacuccagccugggugacagagugagacuccaucucaaaaccaaaccaaacaaaacaaaacagauuuucaaguuucuuucucgaauccacggaaacagccaauaaaugaacacaaaugggaaaaagcucuguaggauuugccucccucgcuuaaaugaaaugaauauucuggaaucuuaagaucuucccuuuccccucucaaucuaggaaggccuaggagaucacucagaagccuccguccaggcaagggggagaaggugccagggagcugugacugccgagauacagggauguggaugaagccaggagcguuuguacaacauucuagccauauucacuuuaaacuauggacacuggaguuucuaaaaagagaaaaaaacauuaagcaacauuuacaagccaaauucccugccuuucuuugaaucucaaaaaaaaaaaaaaucaaaauuguguaagaaaugucuuaaaauaaguuuuugauuuuuuacuuuaacuuuaguuaguggacuaauauaugagaaccccgaagugaggggugcacacacauuuagaguauggcacagcugcagaaugugccaaaacacaaauuaggugaauuggacacggggagauccgcagcccuaccgugcagugcaauuaaagcgaagacuguuuaauucuccaaagacucaauaauaugaaaaaaaaaaaaaaaacguuuacggaaaacauggaacugacaguuccaggaacucagaggucaucaaacauaacuagagauuuuuuuauuuuuaauucuguacuuuucccauuuggaacuugguguuaaagaauaaaaugcuugcuuuccaauguuucauagcuuguuaucacaucacccaugagccacgcugcgaaauaaauacaucuaaagucaggucgucaauucuuagaccaaacuagcaaaauaauuuauugcacuaagcgcauaaaaugucaaggguagguaauuagaauuauaugcacaguguguuagucaucuuuaaaaaaaauaaaaacacauauccuguccacuaugacugaaucucagcaaaugacagcaccaaagagguguucaagauaaucaaaaggccaugguaauacgaugccauuauacauggcaccagaagggugugaaguggccucuugugguauagaugggauacguauauugugaugaaucauuuuaauagcuguuauucaacgaagaaaacgugagaauaucacugaaauuauauuggggaagcuuagagugcuaucgaaaugcaaaaugauuugaguauauugcuguuucagugccuguuuuuauuucaaaguguaacuaauacagugagauaaugagggacggcuaaugacgacaaaagaaugcuggucaaagcuacucuccagccagccuggacgcagcaucagcuuccugagagccuggcaugagcaguuggcauuuuuggucagaaucuguccucugguugcaucagacagaacuggauuugaauccaggcuccaccccuuccuagcugugugaccuuggagagaucauuuacguucucugauccacaucuguggagacaguuuaacaguauugagugcccaguuaucugguaagaaccaaaguauauaauccacaauggaccgaguaccugccacccuggaggcgcacaaccgaagcggagcaucauucucaucgaagucucauauucagucagggcuuggggaaggaaaaaaguacaacaaggaggcuuccauguuccuugccuuccccuuuaccccaucccucuuccaugccuguggaaccuaagguggggauggagggcaaacaaggaaguuccuacaccccccagcugggagaagacugcaggccucccugcagcagcucccuaaagaaaagccuccugugcaccggggcagaaggccugggaagggcagccaguagcuccagcaccagcacacagcgcugguggguggaaacucaagugugaaauccauucuuaccccuuccuguccuaguucuuuuuuuuuuuuuggagacagagucucgcucugucacccaggcuggaaugccauggcgcgaucuuggcucacugcaaccuucaccucccagguucaagugauucuacugccucagcuuaccgacuagcugggauuacagucaugagccacuaugccuggcuaauuuuccuauuuuuaguagagacaagcuuucaccauaguggccaggcuggucucgaacuccugagcucaagcaaucugcccgccuuggccucccaaaaugcucggauuacaggcauaagccaccgugccuggcuccuuccugcccuaguucugaucagaagugucacucucugugggcaugucagccacuuuaugagaagguggcuucagcaggcucaaugagacugguggccuuaccagcaaggauuaagacaagcccauugagccaucuaccugugcugaagagguuggcuccccagugacgagaaugggauaguaagaaacccuauagaaaccagcacccaagacugaccaaauaaaggucaacaaaauaaaggguuucuguuucauuccccaggaguccgccuaaaagaaaggagaggcugcaguugggaggggaaagccuugggguuugcucagagcccugaaaaugagggauugugaggggagaggggagagccagagugcacgccugcucuuccuuauucccauacaucacugccucaguugcagggagcauuagaaaaaaacaaaaaccuagagcuacuucccucucuuucaaaaggaaaaccuuccauuucuguggauaaaucagauucacaaugaugcaucauagaaagccagggaucucaacgaguccucacgaugcucagguuuuccaaaacaaauuuguauuucaggccaauaaaccaucucuaguuucuuaccaugaaaggaaaagaaagccagaggaguggcauggcccuggaacauggaccagcaccucagaaacagcucugguucccaccagaaggaaacacggcucggcugccaggaccgugcaagagccacgggcaaggggcuuuacacaaagcgagagucuuaaaccagaaauaagcccagaaagaggagagugaaggcucgagcagaauaugacaaggggaaugaugcagaaagccuuccugcagggcuucucggcagaaaaggaggccccacuggggcaccuugaggauugugucugucuuguucuugaaagacaaggcuaaaguguccccaagggaaugaucucgacccuacaggucgaaggcgauaugaguuacuuuucccucguaggcguugagcacuggcugaucugcuaccacagcuucugaacugacggguguaaccugcccaucacagacuuagguugggcucaucuaugagucucuuuggaauaugcagaugucagaggcauccgaaccacagcgacuccauuuugagugaggacuagagaaaugaggcugagacuuacugggcugcauucuuagaaaguuaggcauuccucaccucuagauguuuaagguuaagggaacacacuggugauguuuacuaaacagacccagacuugggaguguccuaauauccagacauccugagaacaaaggcguuccuaauuuuacuuuaaagauaauaauaucgggcgcaguggcucacgccuguaaucuuagcacuuugggaggcugagauggguggauugccugagcugaggaguuggagaccagccugggcaacauggugaaaccucauuucuacuaaaauacaaaaaaucagccaggcgugguuacagguuacucaggaggcugaggcacgagaauugcuugaacaugggagauggagguugcaguaaacugacaucacgccacucuagccugggcaacaaaacgaaacucugucuccaaaacaaaaacaaaaacaaaaacgaaaacagauaauaucgauucuugcaaaauauaauaauuaagaaauuuaauccuuuaucacaaacccucguagcagagcagagcuccccauauauaugaguauuguaccuaggcuggacgcauuccuccucuuacuuuugggaaugucccacucugucuauggaguagcuguucuuucacuacuuuauucucuuaauaaacuuguuuucacuuugcacaguggacucgcccuguguucuuucuugugugagauccgggaacccucucuugggaucuggaucgggaccgcuuuuguguaacaaagacaugggaaagaaaaauucacguccauagcgagcucugucacagcgacaucggacaguugggagggcaggcguuucaucggcagucuccuaaagaaggaaguucugcuguguagcuaaacuggaaggcuccucuucugcaguugcuaguuuggagacacuuuucucuucuccugccuugcacacuggagaggauacagguuaaucacacugacagauacacugguucacugagggguaaggguuauuggggagcaugcauguggacauugcaaugacacagugaugaugcucagacaaaugaggucacacugagacaggaagcaucuccaugaauuucuauauagguggaaaacugcauaagcaacuagugcaggagacagaaugauccagcaccagugaaguugcuguggucccgggcaacgaguaugccucaaagguaauccccauucugauauuuuccaccauugauaacuuugucgcauucuuggacuucaucuaaagggaaucaugucauaaacacugggcgucuggcuuccuuuguucugcaccuuuguagaagcccuccaugccaaagcaugcaucagcaguuagugcuuuuggguugcugucuaguauuccacuauacgaagaaccaagaaaucuuuaucuacuguugacugguauuuggauuauuucccguuuggaacagauauagauaaaccuguuaugaacauucuugaacauguuugacuuguauauucuugacuuuuuaauguggaaauugagaccucaaacucacuauaccauagggguggaauuccagcaauucucuguacaaccccugcacaauuccaagaagaaggcaaaagaagagagacguggauauuuugcuuaguuagccgucuugaacuuucccuuauuuuuauuccucugcuuuuaggaaaucccacuugaaaaguagcuauuuucuccuuugcaagucuaucuuuuucaacaaaaaucuuaagcaaaauauaaaaagccaauaccaauugauuccuaaaaugaaucuaucaaguuucacuuuuuuuuuuuccugaggaagccgagcauauugacucauucuagacccuaaaaauaugccuacaucccaucuauuaaaaaaaaaugcaagagggaucugugggcaggaagauggcugaaacucccuucucuccagccagcccccagcaugaugcuugcuuuaaagccuggagcaugaugacacacaccucacccauguggaauaucucuccagagccaaagguaaggugaggcaaguuuucaccaauauuuugauuugugaugcugaagacaugcacuuaagcacuacaauauguaaaugguuuccuacuucaaaaaaaaaaaaaagaagcgaugccaaugauuuuaauagacuuagcaaaacaacuguaagucuacuacacaauugaacaacucuaagcaguccugaugaugcuacagaauuccguuauacucuccucuucauguaaguggauuuucuaaccugccaauuacggcuuuccauuuucuuccuggaguuauacaucaugcgaaucucagauagcacuguccuuggagcuguuuucuugccaguucacagugccaccuguggcugagcacugccuugcugggcaugcauuuauguugaccuguuuucacucuuggucccggaaaacuucagccuucugauacuaccagcccaaugcccaaguuuccuggcagcuuuauuuacagucacuuuaaaagacggaaggcagauuucaauuuuauggauugccaauaaaguaagauuuacagaaguuccccagaccacugggaaaauuacuggagcccacagcugcaacagcacauccccaagggaacaugcuggagaguggcaacuucuccuaucugguuuuaaacguccccaacuccuauacauucccuucccaggccccuuccaggcagaagaggggacugcaguuuccauacugcucacacaaaauuaagcaucucuuuccagccagcucccaacagccucccugguaagcuggaaaaucagcuugggggaucugaguuaagaagaacaacaagaagagugaggugggcagaguuuggauccacaggcucaggacucccguccugggcauaucuggauccccaaggcuggcaaaauuguauaccaaaggaugcugcgggguaaagagggaaauagaugacauuuuagauuuuuuuuucuucugaaaugucuggacacacugcccaaagcauccacauacaaagaagguauuucguauaaagucauuuauaaaaaacagacacucuauaaggcagugauaggcucaguucagcucagcgaacaaggauggagcuauggcuuggucacaggcacagagcuggugcuaggugcagagacucagggauguauaggcaaagaggucucacugcccacugaugugucuggagaggugggugggugaagggacuuuccauuuguccucccaauuuccucuccgaagccugucccuucccugggguccacuacuucucugaccuuuccugagaaacagacuaauaaauguggcuacuuacauuuuacauuacauucuaggagcaaauccagggggccaggagcccugcacucggcuggcugcuuagucccuggcccagaccccagggccugacaggcaucagaggggccccugggucugcugcucugagcucaaaacacccaauacucuuuggugggugggaaauuaagggcggggauagcuccgugugcauccuaggucuuuuccucucccaagagaauucuacucugccacaaaggaacucagccucugcgcccuguggcuucugcugacggguggugugugcucuggaugggggguaggguuccuggcuaggaguggcaguggcgccugcucuggagugucccuaaaugucagcaugcaacauuaccaggcaggcccucccacuucaguccucaggccacucauaggaccuccuguccccauguagagaggcugacaccagguuggagccagcacugaaaggauccccgaacuccugcuucuacaaggcagcauccgcaggugagcggccaggcaccuacaagacacgcacccuucaagccuggcuucccaaagccccgccgggccaggcuggcuggcacagcagacagucaugcagcaggguccccagcgaccccccaucccugagagaacacacggagucccccgcccgccagcugcuccggaggcggcuccaggguagacucaacaaguucccgggccaugcagcgccgccugcagcccagaaacccggaggacgcgcuguggcggagccccgcgcgcaggcggcagccggcggcagccggcggcagcuccuuccaccuccuccuccucuuccuccuccuccuccagcucuggcggcggcgggagggggcuccuccacucccucccuaucccccaccccacgcacgcggcccggcccggcccggccccgcgccgcccccgccccaccuccgccccgcggggcccggggcuccgcccgccucggugccagccgggcgcacaggcggcaggcgcgcggcuuggggcgcccucgccucuggccgcccggcuccgcggaguagcugggaccuggagcagcggaaaggacuucccuccugcucccuccucugccccgcccccgccuccuggcccuggcucugagaucucgccgaagacaauugcaguaaaugaggacaucggaggagcgcgaagccggguggcuguggcuggcuccgccgcgucgcgagcaagcgagcgcgcgggcguccccggagcuggcccagccgcugccuccccgcgcgcgucgcuaagcggggccggagggacgcgagcgacgcgagcugcggcgcgggggccggccgggccagcagggccgggccggcagcgguggagggggcgggcagcaggcgcgcagcgggccaaguccccggagccgaggcuuccuccgcgugagcgcggcgagucuggccgcggaugcccuguccggagugcuccgugccgccccaggcuugccaggguccgcagcgagacaugcccgagccaggcgcugcaucgaccucgacuuaucuguaagcagcggaagguaagcggagccccgcgugcccuccucccgcgcccccgcgcccgucguacuuggccgcgggcagagcaccgcugggacgggcgccgaccccgauucgggcgcacacacucggccccaaaccggcuuggccggaaacucggcggcucccggggccgggacaccccggugcagccgggagcggacccggugcggucgcagguggggggcaagguuaugcaacugcaucuggcgcgaccgggucgcugaggggcgucuggcaacuuuggcgacgucagggaggagcggggcugcgccucugcgauguggguuccagacagacgccacagcuucgugagcgcccgacagcccuagccaggcaaaacugggagaucugggggcggccgucuccccggaagguuucgaggcuuuuaaguauuuuccaaacuaaagcgcccuggaaaguacaaguacggcugauuaacuucgggggggggaugaguuggaacagaggggcccugacgccggccguugaggagaggcgcgagcagcagugaaggcagaugcccacgugaaaugcucgucuccuccacucgcugggguuggcaccuucccggggcugcggguuggggucggcgccgcggggcuucccggugccuggcagcccgagucagaccgggacaggcgugggaaaccaaccaacgcugcagaccuaagagacugcgagcuggcgggcgagggcaggagggaggagggagcccgcgggcagcccggggucggggcagcuccuggagcccaaagucaagagcgagagucugcaucuugcugguucaugcucagggcuccaggcugauguccccacugcuuggauaaagagccgcucccugugaccucagcauucuacuacccaaaaauaugccacagggagagggagccagugauaaagagaugccaggagugggggaggagaggugccucuggaguaaauaggagagaaaaugggugcguuuugcuuaucuacagcccagggcucccgcccggaccccucuccugcuguuggucugugcuggggagcugcacgcgcucugggccccugcgccagaagcagcggugaagcgguuuacuuugaccuugucugcuuaggcgcugaaauucugcggaagcaucccgaggugaaacugcaagagugggaaugaacuuugggggagcccugccuuggcugggaagccaaacgaucauuucagaagacuacagcucaggauagcacaggguagacgucugugcacuugaacgcuccccccucaacgaggacuugcuagaggguuaccuuuccaugccuuaucucaguggggggacugucagagugacugcgcuggcuggguacuugaugaaaaaauaccacucacaagacccgggccauucccagaguaguacauacaugaaaaugauauaacccuuauuaagcuuacgcuacagcaaguuaccgucauuucacuaugcagaggcggaaagugcugguuuuuacuauucccccacacuguacuauuucuuacauucauauccuguugaauguuacuuuugaaaguucauauuuaucuuugcaauuuuuuugcaagaaugauuagcaaacaugcacaaggagcucaaagaaaaaauggaaguccugccaucugcaugccucaccagauauuaaucauuuacuauccauguuuacuacuuacauuagauggcacugcuccucacgaugguuuuauuagaggcgcauuugguuaaggaaaagaaaaagucuagcacagcuaucacuaauugcaugauuuugcauaaauuacauuagccauggagaguuuuguuuucuucacuaaauucaucauuuuguuuaaaagacuaaacaauucaguuuaauuucuuuagcuaaaugaaagacuuuuccuuaaagacaagauguccuugaaaagcuacauaugucuuuaaacuuauuacaguugccacgacuuuguauuuuaucauugugauuaagacuuugagcuuucauguaagucaggcccuuuauccuauuaagaaacagaauuacugguuaagaaauaggcuaacaaggcaaaagcugggaagcuccaugucugcacaaugagauuucugcaagcucuaugggaggcuggguacucuauuacucuguuuacuucgggggcuucucuguuuugccacaguuguuuuccccuguggcaggaaagggaauuuuuguguuuuguuucucccucuguagggaaaaauuuuuaaauaaaucaauaaauaagagaaagacuuguacgugaaaggcauucaucuacaaggaagacuccuacacacugaaauaagcaguccaaaaaucaaaaugauucucagaaauaacaacggaucgcaguggaguggcaggacagacccguucacguagacauuuguauucucuuguuugcgcccagccauggcuaucucauuuagagacaacuacugaacucuggaauaugagaagcaggugacuuaugcuucucagagacucaugauacagaaaugaucacagcuaccucccaaagcagcagcucuguggucagauauuuacguaggagggcagugacagguucaccacggauuuuaacgcuugugaaggaugcuguucaacgcguccauagcauccaagaagcucaguugggaaggcaggcaaauucuacauacuugaggcaaaccaccgucauucugggagugugaggucauaaaaacuccccagauaaaaccagugucaucgucauuuucaacagucuuucauaaaugugaagcaccacaaccccuccccaccaugauuccacugguuggagaccuacauuccccaaccagaaauuagcuggcaugauuuaugaagcagauccuuuuuugucucacauauuugauuuuaauauuucauaacauuauggggugacuucaauauuuuaaagcaaaauuuaauaugauugauacuacaugacgacacuuucauuaccaugaaauucucauacaaacauugagagaagucuuuauuccaauacuggagcuaaccuaugauauauauguagugaaacuucaugacuuuuaaucaguuuauuuaaaauguacauuguucuuauacauuaaggacagaauacagacuugcaggaaccaaacuauagggacccugacaggauugcuguaaacaaguuguuuggacaaugucuuguguuaagcacuaagccaugaaaggauagguuugaaccuuuggaccaugugugauaaugugucuguuucagauccugaaggcacuaacuaagguaucuccaggcaaccaaggaucuuaccucucacauugagaaaaaccauaacuucagagacauuuccuggcuccaaauucaaguccuuucagagaccccucuacuguaagucacaggauauucagugugcauuugagucguacgugcuuuagacauuauucaaaccauaaugaauggguugagggacuuugagguguauaaagauguuaucagaugacaaaucacuaccugaauaaaaacaaaacauucuaaccugacaaaugugucucuuucugcugaguauguauucccagcucuaauugggacugagagaaaauuaacuugaauguagaacagcagauauuagggacaagcaggaauuaugauucuaaauuacucuauaaaccuuuuggcuaacaacauauuucaaagggauuuggaaauaacucuccccaaagucauuauuugugaauauuuauuuuauagagcacugaacuguuuauucaaaguauugcacauccauagacauguucucuuuaccacacuauccugcuguuaggaaguuugagcaaaaaaagaaaagaagagagucuuacaucucugcacagcauacauucauaugaauuauacuauucuauccaauagaaugguaaagaaacaaaagaaaaccccaccauaucaaaaugcuuguugaaguuuauauucuacuuaauauggaaaauuccaguucagcccuuaauaaucuagcuuuggccaugaaaugaaaugcaguaaacuacaacauaugagagacaugggaaggaggcuacggaaugcugaaaauacuacaggcagccuugcaaauaaaaguugcucucacuccaucucagcagagaugaucacagcuauaucccaaagcagggguuccauggacaggcacaucccagagagaaagaggaaaaagcacaggcugauggcaugagggccuuuuuacagcuguucaguugaggaagcagcauggggcuauauccuauucacugccaaccuuaaugaaauugagcagucuuuguguuucuaggucauuccacuggugaugugagaucccccacccuuguucuucucuaggaaggaucuuguauuugucaaugguccuucuucauguuuuuaaaaaucuuuucuauguguacuuagugguuacauuuuagauaccucuuacuaccugcauuuuguacagugaaaucugcuuauuuuuguaguaagugauuuuagcauccuuaaaaaaugcagcaaagauauaaaaccugggauuuuuaaauggggcaagcauagggaagguagauggauaugcagauggcuuuguucagagaggacuucugauuuguggauauguacugagcuguugcagcaguggccaaggcaauguguaagguguuacaagaccaagugagaggacuccaagaagcucaaguccaggaggaggggaggagguggcaaggaaguggcaggagccuaaagacucccagguagaaucaggauaggagauuacaggcagagagugaugccccggcucacuucgugggugaugcuugagauugcacuccugagcccagcagacauuaguccuggagcuuaagccaagugguagggugcucagggcuacagacuuguaugggaagagugagaagugacauucagcaaagguugaggugcuggaaucagagaguggaggcauagucuggagucaguuugaggaggaaccagcagggcaagaggguccucuguugauguuugaaacaagaacauauauucucagaagauuaaggcgguauaacuagaggcaaaccagaggagaggaguuggagaccaguugagaaggugucacagaugagaaugugccagucucaguagcacugggaaguaaguuagggggcagcuaugaguaaaaccuucuggcagacaagucuuuguaauguggcaagauagaaagaagggauuaaagaugcuacccaaggccagcaaggcggugggggauuuuaauggcaacagaaaucugggagccagcaggaacggggggggggggggggggaagauaggauuucuauuaaauauuugagugugaauuuucaacuggaaauauuauuuaaaaaauaaguuuuucauuaucucuuacguccuagaauguccacaagaaauacuuugaaauaggaggaaauuggaugaagcgauucacagcgcaaauccuuaaaugacuaagcauaguaguaucuauaacaggugcuuaauaaauauuuaaugaggcuacuaacacaaaccuagccagugauuuugcuaccaacucagggaauccugauugggaaagaauuguuuucuuccauuuccacuuguaacuuuuuguguagcaggaauuaaaggaaacaccgugagaaggcaguaaagaggaagacggcuuccagggcugaacaguacugacgucuggccaugcaguguuuagaaaagaaaaaagcaccaaaggguuggguucuuuaccaccaaacucaaccucagcgauuccuuuggugaaaauucaguuggguagaaguugaguuuuuagagaaagaaugucuuugaauuuggugaccuaguauuaggguaaaagaagcaaauaaggagaauugagaaaauguaucucacugcagucagauaaauuaauguucuuauaacccaaaugcugacauucuggguuaaaaagaguuuucaccagagcucaccaaaaaaacuggagaguucaucgggccagcaugagagaaggagaugucugucucucagccuuaaccucacaucucaauuugacgucgugacuucaacuccauugaucucugugccagacccaccaauuuaucauuuuaaaaaucaaugacagcgcugcauaaagauuauuuuugucuuuuuuuccuugcguaaaucacacugcacaguguccacuuaaccgugcacuugagacucccauagcuuagauaaugugccaugugcaaacguacugugugaacuuaaaggaaugcugaaaauaugcuguucacuuucaaaccguauuuuucauuugacuucuugcccaaugauaacugcauuucucaauuacuuacuguuuuaguuuuaaagguaguuguuagcucaguggcuucacugaagucauucauauccucauuuaauuuguuuugcacuugcuauuuauauuuuagucuugcuauauaauauuuauucugaauauauaucuacuuuauuuauugugucuaucacauuuguccauguggcaaaaacacccagggugaggcugaaugacagaaguuagcagguggcuggacacuggagccucagacagagugcccaggcucacuggcaggguuggccccacacugcacugggcaggucaacuacugagugaguggcagagacuggaccccaacucacuccuaguaauuauuuaaaauaauuccacauggaagcaucaguucuaacuguaucugaagagucagugagagugaccacuagcaaaugcagcuuuaaaguauaagucuaagacaaccguacaguuuuuaaucagccacucaagguuggaaccuucugguggugauucucaagcuugugucucguagguccugcauccagugucauccacaugcacaacacaucccaaggugugcugucuuuguguacauccacuucaucaccagggcuguguacugagcgcuuccuaggagccgaccaccugagcccugacccagcucacaguggagugcagcgugguggugcgguaacaggcuccaggccaggcuguccuccuuugcccuccuggcucugccaguaucugugugaccuuuggcaugugacuccacuaccugugccucuguuuccccaucuuuauuacaaauaguaauuucuccuucagaggguguuuggagaaugaaagguucagacauacacaaagcacagaacgguaccuagcuugugcugaguguuauacacaaguguuaccuuuucugaucuuugcucucccagguuagaucacuugcccagaguucugggcuauuaaguggaggggaagggccagaacucaaauccaagcagguggucucaaagccccaguucguaaggacuacggccagaaauuaaccacguuagcaaaccaugguagcaugggaagaccuugagcacccccucucuaaugcagaaauuccagaguuauucacugugcaaagacugucaauguacgaaugacuggucucaaaccccagauccaugguugaaaagagcugccccaagccauggaauuucuagaagggaacagaauucuaaauguuuugcgucuccaaccagaaauauauauacauaaaaaaaagugugaauaugcccuauuccuacuaugggucugcucagugacaauuuacuuggaauuugccaucccauaauuaauggauguugugaaagaccuggauuuucauccaugacaauaacuggccacuagcucucuccucuguggaacaugaauccaccccaucuguuugugcacagcacagcccagccaggccagggcacagacacucugugggccugugugggaucugcuggugaucaucccaacaccuggcugauguccagguucauucuagaaaaaaauggaaggggcucaaccucccugcucccccgugacauucacucauucauuaagcccuucguucagucaauauuucuggguacuuuuuguaugccacaaacuucucuaagcuuuggagauacagcaggaaauagaagacaacaaagggugaaaaagauaaaggaagaaggccagugguucuuuaucguaugugcauuauuaaaauuauauuaggcauuuaaaacaaacaguggaacccagucuccauccuccagaaguucugauuuaccuggacugggguagagaccaauaugcuuuugcuuuugcuugcuugcuugcuugcuuuucucucucuuuucuuucuuucucucuuucucucuuucuuucuuucuuucucucuuucuucuccuuguuuuuuaauggauuaacuuccuggccuccaaguguggccuucgagggagcgaggcugagggaauagagcccuuaaggaaaaaugcuuguuuaccuccuuccuguaggaggacagccacccccuggauuuucuucuacguggcaggauaugcucucuuuaaaaacccacacacaaaaacaaaaaccaaaacaacuuuuaaaagacuccauuucauccacaccuaugcucuccuccaaagcuucaagaaggcgaaagcauacaggggucaugugagguuuuggaaagauuuauguuuuccuuuuucaagaucuuuuuagcaugcucaaguccacagagaaucauuucacagaucaucaguacugcuuacucacuacgaugcuaacuucuauucaugaacuacacaggcuuuugcuacuguucucuuucucuuuuccacaagccuuguaaaguagcagggcaucuguuccaaggaggugcuggagagauaaaaagauagaggcaaacgcaggaauauuugcugaaaaugggacucuucauugaguuuaacacuuaauguguuauguguugggugcuucauagaacaggaaacuguaugauguccugcuuugggugccugcccgagccugggcucuuguuuugccccggggugaauugucacguucccuucuggacaggagaugggguugcugcaacuggcccuuuaagagcaaccaaaacgcugggagucauggcugaaggcuaucaaaacucuaugugccugauucaaggaacagcccacagaugucccacagcugaccuggacuuauguuccagcacacauccccuuccccuccuguaucugugugugcaugugucuguuugucugugcauuucucucgacucaccguuccccuaacaaccucucucucuuuauacauccccauugcccuucuccuuccucuccacguucaucucaauggacaacagcaguguggcaugagauuccuaaguacugcgcuuccuuauuuaguauaauuuuauauucauuguucucagucuaaagaacaggaaaaugaaagcuauuucauucauauguuuaugccccucugauacgguuuggcucucuguccccacccaaaucucaccuccaauuguaaucuccauaauccccaugugucaaggguggaacuggguggagguaacuggaucgggggggggcgggggggcgguuucucccaugcuguuaucaugauugugagugaaaucgcaggagaucugaugguugucuaucggauguguuaaggagagccucccaaguagcugggauuacaggcacgcaccaccaugucuagugucuggcauuuccccugcuugcgcucauucaguccugcagccuugugaagaaggugccugcuucuccuuugccuucugccaugauuuuaaguuucuugaggccuccccagcaaugcagaacggagaguccguuaaacaccuguccuuuauaaauaacccagucucaggcauuucuucauagcagugugagaauggacuaauacacccuuggaagucacuagaacccuggguaugccccagacccucuauuguuuuuuucccucugaaagccagugauucauccucuagagcagauuagacaacugaguuuaggaaaggugccaugcucuaaaacguuguuauuccaagcuauugagauuuuuuaauuaaacucaauuuauuuugccacuaccauaucuugggaguacccaagaagaaaguugaguaauauaagaacaaaccuucugauaauuccuagcaagucacauuuucuacaacaguauggggccccaauauacugcaugguuaaauauagaaccuguaccauuucugugccaucuacucauuuuugugagugugugugccaucuccuucucucccaucagcaccggaaacauuuguacaacaaccacucaagguagucaugccaaaguucagaagauaaagaucucuggauaugguuuuaccucaacgaacaaaacuaucccuucuccuuuccacuucucuaauuccuacucauguuucauuauacagccagguucuaccuaaugugaggauccagauaauguaaaaagacuccuuggaagccauuaauauuguacacucauccuaagucuucuugcuguaucucagcuaaggucccagcucuaaggauacugugauguauaguguuaagauucucuugcuggagugcaguggugcaaucucggcucacugcaaccucccacucccugguucaagcgauucuccugccucagccucccaaguagcugggauuacaggcacgcaucaccacgcccagcuaauuuuuguauuuuuaguagagacgggauucaccauguuggccaggauggucuugaucuccugaccuugugauccacccaccucagccucccaaagugcugggauuacaggcaugagccaccgugccuggccaguguuaagauucuuaaaccaguaaguaaagaaggaugacugagcauaggaggaagacuuagagggaccuacuccacagaacacuuauauuuguguuaaggagagaaaaccgacacaaagcaaagcaaagugagcauccuucaggccugcucuugcacaucucccagguagagccuacccugacuccccagggagcacucucaguacuucccuccucuuacauggucuugugcacaguggacuggugucaggcaucaacgugucucucuccugcuggacuagacacugccaaagaguaugccuuguuuuuuccugugugcccagcauccaguauggugccuaggucaccccaggcaugcacuguucagugaguaaaugaaggugacagguaaggacuggagaaggcauagaagauaagacuagaucuagaccaccaaacacagacuauccaugaggaaggaggaccagggcgcgguccuggaaaaugaaccaguggaagugaagacacaaaguagagacugaccaugguguguucaggagacagugcaggaaauggcuuaauggaagucagcagauggagcauuucugaguagccaagagaaaucuagaaagaugagcagguaggaaaaaguauagaugaucuuauaauaagagacucuuuggaagugcuaccaacugggauguauccagguauaugcacagagaagcgacgugugcacuugaagccaagacuagcaggaccugcaggaugggggacggggguggggcaugggggaauggagagcugagggcaggagaguuaugaaggccaagaucagggugggaacaguguggaacuaaagggaagaaaucaguaggagaagcaacaggaaggaaaaacaaaaacgaauagggcauggugacgacugauuugggggauuagacuggggggggaaugaauugagcaagccguuggcagcacuuguuggaagccuucagcauaaaaauacugacagaaucuacuaaguuggagaugggucucgugaccccaaugcaaaccaaguccaguccugccuuuaacauggggugucuuuugcuccaagcucagcugggguaagcacaguagcuguguugcuggguugaguccaggccacccuugggucucaggcauuacaucaugucagacugcuucccaagaaagaccacugaguccuccuccuccagauuaccagagacacugccaaguuuuucaugcacaaagagauaaaccuucgaagacauuagaugaaacuuugugagggaaggauaugguuucauguuuuuaaaaaguagcuacuuauuaucaugcacagagaagacagagguucacaacagcugcuggucaagggaaaaauuaaacaaccaacuaaccuggcagaguaacaccaggauugauaagagguagauuuuuaaggaauaaaauauacaguuucaaguauacaauauauagaccuuuuguuuauuuucucuucaccagccccccaacaaaaaugacauuuuguguuaugaaugcuaaaauuucgcucugugcacacuugcaaugaauagcucauucaaaccaagacagucuuuucagacuaggccaugaacugcaaacuguaugagggccgagaagauuacaagcacuaacucuuucugcagacuucgguuaggauuguguacauggaccccaagugcagguuauuuucucuacauuuggcuaucagcuuaggaauagaagcucauuacaagaaaugcucaagucuccuuuucuuccuggcacagcuaccucugcagugaaccgaagaccaugcaaaguuuaggauuuggccaaaccaaagaaacauuguggcauuuucauacuacgaugaaaauacaagagggauccauucugauggucgaguugaugggcauucccauggccuugccagaaagacagacugcaucuucaacucuaaaugacuuccauuguagugaccauuaccuccaagcagauauccugcccugauugucccaauaggguauccucaaauaagacugggaagugucagggaaaacagacuccuuugauauaagucauuuuuaggggggaaaaaaucaauguccuaguuuuaguuucagauaaaucaugagucaaaacaugcuguuuaguuaaaaaaaaaaaaaaaaaaaaaaaaagauucaccauaaucaggaaggcaaagcacuccccaaguacauucuaguauguaucuuuguguuuucaugugagugagauucccacuaagucuaaaaaagggagaccaccucuucuguguccugccaacucccgccucugaugggccccaaacuaccagcugauuguugcuucaucaccaggaagccuccagggucagugggacaccugcuaucguaacuaaagguacucaugagcuguguucaaagcacagcccuccugucucacacucugucacugucaugaugaugggaaacagggaggcagggaaauuaguuccuuuuaccaaucucacaggugauuuuggugaguuguuggaaccaacuguacugaacuccuuuuggccauuauuagcuggcauagcuaacugcugcaaauaaaacuuuuuuuacauugacauaaugucucauuucaaggaggcauauuuuccaguugauuuucaccaacaucauaaaauuuugguaauucaucucuaugaauguagcaggaugagcaaagguuaacaucaacauaagcugaaaaucaaagaacuggguagugaaacauaaauuaaaagucuggaccauuuaagagggccauucccugguucuuuuaaaacaugagcaccaagcaccaagccccaagcaugcaugcuugcccuccuuuguucucacuccccgaaguaggccagugugagccuuugugguuuacauuauguggcuaaagcaacugaccauagguuuuuuuguucguuaagaguguuuucuaaaaccgcagauaugcaugagugggggcugaaccuaagauagguuuucuucugccucgaugccuacauuuaaccucugugagugccccuuuucccugcuuuggacuagguggucaucaguucuuaaugacagagguuucacugcaauauucuacacaucgagggaacggggcgugccaucuccguguuuccuccaaggagccauaguucugcaagaaaacaguuccucacgcauugcucagucacacaagggugucugaauucauccagucaccccuuuuugguccucaucagugaccucugcugaaaacaacaaauguagggaaaaaauaacauuucacuauauaaagaaaauuaaaccggauaaugaaucuaagacacaguccaccaucuauggcagcuggcuuugccccaaggaaaagaggacuuccaguucugaagacucaauuggcaccuaugaaacaggucucuaaguuaacuauuucacaaugugagugacuucauuuagugagugagguucuauuuuaccuccccuuccgguggaagccgguggugaagaaugggauguucauuuucaccauucucccauucugaguagccucauguucaggcacccccuuggcauauggaagaaaaugcugacccaguucaucuugaauccccaccagcaucuuugacuccaaggugucugaacagugagaaagccacuaggaaaacccauaauuucauacaaucccuuguggcacuccucugacugcuugccuagcuaucuuacuauaugcggagacugcugggcccugggaggugucucggucagacuggcagcugccugcaucuucccccacaaaucccaucacagggucaaacugcaaaccugcaaaucagcacggacauuuuaagaauggacagaauccaauggagaguuucucuuggcagcuaauggaaccccacaaaauugccuucagacuauugagucuguuuuauuucuaauuaaaacagaugcuaacuuccuuccuuacaguacguuugcucaaauauugacauaucuucugcuaaacauuuaacuauacauagccaaauacauacgcaggcacguauauaccuaugcauauauacauacauauacacacuugaaauucauuuucauucuuuaucagggcucccucaaaacaauaaaagaugaccuuugacaaauuacuuauagccccaucucaucauuucuggguuuuucuuauucugauacuagugguuaugccuuccagaggccugcuucagguguggauuagauuuuaccuuguguuauuuucauuggcaaaaccagaacgacgcuguaccucccuccauucuccccaaauuggaaaacagaaggaaaaauaaaucucuccgaaugugcuaucuuaauaccacaacgaugaccguuuuuguucauuuuuuuccaguauaaucuguagacugcuuuguuucacuuaacauuauuucguguuuuucuaugauacuaaauaaucucuauaauuauccuuuuaauggccgcccagagugaauguaaaccauaauuuacuuaacuguuuaccuauuguuagccauuaaguugcuuccauuuuucacuuauuuaaguuggaaugcacauuuucauaucagccauuaauuuaaagcagcaugcagagaugguucuccgucacuaaucuaaaaaugcaggguuuauguauuuacagcucacuuugauuaugaaauuuaauuugaggguaauuaagacauuuauauuccaaacagcuccucgacaucuagcucucucgagccaaacaggcacaaccaugacuagccauuuucaccucaagacagcacaguccaaugaauucuaaaacacaauuuucuuacgaaaaauaaacuuuaugaacuccugcugcuuuagagccaagagaucagcuccccaaaccagaguccaugguucucuagggugacccagccaaggcaagccaucaugaagaauccuauugcagcuucaugcucaguccagaauucaaggcaacauucacucagugcuccaacacccacuguguuaccggaacuaccuggauguccuugccuaaccagcacccagauacacugugggaacaagacaagggcauugcucagaugaguuucaguuguuugauguuuucaaguuuaucauggaucacuucaaguuacagaguuccuugagcagggguaguggguuagggcaugugauucaaacggauucagcuguuucaauggguguggcccacuagccuccucacucugagcaaguugcaaaaaaucccaaaaucgugugccucgguuucucaaucugcaguaugaggguaucaauaguggcugccuuguaaggauaugaugaggaucaaaucuagaaaacacaacugcuaugcauaggggaauggugacauuugauuagcacauaggagcacuuaacugcaugcuuacugaauguuaaugcuacacuguaacguauguacauucacuugcugaauaaaugcaugaaggaaugaugaaugaaauagugugggagaagguuccacuugucuuagggaaaguccucuguagaaugccccauuuccuuucauaacaaaaucauuuucuuaaugguaaucacuguaagccuuacccuccacccccaauaaagagcaaaugaacaccccgaaaagauguguccaccuuaguaauucuuaauguccagaaauucaauuuuaaagcuuuagaaaaugucauccagccgucagaaagaacucauaaccucauuugaagccaaaauaaaccagccacaaaaauuccuugguguuuucccuaucagagaauaagaacucaauuacuauuacuguuuuuuaagucagcaauaacaaacuaaagugauuaaaaauccuaaguauuaccaucauuuuuuuacuaacaacgaaaugauuuuuauguaccagcaacccucuauaaaacagagaagagcuuagaauuuuuuauuauuauuuggccaccagcaauuaauucuucugauuuguuguauuaguuugaugguugcguccaagaccuagaauauuucuuaccccagccaacugauguaagaaaauuauuucagugcagucccuagcaaauggugaugaugaauagcauggcaggacaaacuuauucagacacacauuuuucagaaguagcagggaaaaggcugauaaauuacuaguaaauugcuuuuuguaaaaaugcucucucuuucaaauuuucccuaguaugaaggucuucugcagaaugauggcacaauacauucugacauaccuggacaacaaaggcaguuaaagaaugaauaggagaucagagugaagguuaagauuuaauuuucuuauuccacccccacugcuacccauacugucccccacaccaagcugucuugugugcaucuguuuaaccugcugggauaagaaucucuaaaagccaucgaugcuuucuccugagcaggcacgccuugucccuccuuccaccuaucaucuagccaucccaaacggggccaagauauuggugcaucuccagucuguuucuugccuuuucucuccucucuaaaacugcccaguuuuucaaguuucaaauugcagcaaucuccaaauacccccagcaccuaguaaagcaccaaggacuuccuuugcugucuacgcaagccucaccuuucaggacacacuauaggauaaucgaacaagagcccgaggcauccagaggugcaagggcuaaugcagugguucucugccaggcaagacucugcucccaggcucaucugguaauggcuggagacauuucuaguugucacacugggagggagcggugcuacuucuucaguggggagaagccagggacugcugaccacccugcaccgcacagcaaagccccuccaacagcaaaugauccauccugaaauaccaguagugccaggauuuagaaacucuggucccaccuaaaucaaaugcugcagagauuguuuuuuguuguucuuacacaugauuaccuguuaguuguucauagcauaauguaugaagaauuugauuccuucacucuuucauccagugaacagcaguggaggccagcaaggugacaagaccaggcuggccugagacauagaggucauuuuaauagagggcuagucaugucacuuacuuuuagaugguggcugugaaguugucucuucuucccccuuauggaaccaccgugcaccucggccugucaugcuaacucaguaagggcuaaggauguggggaggggucaugccucugucuguuggacagcugggucuaugagaacagcauggauucagcgguccacuaaaguaggguccugcuccugccugcgcugcuuauuuccugugugacaccgaaaaaugacgcaacaucucugaacccuaguauccuccuugaaaugggaaguguagccuugaccuucaggaacauuuguaagcaaggcauucuguaugugaacgagcagagcaucuggcacucgaaccaccucacuccagaagcaguggccaugcugcgcaugucauaguucuuguggcauuuuccaaugagugcugccacaggucucugggcugguuuuucagacacccccaggacagggcacaaggucggcagcugggcugggggcaauguggacgaagucuguuucugugcagcucucacgggcccauguccaugaccuugccucucugggcacucagcuccagccacucgggccccguacacccucagugccuuccguuugacuguuuucuucucaaacacaaggggggaaaaggcgaagccucacucacaaacaacacacuuaacucuauuuucuugcuuuaagcgcagccaucaaauaaguucuuccaugugcaauaaacagcugugaauccgccuaauaaagugaaggcauuuuaccccacugguauuccccgagaggagucauuggccaccugcaucuuuuuagcugcauuuaauaauucagcccaggaugaauuugcaugauuaacauaaagccucauaguuuuauuugcuuucagaauuuaaguacugaaaccaccaccauuguuuucauuuucggagguugugaucacaacacaaaacuugauucuagaaugaguaauuucuuuuauuuuuuuuuuuaagaauuauuuuccaguaccacucuccauggaauaaaaggaguugcaaacauggccuuuguagaugcagggaaacccacguuccuuuuagagcugauguuaacccaugagaagcgaccaccccucgacgacuucuccuucacgguucccacccaggagcacggccaacucucccccggaauccauaacggcucacgcaaauagauuucuuuccguuccuccucggagggcucuccacauuuaucugcucgagacguggcagcuccaguaagucuuuaaaacagcagcucucccagauuccagcaauagauuaaugacgucauccucaaaaaauagucaaaacgcaaaccaaauaaguagcacuugguaaaccaucugccuaagaaggggagucacgcgugugaaaagauaauuugcaaagcagaagaggcagcaucauuggguuucuugaugaauguaguaaaacagguuugucuaauggggaaacaugcauuacugucaaaaggaaagcgaguguaucccaccuggaaaagcaagcaggcuuuaauaucugagaagcauuucaagcugugcugccagcgacucucagcccgugugauuuuccuuaacauaaaggccgaccucaccugcuuaaauauaauuaggaaacaggcagucgucgugguggcuaaaaguuugugcggccggugcuugaguguguauuucugucccacugacaccucuguugcuguuucugaaugcaggaaccauggucaguaaggacaccggcaaaugcauacucacaacgucggagagugaaguggaacccgccgccugccuggcccuggagaugaaauacgcccuggaccccaaccggcagauuaaaaaacggaacaaagcccugcaggugcgguuuaaggauaucugcgaggcacagaaugagcagagggacacacagcuguccucgggccagcugggggagaagcgggaggccaagcccguguccugcagagcagccuaccgcaaauacaugacagugcccgcacgcagguccauccccaacgucaccaagagcacaggcgugcagaccucgcccgaccuuaagaaguguuaccagacguucccucuggaccgcaaaaaggggaaccucaaaagccucccagcugcagaucccuuuaaaagccaaaacaauggguuucuaacagaugcgaaagagaagaacgaggcuggacccauggaggaggcccggccauguggcgcggggcgggugcacaagaccacagccuugguuuuccauuccaaccaacacaugaacacaguggaccagccuuugggggucaacugcacagagcccuguaaaagcccggagccgcucagcuauggagaagcugcgcuccaaaacuccacucggccuccauccgaagagcccgauuaccagcugcucgggagggccaagcaggaccgggggaggccaaacuccgaggagcccgcuccaccugcccucaggaggguguuuaaaacggagguugccaccguuuacgcaccugcccucagugccagggcccccgagccugguuugucagacucugcagccgccagccaguggucacucugcccggcagaugacgagcggaggagagccacacaucucaacgggcuccaggcgcccucggaaacugcccuggccugcucacccccgaugcagugccugucccccgaauguagugagcagccgucgcagacucacaccccgccggggcuggggaaccagccuagucccacagcgguugcugcaggugaagaaugccaacgaaucgugccucauacggaaguggucgaccucaaagcacaacuucagaugauggagaacuugaucaguucaagccaagaaaccaucaaagugcucuugggggucauucaggaguuggaaaaaggagaggcccaucgggaaggguauguauguucacccaugucuuaggaagcuaugcaggcugaucaccacagaguccaucuguagccccaaacccaagucuguaaugagacuaaagccagcauuuccguaaacaggucauagucuaagggcguggcgagcuccaaggggucgcagauuauuuuaugauacuagacgucacugcauccugcacgauacgcuuucugguuaauguucaucuuucuggccuugaauucaaaccauaccuaugcuuagaaugaauugauagaccuuuccuuuuauucugcuagggcuaaagguuuaugauauugauaauguauaacaacauaugccaguccaaaauaucuauucuaaauaagaagagaaucaggaagagaagaggccacaggccucuuaggaaucguauuaggaagagaaaggaaauuucaugugacauuuggaaaaguaaaugcugacuugcuuauaauaaauaauugaaauaauauugguauucaggacuguacaaggcuuuacaucauagacaguguguuuuccauucuguaccuggaacccaaagaagcaaugggcauugugagaccaguccugacuguauaugauuaggagacagaugcccuuccccacgggcugcccuauguguccaguggggcugcagaaagaaugauacuaacuucacggccaauacuuuauugcguugauaagaccaucuugcacuucauguuuugaaguuuaaacugugcagcagcaucuuuaaaaacaaaugaccuaaaggugggguuuuaguucuugagcuccccagugcggaagccuccuacaggccggcaugugcucagcugauacaaagcagccuguucuacucugggucuggggguuaucggacuucgccuggauugccgagaccucucuugcccauugccccuugaaagugucuguguuccugcuagccuguguacuggagguaacaucggaggcagcgcccuguugccucaugugaugugcacccuucacucugcgagcccugagcccuggguuuagcaagcuagaagccagccugaaauaagccaaguaauguauuuccaggacagaaaaccaccugggcacaaaguuuccuuaagaggauugcuguggcugaguuagacaguuugcugacugcaaagaauggggaggaaacaccuccugccuuaagguggaggcugaggugaaaggcccagcuccagcaguggagaggcuggggcagguccugcccugggcucuggcugcuccagcuuggugcaggaggccugucuacagcuugaugcucuuaagcaaaaagaacugccagccaaauguacaaaaaucuuaacaguagauucauagguaaucuaacaccauauaacauuuccaaaaggccuuguucaaucuuggguuuacaucuccauuuucaucccauuuccaucaguacagauccaaaagcaacacucaucaggcguggggugggggagaccagugauuuacugaucaguaguccacauuccugcaaaaaaauuaaaaggucaaacauugacccagucacugauguugauauaguugguagugaauuaaaccagacagcaaaagagaaagaugccaacaucuuuggugaaauaaaguucaccaaaugguguaaaaugaaauauguacacuaaugugcauacucacaggagugugugcccaaagaagaaccugagagggcugaacacccacgaacacaagaaaggaaaaccguacgauauaugggagcgccuucuuacacuccucuuagaacaaguauggaagauugcuuuaaauaagauccucaggguucucugagaugccauccaucuagcagugugguucucaguuuacuaagacaugucuggguaggaaucuggcacugagggcuugggcaagggcuguaugucucugugccuucuuucuucaccuguaaguugagaucacugucuguccugcagacaggggauggaaugacauggggugaccuucuaauguguucagccuaguggcaggugugucugaauggguagauguccacuaguggcaugaguguugaucuugcuggccagcaaugcuggagcaggggucuggggaggacuuaguggucuugugggcguccaaugugaugaaugcauccccuauaugcccggcacacaggcugccacacaagacugucccugaaacucuggagcugcucuauccaauacaguggccacuagcugcacguggcuauugaaauucaaacucaaugacaauugaaacuucacagucacagcagucacauuucaaaugcucgauagccacauacauaagacagugcagcuacggaacauuuccaucaucacgaaaugucauucacuccgguaucccagaacauggcacagugccugguucuuaagcaucugaggacuugggcaccuuaaaucaagacaaaggaugguuuuacuuuaaaaucaauccuaguucaguugcugccagcacaagcucacgguggaagguagaaaggcaggucucuguuguguuccugggaacauucacuuccucucucucagagcccucuggacucagauagcaaagaaucaagugccaccuuaugggcuccaaaauucaaggccaccuuauggggcccccucuugcucaaugccccagggucauuaauuuggcugaaauucaaauuucccacccgucuucuccaugucagaacauaggagaggacugcagccucagagacaggcagauaagaugcaagcucauucuccaucccuucccagacccuggguacagcacagagucccaggagugacagcugugagcaguggcagccagcacugggcugggacaucuggaacaacaggcucuggagggaagggaaguagcaucugcugauuuccaugguguaaauacugcuaccguggccaauuucaaucucaugaaauccuaaaaauguaacacucugcuccacucagcacccaaccaaucccuugaagggcaaguucuaggacuuuagaacgagggauucacagggcuuacuuuauguaccagaucugaacugggaaguugguauuuuaguugcaucucaugguuuaaaaaaacaaacaaacaaaaaaagaaaacaggaaaaugcacucuguguacacugauacauaguuauuauaugauacgacaaugaacucaaaugaccaaguuaaaauaucaguggaggccgggcacgguggaucaugccuguaaucccagcacuuugggaggccaaggcgaguggaucacuugaggucaggaguuugagaccagucuggccaacauggugaaaucccgucucuacuaaaaaauacaaacauuagucgggcgugguggcgggcaccuguaauccuagcuccuccagaggcugaggcaggagaauugcuugaacccgggagguggagguugcagugggccaagaucacaccacugcacuccagccugggcaacagagcgagacuccaucucaaaaaaauaaaaauaaaaucaauggaacuuuucuuggaaaauauucuaaagccuacaaaucaggagcuggagaacacucuugaagcuggggaaagucaguuccucuccccacuugccaccccaauaaagcauacaggggcuuccaacagaauuucaucugcauucagaagaguccuagugagggcaggcaccucggagcccaugaguuugaauacaagugacaaaucuugcccccacauuuccacacuauacuuaaggucugaccuggcccaaaggggucaugggccugcuccuugggaagccaguauucuuugaaucccgcugauggcccugggcaauguauguuucuuagaacauguuuauuguaaaaucucuuuaauaggacuucuuuucacuauugaguuugucaggcaagugcuucccuguaguucuuaaccugugcaggaauuucugugucacuggcuacaaccgcucucaguagcuuccaaauuauuuuucguaagagacucuccuucauuauuuucauuugcuuauguagauuuccaaauggcuucggcagagaauguuuauggcugagacagguuaaccucugugagcuucaauuuugucugaaaucaacuaggggugguagacacugaaauacaguaucuacaaagcucccacuuauaaccagcacacaguuggcgcugaauaaaggacauauccuguuacgagcauuucagugggaugaauucugcaaguagguuagaugugcaaaaaguaugcaaaaucacgccuuuuagucccuuguaaaacacuggggcaauucacuaaaaucacucugcuuuaugcagugcgggcuugcaugaaugccaagaauuauccugcuuauuucagagcucuuaguauuaugcuugugucuucuggggaaguucagggucacacaggcuaccuaaauaagucacuaaugggagucauugaaggcuaagaacaaggcaaaugggacaguggauuuaaaaaacccaaucaauuauuagaacagugcuaauucacuguagcagcuaugggauuccugggcaggagauccucagaccaaugggguguaggucuugguggcucauuggguaaacucaccagcaacuacaguguggcaaccccgacagcgcucuuugccucuuagauuuccuacgccaaacauuuagucucuugaaguguccauuggcuggugacagccuaaugauacucugcuauuuggagaagaccagaaaugaucgugagaagcuuuacuugaggauaucaagcacaugaucagaaucugucacugcccagagugaagcagauucuucuaugggccaggccucccucagcauuugcuggguguuaccugcaggcuugggguagggggagagagcaagaggaccccaggcccuuaaacaugaccagcagguagugauaagacccugaggcuucggggcuuugugacuuuacuaauucagagcaaaggcaagaguaugauuaaaaacagaaaauccuaaguaacacaccaacccaaagagucuaguaccuugcaggaaggguggcaaacccagucauuuaucaccucccaucaucccugccaccccaucaugggggcaguucccugucagcagggguucuguucauccucauugagaaagggugguuucuugguggugugaggccagcucucccaagucucgggcacacagugguaaaaaaagaagcuaaaggaacccccugaguucaggggcucugugagggugccgcuuacggugguguucaagacaagggagagaggaagaaagagcugagggauggaacgaguuaauacagacgaagugugguauccuguaccaagguuugcucaacuuuaccaaaaacaaugaauagccaacaaguaauggaaggucaugugcacauacacauacuuaagagguaaggacuuagucucauggacaucuguguuuacugcaggggcucagggucagcuccuacauggcagaggucagcaaacuuuucugcaaagggccaaauaguaaauacauauugacagccagucuuugucacaaugauucaacucugccauuguauccugaaagcacccacagagaaucuguaugaaugggcauacuuguguuccaauaaaacuuuauuuacaaaaacaggugguagccagauuugggccacaagccauagguuauggacuccugauauaugguuuguaaauacagugaccauauucauacagcuaaaaauguucaggccagaauaugggugcaggcaguccaaggugugugacugccaagcacaccggccuaucauucauucacacauuuagaagguuucugccaaacaucacugaagugauggacacugugccaggcaaugaggggaugugagagucaaaggaauucgggcccagccuuugagggguucacaguucaucggcauucaggcuguucaaauauacgcuuaauuguucaucagcccauacaaccugggguccugcuuuggaacucuguguguguaugacacacauauaccuaauauguauguauaauguauaugacagcaucucuuggaaacaugaaaaaggucucauucucccagcagcagaaauaaaaagccaucacagaacauguuugcgugaugugacuugcguuaaccuagaauauugaugcuagauggguagaaaugauauacuugcuguaucuuauguccucauauugacaaaucacucagaaucagagagaccugucaggggauaagaaaucucugaauuugcucuaauuaccaaugcccaaacagaauaaauacugcaucacaauuacagaggaagcauaaggggacuauuuaaguuacagagcagaaagaacccacauggaaaauugugcaccgcugcagcagcugugcauaaacgcugaggaaucacgaaggugugggcuuagagucugauuuccuggcuucccaggcucaccccuccaagagccaaggggaaagcugggcacagugaggugaucccaucccaauuuggcuaugcacucucuagcaggaugauuagguuguucuugccaaaaccuacccacuuaauagagaucaaagucuuccaccugguuagcugagaauggcccaauuuugaggagaggaggugggugacauuagacagucucucaacagccucugcaguccugaaaaugaucuuguggcucuucucuggaauacugagugccguguucccuggcucuggccagaugcaucacagaaaagcagggcauugugagcagcagagagaaagcagcgcugagcugagaucagaagcaaaaagguuguugcugccaaaugcucuccugugccuuagcacucccuauuugaauggcauggaaaugucagcacuucauuuucuaauauucuugauaaaucaguuucgaugucucucuccacauuuaucauaacccaaaacauuuuaaaucauuccagccagcuggcugaggucagccucccaugcacuugguucuuccauuuuuccagagugagauucaggagagggauaggguggggugaccaggcucuccacucugcagguccugagaugcugaccuucccucuccugaccugcgugcacaggcuuauuaaccccucuggaccucagcuuuucucuguaacaaacagcugagaauaccugccucuugggcuucucuuggagaugaaaugaauuauggacaaagagggucucaguccucaggcuauguuugcacucaguaaguuacuaccuuugagguuacuuugcuacugggaagcaacccuccaagugcuaagauucagggaggugaagccaggggaggagcuugaacacagggaagagauuuucuugcuuuauuuuacagggugguguauuuuggggauggggggugguggugaggaucacuaaauggagacaugaagcuuugucuuggugguuuccagagaaaaggacaggaccaguucauuuggugucacgggcaggggagcugauguagcgucaggagaccuggauuuuguuuuaguucacccuggccuagccucugagcuacauuuuuugauaugaaaggaacaugguccaaaugagaggagaggcccuagaggcuccuuucugcuccaagaacauauucuauagagaugucugagaacaucacaauuucagccacugccuuauaauauucauaaaaguuucggggcgggggggaaccucgcugcagaucuccaucaauaaaagugugcaaugaucccacuguucuguuuucuuuuuccucuugacacuucaucaauuccuuaucucucccaguacuacaaaugcuagaguuggucucuguccugcaagguugcaauccuuugaauuguuuucagggaagccauuuucuuuucuuuuucuguugaaacuaauggcuuuuauuuauuugcaauagaauauucaaguucgaaaccccaaauauaaguuaucauuucuuugaaauuuugaaaugggaagcacauuucauauucuuucuaucauuuucuucauuuaauucacagggucacagcaagccuuuuuuauagcuuauauuuauauaacuuuguaaacacuacuuuuaaguucuuaaaaaauaauaaggcuuuccaucucuaauaugaaaaauaaagcaaaauauauuugaaagaauauaaaacacauuucaaauucuugcuuugggcuucauguagguaucacacauacaugaaaauguaauuuaaauaaucuuccugugcagaaugccaaaauagauuucaaauaccuccucagccuuuuaaguugguaggugaauaaaagccucaccaccgagccacuaggcaauccagacagcccauuugcagauaaaaugagcaauucaaggcauggcaugaacauuuauggaauuuauggauuugugucccagaauuuggauuuaaaaaaaaaaugaaaugcaaguucuaauuuucaaauaauuuuaaaaacuccaugcaauuccugcuaagcuaugcaaaaaugguuugagcucuauuucccacuggagcugagggagcguucuagugaaaugagaauccccauacagaugaccuacagaggucaccuauuuugggcaccuacaaugugccagccauuugguauuaucuucuuuaaucuuuagaguaacaauccaaggugggaaugcccuccaugaggaagcuagagcuuggauaugcucaguaccuucuccaaggucaaaaagcugguaagacauguuaaugccagaauucacaucugggcugucagaccggcccacucaucuucucucuccccugaaaauggggaaccaacaugaacuaaugaaaaugcaggcauuuuuuugggccgggcgcgguggcucacgccuguaaucccagcacuuugggaggccgagguggguggaucacgaggucaggagaucgagaccauccugccuaacacggugaaacccugucucuacuaaaaauaaaaaaaauuagcugggcgugguggcaggcaccuguagucccagcuacuuggggggcugaggcaggagaauggagugagcccgggaggcagagcuugcagugagccgagauugugccccugcacuccagccuacgcuacagagcgagacucugucucagaaaauaaauaaauaaauaagaaaaugcaggcauuuuuuaaauuuuuuaauuuuuuugcuaaugcaagucuggauuuucccuuuuacuugaaaaggcuacagaagcuccuacccucccaggccugguaggguucaugccaauucaucuucuggagaaagcaucuuuccggugcuagagacagcagagauccccucauugagagggucccauaaauaaaguguauugggaaggaucuguaaucauuaacaggaauccucucugugaaguaauuucagacaaaucaaggccauugaucuuuaaguccagggaucugggugccaggaugcaacgucucuccuugaggaaccugccugggaacccaguucacaggccauuuguaauaucagugguccuucagaggaccgucacaugccugucuggcucuuccuuccucauauugauguccacauccaugugaacaacaaacauuugauacugcauuguuugcaaugcaauauaaaaauaaaccuuaaagauaggcuggaaagaacauucaugaaaauugagauccugggggaaaaaaugaucuaacaacgagcauccuucaaccaaaaaggcaguaaaguuuuuucuaucaguaugucauugguuacagcacuagguuaucccccuagcaaagucucauaacuggacaucaagaaauuuauaaaugaucacaccaaaauuucaagauuuuagucuuuggcaacaagagcucugagacauuuguuuaaaaagcaaaugcaaggucaggcuuuugaaacaaagcacuaaagcuccaagauguauaaguucucauuaaaaauugcuaacuaagcuugaucuaaaaacacacaucaaaagaaauuaaagauaaaagacucuguggauauuuaccaucagaaccacuggcaaaaaaugacaacauuaaugcuuucaaauucgaaccucugugacaguacaagagcugaagaaauaugggaguccugaaggaaaauuugguuuaauacaguauacucacauucuuauuuucauucuaguuugauagccagugccaccaaaauucauuuucauuaauuuucaauaaauuauagcuuaagcuuuaucucuccuccaggaaaauaaguuaaucaacucggccucagcuggaaaaaguuguuuuccuuauuaauagcugcuccuggugccuucugggccaaaugacuuguuuguaucauugucaucauuuugcaacuuaguauuucccugacugcaugaaugaaggaaggaaaauguaagcuuugcccuguuuauaauauagccaggcaguccacacacaaaauaauaauuacuagcuuuccugauauuuauguuaugauuuuauauuaugaaaauaugauuaaaaggcacuaaagcuaaaaaauaaaaaguccugccuuaauaauaguguucaucucuguauuugucccuguccaaaucugcauguauuucugacaauaauaaugucuauaaaauacugaugcauuccauuuucuucaucaugcaugauggcucugugaaaaaggaagcauacaaguugcugggacagggcuacagagaggagcaacaaaaacaaggaggcagggccgggagcaguggcucacgccuguaaucccaacacucugggaggccgaggcggguggaucaccugaggucaggaguuugagaccagccuggccaacauggugaaaucccgugucuacaaaaauacaaaaauuaguggggugugguggcgggcaccuguaaucucagcugcucaagaggcugagggaggagaaucacuugaaccugggagguggaguuugcagugagcccagaucgcaccucugcacuccagccugggugacagagcaggacucugucucaaaaaaaaaaaaaaaaaaaaaaaaaaaaaaaaaaaaaaaaaaggaggcaaaugacagggaagacaaagggccaagggagaaagagaggagagggagcccggcugaccccugcguccccugggacgccacccagguuggaaucucccugcuaacugugaugcuuugccacgauccaccagcauuguuacccuuuaauucuugauaaugaaaacaagcauuaaaacuucccuaacagccagagccuccccagaauuauagugucaccacaucuggggagcugcgaggccaauaaaaguuaauuuguccacaccaucgaaagaaagccacugaguucauuaaggguguuucuuccuggaacacguccaccaggauugcuucagggcaaaaaaaaaaaaaaaaaaaggaaggcuuuauccagacacggaagugggccugguuuaggugcaagacuaagcuauuuauuuucaaaacugggugucggaagcagaagacgacugaucuuuuuucuacuuguuugaggaaauuuaaaaugggcuaauaugaauacuauuuagacagacgcaucacaaaauugugagaguccuauuuucccuuucagaagcaaaagggcauguuaucaguucacccaaaagggcacucacacagacuccucauucauucacucauucauucauucacucaagcauuauucaaaagauauuucucagucaucuacucuacuucuggcccugaggugggcacugaaaguuugcccgcccgggaacagacaaaaaccucugcccacauuguguugaccuucucguggagggagacagggaaagcgaaauagcuacagcucccgguauacuccauggcgauaaauguggcggagaagucucaagcagggagggagggagaggugggaaggaaacugacuuucacugggcaugaaaggaccaggcauugcugaugcaccucaagccccgaucugcagaagucaccaagcuaucagcuaggauugugaagaggaacaaagacauguucccagccagcaaaaugcccagucccauaggacagagaaagugcaucugaucaucagauuccacaguggcauggucugcaagagagccacaaacaaggugcugggagugcugcacugaggaugugcugugcugccccggagggaagagagaagccgggcccggaccaaggaugcagguuugcaugcggguuagaacagucccauggaaggagugcuacuguucaggguucugugacucugcuuccuuaacccaucaagaauuccuucauuuuggaaacaaaggucuucuggauuuuaagugucugggggcgagaccuguguuuuauucuuccaagcaacuguuccccagcacaggccaugcacagugcugacacacagcaagccccagaugaacugggacuggcaggccuggggaggccggcucguuaugucggcuccuuuguagcaaaguccauuaaggucuaugauuagaacacuaaguagaaauaacuaggcuuguugaaaauuauccugacauguuaaaugagaccacauggaguuuacauguacaggugauccuuccaggguuuaaaucucgauuccuggcuuuaggggaaugggaugugugugauucugagaacuuugcccuaccauggaaaaaaaguaagguaaagagaaaugggaugaagacagacccaacucaacuucugaauuagcugugcuccaaacaucauugcuaaguaauuuguguugagguugccaggguagcccucaaaauccuuuaaucuauauggagauucagcauuagaaugcuaucagaucuaacuaucauguucuuagagauauauuacuuccaaguucucacaugggaugacaaaaauagaucucccuuaaacuaaucaauugggacacaacuguauacaagaaacacuauagaaaaugcauguucauauucagggagauuacacgggugucugaaaaagaaguauuugcccuuccccagaaagacauucuagacaaauggagaauacugagagcuaaugggaucagcuuuaccaccugacauauaucugcaggcgaaagagcuggagaaaagagaaaccaaucagacaauaucaaaucgcauuaacguucucgaaacccaugaguggugguuauauuaaaguaacucuaccacagacacugccugucccaucaucaacguccugagcagaaaacaugggagacaguuuuccagaguuuuacuuaacugucaggaaaaagcugcuaaguuucucuggaacaggggucaauccaacccccauagaucugagacaaagacaccuucucaauuauauuuuuucauuuguuccuucauucaucauuccauguacccacagaucuuucuugccaucuccucugugacuggcgaacaaagaaagauuagccugccaugacaacauggcaagacagguguucuggcagaggaaauggagcagaggcgaggagagugggggagagccagccaaaggauccguaaagaacagcugcuccagcagaacucucaaaagguggcagccgggcagcuggagaggugucaacacucaccccuguucgacaucccaaaagcaggggagaacagaggcaguacuccaaacagccuugccaguauggagggucacaauuugugcucuucaaauugcaacuucaguuuuuaccacuaacaacuuacuuugucuacuuggagauccaaggccagcaaggaucucauaacugcucagccucacuucagcaaguuggaugcuggcugacagauggguccuaucagcuacugggaaaaagggaacagacaaaccaucaccaaaagccaguaccgccuuugacuaaugaaggggugauccugggaguugguuaugaaaaucaacuucauauucuuuuagcaaccauaaauuggcuguucccucaaauucuagcauuuaacagcucaaaugcuaagacaauguacuugcguuuccaugaguauauggugaagucuaaauccacuuuagcuguaaacagcugacaucuaaaauaaguacauguccggggcauaaucuggcaaacuccuggugagaccuuagauucagaaacaagccaaaucuacugcucagaguggcucucaaacauaggagggaaucacugaaaacagugccuuuacuacuuuuugaaacuuaauuucucccagcaauaguggugguaucauuuuaugccucuaauuaaugucacuuugagacuauuaagugaaaaagcccuucaagaugcugacauaaaugauggcuuaguuaucgagaagagacagcuagugcacaaaccuggguaagaaugcagaagaaaaaaacgguuguugcauccaguaagaaaacugaaagaacaagagagaucaaacuuaagagaauaaauuaacggcaaaaacauuuucuuugagagcagagaccaugccuuuuuuauaucugcaacaaccaccaucucuagcuaagguccauacagguaaaccuaggauacagccucugaauugauucagugugacaauugccauacccuauguaaugaacauuuugaagaccacacuuagaaggucaugcuuugauuucagcacuauccaacgugcugcucccugacaugcuagaagcucugaacuggcugaaaauuaacaaggcauuuaaaagagcagcaaaucaacaacugggucacuugcccuccccugcacugaguacugaacacaucuuccagggaggggcccacagcaugcugcugaacucugcaaccagaccaggcacacacaaaugccccauccagucacccaggaaugugagaagagaacuuuccauugagaauuuaagaucuuaugaaggaaacaguguugugagacuauggcaguaaaaacagcacauuuacaucaauccaauaacccaauacuaguacuguaauuacuauuagguacuguaaaauuaguuuccacuugcuaaccauuccucuaggagaugcuugucacuuucucggucuuugcuucuaaugacagcacagugagagacuuuuuuuuuuuuuucuuuccugaccuuuuaaccaaacaauucauguuuuguuaugauugccucagaguuguuaguccugccucucaggccccaucuucaaggucucggagacacuaagcagagcuuggauauguggccgggaagaaagcuugcagugaucuuucucugacauuucucaacacccuuccuaacacccagggcccugcugacuuagaucucccuguggugucagcaugaaagagcagaugccguccagcccucccgugcccugcuccucggagucccugccacccaggacguggccauggugcggcucucaggcugaggccggcagccacccuccuccuuuaucauuccugcaguggugucacaaaaacugcagcaccagcucugccaugggccugcccuucuuuguuucuuuucaaaugucuacccgugaugcccucuuuugccaacgguccguaaaaggaauaacugaaaacacguauaccccaaauugucaccaguuuuuaaaauaaauauacaaaggugcauauauucccucuuuugcuauugguccaaaaaggauuaacugaagaccugcaugccccgaauugucacuacuuuugaaaauaaauuuacaaagguauguauguguguguauuuacacacaaaaaaauucagguauguuauauacuuguaaguauacaaguauauauauuuauuuauacauucaggaauugcugauaguaacaacugaagaauuagagccgauuauuauaaagguauaagguagcuagagaaacuggggaacugcaugcugagcuaaaccugagagguccaggccauuacagagagguagcccugacuagagcuccacgcuguguucuguaagccaaguuuauuuuccuuucuuuaaaguagagcaaaguccugugaagaaaggugguucacuacaaaacagaaauguaaaugacucaaaaacuggacuccacaaaaaccaccuuguagaauuggcuuguccagaucccuucuguuucuaacagagcaucaccuucucuuucaugcacugucgcagagucuauguucuuauagcuucccuauuaacaguucauguccaggcuccucuaacaggcaagccuaccuugaccaaggaguguucaaaaggcaucaagcaaggagagguccaggguccccaaauuggucccugggauaaaacccaguucuagaaggaugggaggcuagagggucaacagaacagaaaacaaaagcaccaaaaaaagagagcuccuuggacuuuuaacacugucccuggugcugaaugcgauguuuuccaagcuauaugcauuguuaagagaauacuuacaacuaacugccaugggacgauacauagugaaugccacaaaauccauaucuacaaugaacaugcuuaucauuagcacccaaaggaguucauauggggagaaaaaugaagacuagaacuuuucacaauuuauaccugucaggguuuuuguccacacucaguuggaauucuuuaaauagguaaguguguuauucuggacuuaugaaaauacaaauauggacucuaugacuuggcuacaucaacauuaacugaacgcccagaagguaccagguauuguaucacgcauggaguuacaagccuauguauauauaauacaggcuccucaaagcaaaagggaagagugcuuuacaaagguagcaauuaaucugcaagacagaaaauuuauaauuugugauccaaauguucuuccacugcagguuuuacaucaauaaccuaagcuuucuccucucuaaacuucuaaucuacaaaagaucuccagcccuacugucacuggagaagaaucugcucuagcaguuuaaaguuuuuagguuguucuuccuuauggcaauggcaauauagagaaucauucaaaguacuguuuucugauguguuuccaaguugagaaggaaaaaauagggaaauuccauaacagcacucuguguucccuguccuguagaaauaacuuaucuguuucaucucuauuuggagaacauauucagaugcugcagcccaauuauuaaugugaccauaaaauuaucagugaagccaaacccuacagcuuggaagcuucaaggacaauuagauggauuaugaaagcaguaagcacaauggauuacauaguuuuaagcccucuauugagaacacucucgugcuuaauaaaauuuuagcaggcauacccugauugacaccagcugcuggcagcugccugugaauuaaccacaugacaaggucaacacuuuaaauuuuauucacaaauuaaucuccugcugacauucauggacuccaaacaacugauuccuuuaaacaaaagaaagaucccaaacaaaacuuaaacaaaaccucaccuucaugguaaugaaguccuaaaaauaauucucacacaugggagaaacauacauauauuuagaaacugacagaccacccacuguuuucaacuagcuaaaaaaagaaugaccacagauaugucuccaaagaaaacacaaugacuccuuugguucuuaccaacaaacgucagccaaaccauuucucaggaauuggugaauugggcuggguuguaaauaaaagaagcaagagaaagaaaauugagugaaaaugauguuauagaaggagaggauugagaguaaaagucaagaaguguuuccaugucauucaaccaccuauaagaaaaacuauaguggcuucccauucaauuuaaaauaaugcccaaagggccucucauuuuauacacauguccucaucucuccccacucucaccugcugcaucuauuccagcagcacuggccuuuuuuucugacuugcaaacagaggaacaucauucccacugcaggauguuaacacgugacggucuuuguguuugcaacauccaacccugggucaacagaugacugacugcuuuuucauuaccauccaggucucacuaaaaaugucaccuccuuagaguucauucuagaccaaaauacugcuucacaacacuuccuuaacacucagcaguaucaaaaauuaaccguucgcucauuuaugcauuuauguugcccuucugccacucccacgccacugugagcuuugugaggacaaggacuccaucuuauucgcaaaugucuccuguagagccagaaaaauguuucacacuuaguauguacuuaauaacuauuugcuuacugaccguaauggaggaauaugugcuuucuacaaagugacugcaguaaagucuuuucaggaagggcuuuagaagagcaauaucucgggccaggcaugguggcacacgccuguaaucccaacacuuugggaggccgaggcgggaagaucacuugagguugggaguucaagaccagccugaccaacauagagaaaccccgucucuacuaaaaauacaaaauuagccgggagugguggcguaugccuguaaucccagcuacucgguaggcugaggcaggagaaucgcuugaacccaggaggcggagguuguggugagcccagauugugcccauugcacuccagccugggcaacaagagcgaaacuuggucucaaaaaaaaaaaaaaaaaaaaaagaagaagaagaagaagaagaagaagaaaaagagaaaagaaaaguaaagaaaagagaagaaaagauucagaaaagcaauuucuuacugaaguacuccaagguccuggaagauuccucuuguacauuucaggugccugaagccuuuguccucucauugucagguucauugccuaucccaagcugccaauuacauguggugcagaacaccagccccagcauacaagcaaggugacagggagcaucagaagccuggggccuaagaauaaugagauccuggaccugaagugugacuguaugcuccucuguaaguggggcuagcauaauuagaaggcucagggcucuaaugcaagugaggcacugggaaacuuggacacugggcaaggaaggaguguugauguugaugaggcuugauagacauuuccccugagguuuagggcaggaagguucuauaagcuuagaauucacacuuuccuaugagcacaaaaagagugccuucagaaaacuguaaauaucccugguuucgcccacuguaagaaccuaaaauuuggauaugacuagcacauauagacaaguacuagguacuuucuccugacugcuggcuuauacccacuagcacaacacaauaguagagcaguaccucaucugccacccaagccaacaguuuaacaacacauucagcguggaccgugccauugccagcaccugagcucaaggauggcacugacuucacugugcaaaaugaccuuggucagcacugagcuuagagccgagcuccaguagaauuagcugauggagaaaggcuguaagucuauauagggcaagagagaagggagaagggugaugucaucauguggaagagccuugccauaggguggacaaaucuggagccaggugggaaggugcaggaggaaugcauucuuggggcuugccaugaggaggaaagggguaaggacuacaaaaucaccgugucuggugaggaacaaggggaggggauaaggcacaggcuguucaucccccucucuccugacaaagccaacgggagaacggaauggccugcugugggguuccaaaggcaccucaugugggaggugaugauggaaagacgauagagacagccauacuguaauuccaauucuggcugaaauaugaugaaucacagaaagugccuggcaacacuuuggagcagaauauggucacuugaucaacaaacugcacauaaccaugaggucacgucugaguuuugcaagcccacugagacaaucacggcauguagcagacaauccuuuugucaaauguugauguaacagacaauauaaugaggaaaacaaaaguuauuuucaauuuaaaacccaugaugcagagaaguuuacacagcaaaggggauaaaaaguacugacuagcaauguugacagaagaccuucugugcacacuguuacucuggugaguagcucuguacguggaaauuugcccccagaguguuuauaagcuaaugcagaugggagcuuuucuccugccacaaauuuaacauuccgguuaucaugucugugccuggacacaaaauaauauccagaaaauacacaucugcauguuaaaaaugucagagaggaaaggcuggauaaaauaggagaaacugugaaggcaugaaacacuccccagcuguuccuacguggcuggaccaagaaacagccaaggcaacuccagccugguccagaaaauucucaucaucaacccuuuauguuuauacaaccuucaacaauauacuacagaaagaccccaagaucauuauuauuaauuuuuuaauuaggggggagaauuagcaaccuccccuacaaaggccaaaaucugcccggccucaggggucugacagaacugaccagagaauaaagccagggaaaguaacucagaaguuauggcaaugggaguaagacauucuaacauaaggcuuggcauuuucuucucuaaagagccagagaguaaauguucagggauuugcagaccaagaggcaaaauugaggauacuagaaauagguauuuucauaaaaauuuucaccauuuuauuuucaaaaguaaaaacuuuauucauggacacugaaauuugaauuucggaucauuuccaugugucacaaauauuauaugcuuucaauuuuuuuucaagugcuuaaaaauguaaaauccauucuuaguuugcuggacaaaaccaggccccggcgggauuuggccugcaggccgcacuuugccagucccaguuguagcaggacaggugggguagagcaaacauaagccauggagucagcauauguguaugugguugguuuuuccucaaaguuucuuuaaaacaccauaaaucugcauugaaacaucccacauucccugugcuuauaacgaaaucauauuauuuacuucauccaggagcuuauguucacuucuaaauuuaauuuaaauaucaucuuagcuguagguguugcauugguuuuguacaacgaaagcagagacaggagcaaacugggaagcaugcauuaaucaauuuccaugaccaugaugagcuuggcauugggaaggcauuugauuugaggcaucugcucuauaaagccagugacccccagccaccgcuuguaaugcucuccuguucuuaucuuguaggcuuucauaucggacggggcaagacacagcuaauugugacacaugcaggaacagugcauguauuaucuauagguauguuaacauucuccucuucccacuuucuuauuaugagugacaaaugauguuuacccacaaaugcaagaacgaucuggggccaugcugggaugauucuaucagacaaaaagugaaggaccuuacuugacuguaauucuaagcuaccucuaaauaccccaccccaaguauagaaccgugggauguaggagagcuugaacccauuuaucuugcaaauguaucuuagugguuucaagaauugguauaaguuugauggcuugcucccuuggaaucgauaggugugagcccugggcucuguguucuggaaaggcuguaaaacauaggcccuucagaggguauagaucaaaggcuugaaagcacaccguaugugcuaggaauaccauggaaagaccugggcugcucacaccaaauguggaauuucauuuccugggaacucucgaggauugugcugccugccugucuccgggcagaaucccugcuccagagccccuacagcuguuccuugugguuuuuaauuugaaguuuguuuauaugacugacaucaacaagaauacagcagaaacucccaacaggaagaagcuguguuuggccugcaucaguaauuuaggauuuuaagauauagucaaaaccuucagaaggauggcuauccuuuuuucuuuucuuuuugcaaauguaauuuuucacaaacaaaauauaaaagcggugagaaauguuaugaguaaguucuuuuucuaaaguuuagacuggagaauaauuuuagugauccaccaaauuaucaaaaaacaauuaccaaaccaaaaaacccucuaaaaaguuauucaaaguuacuguccucugcauuaagaacacagacauggggagagcaaagaggcuugaggcuacacaaucuucaacccaucaggguucucucccaagggaaagccuagaccuggccguccaugccuccgauccagacagagcaucccagauagggcccagguuccuuaaaagcaaaagcaaagcugggucaccuggagaccuugucugggaggaggcagaagaaaccacagguagagauaggcaccgaaggccacaucagcacauuccuuaaccucagagguucugaaccaaugggccauuugcaaagucuggaaggagacguuuucaguugccacaacugaggagcugcugccgguuaugcagcagguagaggccaggaaugcugcugacauccuaugcugccugcacagggcaacccccacaaccaagagcuauccagucccaaaugucaauagugcugagguugagaaagccuaccuuacugaaaccacccccaccuuagaguguuguaagaggcacacacaagcugguaaggccuccuggcagcaggaagggaggaggggccccugcagcagccuggcauggcacgccaagcugcugacuguucuuggcaauugccagugaggagguuaaaaugaggcauccaugcaggucuuuucuucaacaauuccuccaaauuagaaacucaaugauagcaacagaucagagaaguuugcuuaaugggaaacuuuucacuccacucaucuugcaaaagagaauuuugaaucaacaacaaagggcuguaacacugacauaaaaugacccuccgugaacaucaguacguuaggaagugcagaguguagaugaccuggcacguacucagaguucagcuucuguuaguuuggaagcuaaagcucauaccgucuuuaacgcaaccaagcaacagugagucaagacauccaggguagguucagagaaugagcuguucagccuaaaccuacguaauauucugugggugaucgaaaaaaaauauauauauauaugugaacacuguuuaaccuaacugaaauaauuuaaaugaacuuagcucuaaauccagaauucacuccuauaaaaagugacauuaaaagugacugaauaagucucugaaggacagaaaucuguccuuucaggaaugacucgaguggucacuguuuugaacuggcucaaacaucacucuacaugaauccgaauacaucagccacugguccacuugcuagaagaacugcgagugaccaagcaccacaggaauuugccaagacuuaggaagacucacuagguagagggcgaggcacugugaucgcucugguuaucucauacgagcagggaaaaugcaugacuacucaucgagaacuuuuacugcagaugugauuuuacagacgggugauuuggguggcaucuucagaaacugaauagagauguggcccucgguagccugcagacccgacugucacccccuuauaaaugggagaggcauucuagaagagguaguguuugaggaagaguggaguuuuagaucuuucuuuccugauuuuuaaaaucacucccuuuggaguggucacaaugacaaaacaucccuacaacagccaaacuucugcuacaaacagaaguuacacuggaaggcuuuuggucccaggacagucugcagaguaauauuucggcuggacuccugcugccucccaaagucuuuauuucauugaguccugucaaugaaauaaacuagugugaaacucaagaaaugaacuaguauucaaauaaagacugcacugugacuaccaaguggaacauagcucaucaaaugcugcuuccuaaacucccuaucauguuauaauggaaauaauuaaaguuuaacgauuacucuuaaggugguuauuauguuggauaagaguuuucugaggucugcaggaagagaugauaaagggagugaaaguucacuucugguccauuaauugaaaaaucaaucaauggggaaaucauaaaaaauugacacguaccuaacuuaaacauguuauuuuaauuugaaucgcaugaauugaaaucucccauuugaaugauuucaaguuagggcagccuuuagaggugaggcccagacguuuucuuugaauguggcacccccacuacaguuucaaaugaucugccaugagccacaccaauuuuccugucuuuaaaguggagcaaaguccuguggcagaaucugagaucagaauccuucugaauccauacuugaccugucucuaccuuuuucauugaauauuuugugguaccccacucuuuccaaagcacugaauccacagcaaugacuaucuucucaugccucagugguuugcaugacauucaauaaucacaucauuucaauagugaguacuaauuguauaaacagguccaggaacaaaucuagcauccucuugguaagcaugaaccuugagaaguaaggacagagagucacaggacaaagacagagaagccaguuaguuaagggucccagcaucaugggugcaccacuuaugucgugaaaggacagggccauaugguuaaucuagcacaucagcuaagagggcuuauguaauccuaucugacuaccaagcacuggucugugugauucugcccugguggcugagaguugcugauacacagggucacuucccucagggucccacugagcaaagagaaaggggagggugagcaauggggauugagcuggaugaccucgcagcuugcggucaguucugugagucacccccaaaugucagaagcuuaagaauagaaguuucuucgguagaaaaguguucagaacccagugaguuccuugggcaggaggagucaccuauucaggugacucaguagcaguguacauggguggccacagcaucucggaaguauagacuccaagugagccagagggugucuccaaauuucaaaggcuuuacaaaucuacauccaugucuuguucucccaugcaaacuuacagccaaguccuccuugaauuccugcauaugaaucuguagaaacacaauuccagcagcaggggaaaguauagcucagguuacaguccuugcugucagaucaaagccuggcucuuaguugcaaggaccugaauccgggaguucaggaacuuuccugugagucccuacaccaccauuacaacccacuucuccauaugcaccaugggaugccuggaacaccccgggauuggguagcuuaaaggaauuucaaaauaaaucuuaaaaugucacaugacugugguugucccagaggcuugagaacacguggggccaucacagcugccaguguucacacauuguaaugucauacccugcuuucuggaaggccaaaagcccuggagggaaaugaauuugacccugccugucuugcauuuaaacaccacuuuucacucgaaacccaauuacccucuccgagcagcauagcuauccaccguguuuccaguaaugccuggcccagggagaugaaaaggauacuguguucaagacccggcugccuggggcuuuagcaccacaggccuguaauaaauggguaccuuugccaugggaggcgguacauauuucucugugaaaaauaauucugucauggaaauauagaggacuagggaaaagcaucaaaaggacaaacggucuugaugcaauuucaaggcggggggaaaaccaccaguacgacaagcgaaaggugagaaacaucagcccgugagagccugccgcguaccugcaagguuagggcugagcuucucugcccucucucuuggguggggugucuguucagucuccagguccucugggguugcacuaagggaucaucaaggucccuuccagaucugaaaucccaggagcugcuuuuuacaauuaugcaagggauguaacuauggguuucaagagacugcacagaaggguaaaaguguggagagucacaaggcauuccucagcugaaaaacaccucucccuuauuggcaaaucuauugacucagagcugaguaacacuucuucggcagaggauugaugggcuuccuccuagaccacugaaaccccaaguaccaaacgugaucuuucugacaaauuuugagaugguugacacagcuacaucuuuuucuaagaugacagacaucccuucgguugugaugcagaccgacugugcuacucuaauuaaaaccaucucagcaugaaagaagauuaaaagagauuccaguuuccguuuucuuuaggaaaacuuuucuggcuuaucuuccauauuucuugucaaaauaugccguaauuauuucagaaaauguuuuguggauaaauuacuaauauaaucuuugcucauaagcagcugaaauuucuucucuccagcccuauuuugguaauucuuuugucggacuaaucugaugagucacaccacggaugauucagcuuuuguucggaugugguuucagaaaggaacaaugaaacaucaucggcaaaccagccauucucuccuucgcugaaaugguuaauuuguaacauaguacugcgacaaaauggccugaauucuaauguguacauuuucaugaaaauaacauggaccaacugcaauccaagggcuuuuggagaugaaagcaagauuuaaaacauaacaggaauucugacucagauucauuaaacagcaucucucccagaauuuagaaucuucucgucaagugguagaauuccuaccaucaguugcaagcccugagugaccacauccucccggagcacgcugugucugcuucauuucuggaucaucacagccaccacacaaaguggccucaagugacacuaauaauucugcaguggaucaaugagugggcuuggaaccugacuggaugggaacgccacaaggcuccacaccacuugucugacaucagagagggggagcuugugaaacgcauugcuguguacuccaugcuuucacuguuugauaugauccaugauggucaaggacagguggaauuuuuuuuuuuuuuuuuuuuuuuuuuuuugagacagagucucacucuguugcccaggcuggagugcaguggugcaaucucggcucacugcacccuccuccuccuggguugaagcaauucuucugccucagccucccgaguagcugggacuacgugcgcgcaccgccaauccuggcuaauuuuuguauuuuuaguagagaugggguuucaccauauuggccaggcuguucucaaacuccugaccucaugauccacccgccucgacuucccaaagugcuaggauuacaggcaugagccaccgugcccagacaaggacagguggaauuuuaaacaaccacuuugauaaaaaugccuuagcccuuuccauuugggguccuaaaggguauuaauugaacagguguuuuucaagggaccuccuaaggacaaguucugcaccaggcccugggagacugggaggagugugaagcugcugaagacaccuccaugcaugccccuuacccugggaccccgggaugaggguaaggacagagcucuggcgagagagagcccucuguauggaaggugagagccacaggugcaaggacguaaaaggcaggcgaggaggaggugaaggaagccagggugcccgaccuggcaaagcagacuccaaagaaaacaagauaaucguggagggaggccagguuagggaggauuuggauggccucucuagagcccuccaggcuacggcguuaggaacaacuggcaggaacuaggaggacaaacagccagggcacccccaaggauggaugggaaaccucgcgacccgugaacacucccccuuagacaggcuggagaacaucccaguccaccacaauccuugacggcuucucaaguaggaagcuccaaaagaaggcaaguuccuuccccaaaugacuggaggauuucaggaaagaugaggaaaauaucuaacauuaugagacugaaugaagaauucacaaaagugauggguuguauuuucucacaucauucuugguaauguauuacaacaccaauaagaccacaaaacagagggugcaaagaguucuagauaaaaucacgcacacuggcacuucacugauuccgaguguauugcaaaaagaaagcuggucaggauagugcacgaucaagacagccggcagaaccgggcaccuccugacuaauggagaccuauuguuaagagugguaauugcauuuguaugcagaauccgugccaauuccagccuguccggagcccacuuggaguggagucucugcagccuuugucauucagcgauuaucucuucauggaagugcccuuuccagcccugcuucaaugaccaccacuugugcauauuaaguucuuuagcagcaugaacugaggugggggaaauucgccuuuugccuaauguuuagugcucuguucuuaguauuuauggugagugacaggguaggaagaugagagaaaggaaucccuggauaacaccuuacauacacaauguuauucugggguaaggaaauacuuuuguuuaaugaagucaggaaaaaagaaugauucugacagaucucuaaauucuucuugaaaauucccaaagcuaauaauccaaguuuuuucuuuucuauuugaaauccaaaaauauauuauuuaugucccucgaauauguacggauuuagguuuagucauuuuuacuaauguuuagcaaugccuuaauucucuuauuuagaugcuaggaaacuuguuacagccauuaacuguaacuaaaacugauuacccaucucaacauauuauuugugaaacaauuaguuaaaauuuauuagcagagaaaggcuaauuauacugauagucccagccuuugguuauaccccaaggucaaaguuaaggaggcauuuaccaauguccaaaacagcaugaggggacuacgcugucaguuucaugggaagauaaagauaauucauguuuagaugaguauggagauuuuucuggggguaaauacgggacgcaguccuggccacgaugucuagggcugggucguaugaaauuccauggggaauagagugacuagggaauucagggugcgggguccccagggcagguucuuccucacagauaggcgucuugaaagaaccuguuugagaagggaccuccugcaggaaugcacaggcugacguuuagaccggucacuggugacaccagaugacacacacaagcagcuaaugguuuccgugugugaugagaacuaucacugcuacguuuaguggagaugaugcucucaauggguaucaggauggagugggagcuccugaccacaucuagaaaccaggguuccgggcugguggcccagggaggcaggguggcuuuguagccuucacaccaacacugggagcccgggacgucacccaugucucuagacagacgcacucccaucuucaaaaggagacaggcaggcaaggugauggcccugggucaugggaucccacucaggguuggguuggccacgagggacucacagcaaccagcuuagaacaggaggacaacagcccugugucaucuccuuuucaaggcaguuauaacacaguuucugucaaaaguuggaaaacuggcuguucuucacugaggucaggaacagcaguguucugcaggcuacgucucagaaaggacugacuccucugauuaucaugacucgucuuccuggcuuccuagggggauggcauaagauaugcuucauagacauguggcggugcuguuagucauggggugucuuuccucauggagaacuuacgaugggcagaggcaauccaaaugacuugggucugccucugcuccucgguggcacuauuuuaugggaugccagguucucugaccccugugcaucugaccugcccucagacccaggcaccuagaugaggcucaggacccagagccgcaggugcacuccagagagugccacagguaagaugggcaccuaggaugagcuucagucaagcaaguucuccaguauggucacggaaaacauccaagaugcauuuggaaagcucagcucaucgucuaacucuaacuuuggauccuucauaguaaaauauacagcuaggauaucuggcuaaugcuuuuuuaaaaaaacuauaaucauaauuucuuguucauaguauaccaggaaaaggggacagaucuuacaguuugaguguuacuaucauggauuagccauuuauucugguauuugaagcccuacagugauaccauaaacauugauuaaugcaccuaccauguaaaauagugguaaaggaaggauacaaaguuacggugaaucauuucuauauuuaaaguguugaaaagccaguuaacuacaaaccacugauauuuuaaacuauuaggaugagauccauauauauuuaauguagguauauaauauagaaauaguauauaacaaauucuauagacagaauaaauagaauuauacaaauguauaaauuuuaaaugaaaacagaaaauagggcggcagcacuuugcugagauuagaagugaggggauuugguucaguucaucaguuuauuguaauucaacaaacaaauagagcagguucagagccagcacugugcuaaaugcacugcagacaaaagaugaauuaaacaugguccauccuucaaugaguucacagaccugggggaagacagcuacgaucccacaggagacaggcucucauggaaaccuagagacaaugcugccagagcaguaacucaucccagagguguguggaugaggcaggggggaggguggacuuuguuauucuagaaaauccacagaaagaaggagugacgugugaccuagguuuugaaggauaagcagggauuugagaaggaguuugccaguuuuccuaaggugacucugguaacuggagagggagagaauacagagagugagggagacuaagcuguuucaauggccaaggaggaaacugcuggaguucuggacuagagcaguggaaggugggcggagaggaaggacaccggguguucugaggguaaauccacucgacccagggaugcugaggcaggaggagcaaguugagcuugauuccagggucugcagucauccagggagaugaaugggggcugcaggcugagucuggaaggacagagaugcaggcugggggaaagaucugguucuggacaugcuggauuuccagugccccucagauaugcacacggagauguguucagaagagaacaacaaauauuugggguccugguucuucuauugccuggcgagguggccagggucacauccauaaaccaaggcccagaaaggacuugccugaauucaccucccaugcaagggggagagccaggccugggauccagaucccaacuuuuaguuuccucuggacaaugcugguguugcccauggcacucacauaaaaccggccaaguuggcgccaaugucaguugacauaaauuguugugcuuuggggacauggcugguccuacccaaagcuacacaauaaaagccagcccacauccuggugcaccugcccuccugggcccaggccuuguuccaggagacugcugugagaagugggagcacaucucagccaucacuucacagccaagcaagcucagguccccaaggugaggugauuuauccacagugguagagccugagucagcacagagccacgguuagcacuggggaagacucugagaucuaauucaaagagaauuaaaggcagaggccucugaccugcuggccaccgagccacauggcccugucgaggcuagagaccccaaagacaaaggguuuucuucccuuccagaaagcaagcuccggggcaccagauuguccugcuuuuaacucuuaacuguuacacauggacgacugcagaaggcaacuuuaaaaauguguuccucuuaaauuaucuugaggauucagugacagcuugcuaaagaaacuguggcagggccugaguauuuauaggagcaugagacaaacagagaauaagcuggagaagcaagaaggaugccgcucugcaaaaucacaugcggcagcggggagaaguguuacuacaaagccuagcacagucucugggaagaaaauaaagcuuaggugcaggcuggagagcagccugagauguagggcagauucuucuuucuuuggaaauguacagaauaaucauguuguaagaaaguccccacacuuaaaacuuucauuuugaaaagggaaagaccaaccaagaaauuaaaucuacucucaguugcuuuaaucaugcaucacagggacuugccaagagcacagcgagggcgacacagccccagggcacagaguguuuggguggaugguucccuuaucuggagggagaauggaggugcaggcagcgagagggcuacaaagguaaaucccuacaguccccaggaauucgugucuugucaauauccccagccauccagggaucuucccuucucacccagcaaaaucuacagccuguguuugacucagguguuuauaggacagaacaccccgcacagguaaggcuggccuggcuccagcugcuucagacucaugcuuugaaucucaagaaucaggacuuuuuccaggcugcugcuccuccccaggaguaagaauuccucaugacauggacacuccccugcccaugcuuuacaaacaccagaucccuccagcaggagggcagcagcaccaccugcagccuccugccuccugagcugcuggagagugaggccugggagguugcaaggggacugugcaaagccacagccagaguccucagaaaccacaacaagguuuggagccccggcuucccacgugcccguguggcuguagaaugagccccugcacuggagccgcccugggaaagcaggugcacacagcacgucugguggccugggaccgugauggugcucagaacaaacaucacccagaaaacauccagcuagaccuccaccugcuguccacaggcaagugaaaaggggacaaaguaacucucacgcuccccuuagcacagcgacugugguagcuggucacucacaagcagacccugcuggccccacccauucuauccaagaucuuacuguagaauccuagaagacggaaaggaggggaccguggcaugggagccaggcuccaaaaagauccuggaguaugucuugcagaaaauguuucaggaucuucgauaaguucugauagaauagaaccaggccacagacuccaucuggagugguucugacaaugccuccaggcagagcccuauuugucuguggcaaggaaggggucucauugugggaggacacaggggaggacacaacauaauuuuuggccaaaacaaagcaguccagggcaacugggacuaaaagugagguagaauuugcuuuuuuuuuuuuuuuguuuuaaagacaaagucucacucugucacccaggguggagugcaguggcacgaucucaacucacugcaaccuccaccucccgaguagcugggauuacagacaugcaccaucacacccagcuaaacuuuauauuuuuaguacagaugggguuucaccauguuggccagacuggucuugaacuccugaucucaagugauccgcccaccucggccucccaaagugcuaggauuacaggcaugagccaccgugccuggccagaauuugccuuuuaagacucuguucucauucauuaauucuagcaauauuacguaggcaacugcuaggacccagccccugcuauaguugcuggaaacagaaagaggaugaccgcauggcaucucugauuauggugccugcauucgagaagaugcauuuaggaagaugaaggcaaguaauaugggaacgaauaauuaucugugguuagugcaaaaacaaauaagacaggauggauugggcaacauuugggaagguggucagacaacaaggagguuauguggaccugagaaacagugggccaaggaaugccagccaugccaugagcccagaaaggcguuucagguggggagaaagugauaaucaugaagcuggcagcaccggacaaagauguggccccagguagggcaaccaacacucccaccacaggucugccgggcagcaggaaggggaagcugaagcaagagccaugggcccuccaccaggcaggcccccaggcacuaucugaacaagccgcugucucaaauacagagggaggucugugugcagggcagucccagugcccuggaacaucuaccggcagcuuuucuccaaguccacuacucuaaccagaagagcagguguugcugccuuuugauccauuuagcuauuaagacuaaagggaccuuuguucgaugucagccagaguuggccagaccguuaaccuucugaugcugccuccuccagucagguuucugcuucagacucaacccagagacucggugugucaaacucaacccagagacuuggugugucaaacucaaccgagagacuuggugugcuuccccaagaaaaguccuugagcaggaagcaguguccagaacaaugcacauuauuccuucacaccucugcacacguugccuggcuggugcacgggcgucaucccacacgcagauccacugcaacucacaugugacagauggggagaugggcuggggggcggaccucagggucaacuugcuggcaggcguuuccaagugggcacucacagacucauaagugcccucuaccaaggaaccugccucugguugcagauucccagggcagcauaauggggagugcaaacaggaaucaacucgacagauaaagucgagucauuuuguuaacaagaacucagauuagauuacucugugauuacaugguuccuuggugugauaaauugguuaauaacaggauucccaguguaguugcuuaaugggaauucaauaauuacagguagccgaaauuguacuguuagccuaggagaugcuagcgccuucucucuguucuaauaacccaaaaccaaucuggggcuguugaaacgguuacgaucuggagaacacaccuucaauauuaccaaagcaccuugguagaauuacgcuucuauaccuaacauaccguauauucacagacucgauugacaggcucuuguuuuccuuguuaaauguccaaguugaagagaucccuaauagauaucuuuauuacuuagcucuuguuuccauuauaagauuagugaucaauagauaauaaugguacaauaauauuuaaauugcaucuuacaguuuaggaggcucguucaugggcauuuuucaguggggagagauugucaccacaauucaguaauuacgacagccugggaaggaacuauuuucucccccuugaagugaaagaauugaaguuuaaggagcccccgacucccaaaccagcaucagguggaagaggcaggguggaaaccccauguccuucuagugcaccacaucacggaacugaggcccggauuucauuaaugcagcacagccuuagacugcacuuuucacaacuguccuuagaagagacuaugccuccaucaucacguagucuggauuagcaagacuuaaauucaugagauuuuauucuacuuccuauaaauuagagcauaacucaaagaggcucuucgaaaaaagggaaaaggauaacuuguuuugggagcaggaggucacuagccauaaacuucucuggcaauuuuuuuuuuuaauuuuuugaguaauauuagagucacugacaaugagaaaaauggaacaguggauuuaaaacaugaaauggcccauuagauggguccugaacuuguuuuaaaacuccagauaauauagcuuggcuguuucugucuuuccaaaaugucaaaauuugucuaggauuaaugguucucuaaaucaauaggauuucauguuuauaaaugguuuacgguuccacugguuauaaaauguuaugagcucaugcauuaucaucaacgcugagccuuuacugaaaucuacugacauuuagucuggcauccagaccagacauggaaggaggacagagcggaauccucccaaggccuggcccagaacgcagaggucccaaggagggacagggugagugggaagggaagcagaacuccucaaugcagagaucaucacagaaaaacgaugcauggaccggggguccuaucccagcugccaagcagaccuguuaggacuccaaguuagaagaucaaaugugguccuuuucaaagacauggagacgagagggcucuagacaaguugacagcaauuuucggagaaaugcuguaagaaauaacauaguucaaaaaucaucuuuaacaccaucuucuaaugcaaacauuaucacugcuuggcaaaugugcuuccacauuggcucugugcuugcacgccauggcuugagugauggaauuuuacuucuguguugucuuuacugaacacuccccacgcuucucccaaagaaacugugguuaguaauggcggaguaccguucaaugguguugacuccaugaacacacuauuuuccccagcguugggcacuauggcccuuaucagauuuucagacagauaagcuuuuacaaggagaaugucagccaaggucauuuccuuccagaauuguuuuaggugggagaucagagaaauagauuucucugaucuugugauacauugcacaggaacggaccuugcgugcacuugguauagauguacuaaggugaccccugcccacucauacuuuugguuuucuguuuuacuccaugaggcccaugugaacagacuguggacaaacaaugggguuauucauauuucacauuuuucauuuccacaaauacauacaccaacugugcacauuaacacaauauuaaagauucaccuacagaagcaaguaaguuauuuuccaaaggaagugagccuccuugaacuauuucacgggagcacagagcuaaaacauaguauaucgaauugcuauuauuaaaccauaaaauuacauuacaaacacacacugaucaugcccaaaucuugcugacacuaagagggaucuucauauggaaaagaucaaaugcuaaagucuucacucucucucuuuucuaguguggagcuggauuuuaagcagcaagaagacaaacuccagccgguucuaagaaaacuccacccuauugaggaaacucaggucauaccuucgccuuacucucaggagacuuacuccucaacucccaagcaaaaauccaaaacugaaucuaaaaagcacggaagauggaaacucugguuccuuuaacacucacggugucuggagucucgaggccgucuuuagaacccacuggaguuuaagucaauacuuuuccaaaaugaauaggaucgagggaacuguggugcccauucaggcaccucccacuucucgcccugcguaccaaaaaggccuuuguaccaauagauaauuaacagaagcaagguauucugugucacuccuugccagcuguucuuugcaguucacugaugugggauguaaaaucugaaaugaaacuuacguagucaaagaugauaaguaaaaauuuucccccacccccgaucugcaaguaauacauuaucaaccugcgagauggcaggcugucacccuguacacagcuauaacucauaauuauuuucaagccuugauuuuuuuuuuaaauaaugagaagaaaaagcaagccuuauguuugcgaaggacuucauuuuuauguuucauuuugcaaauaagcagggggcgagugcaauuuucagcacaucaaauuccggagaaagcacaauuuuuucaaguggucggagaccaugaauaaucucuaaaaugugacuauauguauauuugccuucaugugcuauagcgcuaagccaagugaccacaucucagugucacaacgacaccucaaauuuagcauccucuucaucuccagacuuacgacauguuuacugcucauuuuccaaauggccagcagccaggagucccccaaagucaggauaugccuuuaaucacugcaaguagacagggucagagcuauuggacacuaaguuuucuuagaucucauuuuuaaucuuuugguacccaaaggccaaauaauacauucuggcaagaaucugagaacauacauagagauacacgauggauaauccacccaccaauaaaucacaggcauucugugccauggcagacaguguuuuuguggaucgauccuccgagacacuguuagccaugguaagugcagccagacguuauguacaauucguuaugcuuuguauuaaugguggaagcccugaccaucucaaagagaaacagugcguuuaguuuagcugcuaccaagggacaaugucgccuacauuuaaccuauuaguaaguuguacuaaacaacauacuuaggggaaagcugugaaucaaauguuuuuagguauuuuuuaaaucaacaguaacacuuagaguucucucuugauuacacauugcaauguaaaucuuaguuccuuuauuuuuucacucauuucuuugcaccuuugcaaguaucuuuuuauagaaaucaaauccccuagucuauuaaugacuuugucuaucaauuuuuugauuuucacaauaggaaguagggaucuuacuuugccuuuuuuuuuuuuuuuguacaacuuaaauuuugaauaguuugugagcauacaggaaaaccuagucuugaaguuucuguccagcaguuucacaucuaguggagugcugacaugcacaccucauugacuagaugccaaacacacaguggcuaaccuugguaaaaggaucucaccugcuuuugucagauuggagcugcuucuugccauguauuuuccuccugacucaacagcaaaucuguuuuaguucuaaguguuuugauucuacaaggaccuagugaucaguaaccagaucgggccuugaaaaaaaaaugaagaguaugucguguaaacauucuucgggggccaaacaacacugcaguuguaugcuuuaauuuaaaacacacaugugcacacacacauccucugcggaaacacuauaugaaguucgaaucccugaauaucaauaaaaggaacugagaaauauuuuggugcaagaacaaugaggaaguugauccuguaacaugaaggaaguguaacuguuucacguagacuaaauauuuaaaaauggguuucauguuuuuuauacuguuuuuaacuaaaguuauaaaaauguuuccaacaaguucucucuccuuauguuuuaagaaucccaacuaucucaguaaauugaaauaaggguauuagcaguuuucuaauuaguaacacaaaucugucuaaacaagaggacauccuaguacacaaaauaaugucacuguuucacaccagucuagaccaaaaaaaaauaaaauuaaaauguucagagucaaaaaggaacuucugaagauaaauuaauucaucccuaaaaauuaaaguguguucaaaauagaaaaacuauugucaaaaucauuucauaguuuaauugcaacacgucacuaacagauggugauucuucucuuggaaagauucaaguaaaaacgcugauacaaaagcaagguaaaacgcacaggguucccuuauguagauguacacauggcauugcauauagagauuaaauuauuauacuugucguuaaguucuuuauuaauuuuuaaauaaaaaaaucaaagauguuuuauguggcuauuaaacuuauuucauggccucaaaaauuggggaacauaaaaguaaucuaagaaaauaauaauaaaggaagaauguuugggccgauaggcauuucauccggucugcagaagacaagagcaucguaaggccugggccugacccaccagccagagcuggccuggcuuggggagggaagggacugacgcuugcccaccuaugcacccuggcauggaguuucaccaccggaacacaugguggcauuuuaggaugcacacaggcucauagcaggagguauaugagguuuaauucuuaaccucagaagaaauggcuaaauacauugaguguugccacaguacacuguggcauguaaaucuugccuccauggcccaggggagguagcuucucucuagaucuuccauugagcacauccccagccucaagggaucagccgccuccuuccuuucuucuuccccucccuagugggagauaggcugagcgccuaccucuccugcugacacuagccuaauacuaacccaucugcacacgugggcugguguuugccucaccuggacggccuaggagaggagaggccacaaugcuuuuucccaguaucugcaaccacagaguccaugugcaagggagagggcacugcagaccgacacucaaggcuccugcuaccaucgcauguucuucagggagaagaaggggauuccucuucugacacaugcagaaagggaaggaaggcccaaugcacagcccagagcagacagagggaggguucugucucauucuauaaucauuucugagccaacuauuggugcugccucaaagguccuguucuacagacacccagauacaaugaagggugcccaccagucacucuacaagugugcaacucacuuccaagaagcagaaguccuguaguccugcaucugcuccuucaaucucugacccuccagcagaagauaaauggggaggggcucaaaguaugggaaaaccuugcuaccuuggaaacaacuuaggcaguuggcagcauuucccauguacccugagaggcaguuaguuaucuacagccacagagaucugagauguggcuggacuacuggguguaaauggugucacagucauggcccagccucaggcagaccaacuccaaccuauaaacagucacaaggaggauggccugcaacacuguuuuccuuggaaaccacaugggcauaucagaaccaagauacacaacucuuaauuaaaacugugaagacagaccaucaaauacuggccuuuccuagaagacagcaagaaaaggaaacaagaaagaggcaugaacuuuucuaugucaugguguuaguaacaccauggccuguuuagaaaaccugucacugguggacucauuccuuagcauuuuuaucagcaagugaaaguugauuucauuaugaaucagggcaguuuggcugcagcagugucaccuaaagaucacagcagcugcuucccacaccagcacgucuucuuugaccuacagaaacucuaucacuagcauauuugcaggcacugcaugugcagccacuuuauuuacugaaaguaaacaacucugugguacaaagaucagaaagaacauccauuucaugaacuggcauaaagucaucaugcuacaguggauccuauacauuuuggucaaugacaaggucauuuuaaguugcgcaaaaauuaacuuaaggcagucugguuuugcaaauaucuuugcuguuugguaugaauauguaaggauugcagagcauauugugcccauucaacaaugugguuuuuacuucuucugcaguaaacccauagcuaguaaccaaccuugaaaaaauaccagggucacaggaauaugaaaacaaaccuaaaauugcuguagcugccccaaagaaaaaugaacuuauaaaaccauuggugcacacacacacguuaggaugauuuucugaaagcaggcagguuuauuagcaaacaguacaauuauagacauuuuuaugaugacuauacaaaacccagacacuguccauuugaaacacaacauuuuuuugcagaugauuuuaaaaucauuuuuaaaacacauucauacuuaaacucuauuauaaugaacaucucaaaaugaaugcucaugcauggggauauaacaucuuugugaaaauauuugguuaugagucuuggguaaaaggcacuauucacugggaaaccaauucuauuaauaccauuuuccaaaugaaggagcaugucaggcccuuaucaaucacccaugcucagagaaagcacuggguuuucaccaacagcaaauuccccaccaaagaugcuguugucacaaugaaacacacccuccaccaucccaucaaugucccccugagacaguguuuagaguggaaacaaaauaacuuccaucacuugugucuagggagucaggaugcuccaguggugacaagaguuaaguggagaauccaggcaaaaucuuccccuucccuaugcccacuucugucaauguucaaagggaauuuuuccuuaaaagaagcccacauuuucauuuucaugaauuaguaauuuccaauccccucguguguauccaggccaaagaaaaauguuuagaaguccuucucacucgauuacauuuuuaaaggacccauuaaaagaauguaaaucugaucauuugaaagaagcaacagcagcgcguaucacaggagacggaaauguuacucauuucaacagcucucaucucagccuggagugcuucuuacucuaggaaaaacacacacccaauggcuggccagcccaccugcacacaacacaacagcaccuaucccagccgcggucaccugcucagauccgugugugaugaggaaaaaugcugcuuaaugcugagggcuuagaaagcuucucaaaaaggaaggcugaaauaaauccugaagucugacuuaauauaaaaauaaguauuucacuccaugcuucuacagcaucagacuacaucagaguaaagauaaaaugaccuuuuuguucuguggcaagguuauugcaacgcuucugucucugggcaugugcuagguauucacauggucuacaauucugcaacugccaaauagaguuguuuugguuuuuucuuaaggauguaauacuucggaucauagcacauuauuauccuaggcacgagacgcauuccaaucacccauuucaaauauaaucaacuaaagcaaacaauauacaacugacugcaaagucgaguuuuuguaaaaucccacagauaaagaaaagccuuauauugcauaucccaauuuaucuaauuaagugugaaguuccccaguuuucuauuccuuacauuaauagggggaagcugucagggcauaaucacauucccaguuaaugccuuauuccgauggaaagaggccacauuucuaguacuguuguugacaacaucauggaauaaaucauuaaguaaaguauauuaauuucagaguucuuuuuaaucacuuuaauuuuuaaaaacucauuuucagugauuacuuagaauuuuuaagcugauucauaguuacauaauuuccacuauauuuagcaaaaaugaguaacacauaaaggcugaaaucucuaagauauaauggaauggaacagccuacccaaaacagaccuaugaacuauuuucuacucuuuuuccacucuagaaggucuacugauuaagguuuuuguccaccuugucagggauacuuuuugccuugaucuuccucuaaucuaaauucacagagcaacgacuuuaaaaaguuaaugcacaaaucuacauuugaugcaaauuggaagagcaagggcaggcauccuaaacaggguagcauuucacucacacugcucuguugacuccagagagggggcucguggcugguuggggauuacaaggucccacuaaacaacucgaauuuucaguggcaaacacccuucuugaaaacaucuugauguugucaucacucauuaaaugauuauagcuuauucagaauuuuuuugagaguccuuucaagacagcugcauuuuauaaaagaaacuccaaggauuuuuuuuacuucuuuacagaucuuagagaugguggaauugggaggaguccguuuaagaccucucuccucuucccacuuugaggcuucuguuugggaagaucagggcuguggaggaugguucuggaggugggaaguuuguucuaccucuuccauucccggacagugcuuagaccccuaugccaaaugcuugauaucaauguggcucuggauaagaccaagcauggguccucgcugucacacccccuucuuagaacaugcaaggcuucuuccugaggaacuccucaggguuccuuagaacacagggguucuuccaagcuggagcaucccaagcccuucaggaaaugggcaccuagcuuguggucuggcccuucuagcaaggagauccuagaguuggaccauggauacgacaugauagaaaauagaaaggugcuuauuucccugaacagcugucucccuaagcaggacagggaucuaggagcagcucaguccuuucgaugacuucugaaguggaccacggccaucagcaucgugugccugugucuuauagaagggacugacagcauacaugggaaccaaauccaggcuggaaacaagugcugccaugcuagcugugggaucuugaacuguuucuugucugucugcagggcacugugagaauuaaaugagaaucuuccuguucauuauagagugcauagcacguaaaugcaugcucagugaagaggugccauuauuacuaccacacuuauuaucaugccugagauaggagaaauuucucaaagacauccuggaccacauggucugagaggagauaucauucccugcagggucuauucuacccuuugaugaagcugugagcacaucuuauaaucucuccacauucccagcuucccauccaaacuuuaugagcuuuuucugugcccucuucccuccaguuuaacuguugaccagugggcuacaagucaagugaacacacaccuagcauaaagacccuaaauaaggcugggcaugguggcucaugccuguaaucccagcacuuugggaggccgaagcggauggaucaccugaggucaggaauuugagaccagccuagccaacauggugaaaccccaacuguacuaaaaaauacaaaaauuaucuugaguguggugaugugcaccuguaaucccagcuucucgggaguccgaggcacaagaaucacuugaacccaggagacagagguugcagugagucaagauugcaccacugcacuccagccugggcgacagagcaagacucuaucucaggggaaaaaaaaaaaaaaaaaaaaaaaaaaaaaaagaagacccuaacuggaggcaggauugugccccaacuagagacaggaccacacccccuaaccagagacuggacugugccccccugaccagagacaggaccuccuaaucggagagagaggaccaagacccacuaaccagagacagaaccauguuucccuaagcacaggcagaaccaugcuccccuaaacagagacaaaacagucucaugagaccaccugccuccacuucuacccucucccucaucugccaccaccccugcaugccaucaugucauccccagccucucuaaguccgcccaucccaagagggucuuggcagaaccacacuugguucaaguucaagccacaugcucuuugcucuacauaaggcccuuuccaguuccacuccugagacugugcagagugcaccugcggcacgacuccaagaagacaggaacgucagacgucaggggucaacgcuggacaucaggggucaacgccagaccucaggggucaacagguggcucguggagucacugcaaauccuucuccaugggcucagugcccauuccauauuaauguguuccaaauguguuucaagacuaugaauaauuaucauggagaauaagaaaaggcaggcaaauuuauguuuauguaauaauggaaaagucuacuguaaauaaagccaauuuacauggaaacauuuuauuuccugauucauacauguuguaauccaaacuuaaaaguguuuaaguuuaaacuuuaaguuuaaacacuuuaaaaaggaaaaugugaguuuaaguuuaaacuuuaaguuuaaacacuuuaaaaaggaaaaucugaaccucacaugugcugaagcucuaagacaugaacuguuucacuggauggaaacacacuaaggcagcauuuguccaucugugcgaccugucugugacgcacacgacacggaguccucuguggugacaccagacauaaaaacgcaaaggaccccagugcuccguucugacuaugcuguccaagaagacgcacaucaccucccuguucacaccccagauaugcaacaagaacaacggucacgcaccaggaaggaccagggugccuucucugaugucaagggaaaacuccaaaaggacguuuucuccuuucaagucauuuuuuggaaaggauccaccaagaugacuuaaaugauaacaugugcuaaauauuuuaaacauuauccagucuaucuuugaugggcauucagguugguuccaagucuuugcuauuguaaacagugcugcaauaaacauacguguacaugugucugaauaaagaaaauguggcaccuauacaccauggaauaguaugcagccauaaaaaagaaugaguucauguccuuugcagggacauggaugaagcuggaagccaucauucucagcaaacuaacacaggaccagaacaccaaacaccacauguucucacucauaagugggaggugaacaaugagaauacaugcacacagggaggagaaccacacacaccggggccugcuggggaguggggggcaaauggagggagagcauuaggacaaauaccgaaugcaugcagggcuuaaaaccuagaugauggguugauaggugcagcagaccaccauggcacacgcauaccuacguaacaaaccuguauguucugcacauguaucccagaaauuaaagaaaaaaaaaaaaaggaaagaaauuauaaccccuugaaccucaaaaaaaaaaaaaauuaaacgagaucuacucaugcauuuuuugcugaaggaaacagacuuaagguaagggggugcagaggacagcagugaacccugggaaaaggcaccaugaucagaaacuugauggacugucuaaauuaguaaaauauucuugaaaaaaaugaauaggcuccugccuaauuacuguuuaagaaaaacaccuacaauacauuagaguagacaauaaaauaacuaaggugaagaaucucaauuacuuuuuaggguccuucauaaaauuuuauuaauggcaccuuaaguguaaacacuauggagaaacugccagaagaaugacgacucagcagaaaauacaugucuuuugcuauaaguaaguaaugagaaaacaagagccaaauguuuccaucuuuaaaguugguuugcuuacccuucaacuuugacauucauuuggaaaaugaggacauuuuauauaccaagcuguaucucaacugcucacuacauugcaguauaauaagcuauguucaaacagcaguuggagaaggaugcugucagccccaguuaaauauccaaacauaugucaccaagcacuuacaaugaguucagaaucucgucccauggaaaugacgguucgguucacgguccggagaaguuucuccaugauaaucuggacgugccucuggguuggccccuggggaaggacacaccaaugaacaccaacaccagagaaacauuaacaugcaagccccagugguugucauugaauccauuuacccuguaaagaguaaaucaauuauaacccuuaaugagaugaaaaauggcccuugucaaaggcaaaagcucucacaaaaaaacucagggguuuuuauuaauuauaguccauuaaugauaauuuguuacauauauaaucauaguaauuuaauuuaagcaaaccuuaaaaauaaaagaaaaucuguuuaaacaauauaauguuuaugaucccugauuagcccaccaauuaguuuucuaaagauauuuggccaucuguaaauggaaggcaggcagauaacaguccuagaugguucugcacgucaaaugcaaauaacuuaaacagucacacaggauagaauguuuaaacagcauuuagcaaacuaucuaaaauucacacugcuguggcauucaguaaaaauuaacucuuuuauuagugugggaugcgauuguugauucuucuucgugaacuaugaaucugcuuaaacacaugcucuaggcccuucccagcaucaccaccuccucugugagcuuuggccauacaagcucuuaccccaagcuuuucuccaauaaaaacagggaagagccugaagugggaccacuggaggcuggccuuugggugaaggccuccaagaccucuccaaaggcaaugccccuguaagaggugagguuuccagcaucaccaagaacagauuuaauccgaucuuuuucuuccagaucacuaaucaggcucugagagaaugagccagggcuacagcggaguggguggccagguauaugggcguggugacuaggagggauuuucaaggucaugcaggaaacggccagggacaagccuuaucuacuuagaaauccuggccacucuguccagggcuaggggcaaggacagacaaagcccugcuuucaccuuuccaggcacaccuggaagaucaauagcaucaugugugugcuccaacaggaaugguauguugggagugaaaggcacagggucagacuuuuccauaugugcuggcacaaacuugcuuuuuauuuuuucuuucauuuucuagagacaggcucucacuauguugcccaggcuggucuuaaacuccugggcucaagcgauccuccugccuuggcuucccaaaccgcugggauuacaggcgugagcuacuucgcugggcuggcaccaacuucugauuuuuaaaaaagucccugaaagaagcauacaauuuagaaaugcaaaaggaauaggguaggccaggugcaguggcucacugggaggccgaggcagguggaucacgaagucaggaguuugagaccagccuggccaacauagugaaaccccgucuguacuaaaaauacaaaaaaauuagcugggcaugguggcaggcaccuauaaucccagcuacuugggaagcugaggcaggagaaucacuugaacccgggaggcagagguugccaugagcugagauugugccacugcacucuagccugggcgacaguguaagacucugucucaaaagaaaaaagaaaaaaaaaaaaaaggaauaggguagagcuacaaaagcaaagcacugaccuaggggaagagagccugaggggaggaaaagagcugcucuucuccuuacgacucccucagcaugccuggcuuuauuuauuuauuuauuuuuaacuuugugcauguauuacuuuaauaaaaauaagaagaaagaaugcagauaauuagccaacuuuaagcaucaaagccuuuuugucugaccuuaaggaugaaaauuuagguccugagagacauuucgucgagaagacacaggaaauaaagaacaauuuucaaugcaaaaggauaaauguuguaauaaucaccauauauacauaaauaaaaauaauuuaagggugcaacucuaccgagacaaaaagagaggcuagaccuuaaaaucaagaccuuucauuuuuaacugaauaaaguuguacugcaaggcaaauggcagguucaggcaaauggcaggacgucacgcacagagccaacacucaccacguccuuccuguacagcaccuccaggauguggcugagcagcugacagcaggccuccagguccuccugucucuccagaugguacuugagcugaucggucaucaugggaagcaggaucucucugcagucuacacaggacacagcauugccagucagugugaaacccaccaagacgcaacucguguuugcuauaagcuugucugcccuuucaagcaguuugcauucacguugugcaacacguggaacugacaucuggaggggggucaauuacuugacugugagaacaccgugucugcuguuauuguaaauaauucacauacaaacacacuuccaugcaucuauguguguaucccagguaaacagauaauaauuugcaagcauacaugauauauauaaacacacacacacuuauaucccacugugugcacauaaaugcagacacaaacacacauggguuuuuuguuuuuuguuguuguuuuguuuuugagacggagucuugcucugucgcccaggcuggagugccguggugugaucucggcucacugcaagcuccgccucccagguucacgccauucucccgccucagccuccugaguagcugggacuacaggugccugccaccacgcccagcuaauuuuuuuuuuuuauuuuuaguagacaugggguuucaccauguuagccacacacggguuuuuuaaugaauuuucucuaacuacaaauucacuaauuugcaacauuaaaagaaauacuuccuacaacacaaauuauuugaauugcagcuuuucucaucuaugccaaggugagccaaaguaugauuuccuucuccuagguagaagaugccaaucuuggaauguggcaauuuaaggcacacagaauccuucucaagacagcuuccuggagugggcugaggaggaacaggaaaugaaaagcaggugcagaggccccacucugggacgcauggcuauaaaaugaagggaugccaugguguaaggaucagaggcaaagcagguuuggguuuccauuuguucuuucaauaagagcagaggaaggauguucagaaaauaacagagcaacagggaaacagauacaaauacaaugaaaggugaaaugcaaucccuaauugucucuuccaguugggaaauccagcuuagcuggagcaucauccacucuccagcauggacuaucuauuuacaacaccaguucuguguuuugacacuagcccagccauucuuguuuccuuuaaacgcagagcacaagaggagacagcagugcucuaaaaccuuaaacagacuuagccgguuuucaggauuuuauauuuuaagacuuacaacauuaaagauacauuaaaacauguuuugcauuaauguuucuuuuauauaagaaaacuauaagcaugcaacauuggaaugguuccucuaaguacacagagcacacuuagaacuuucccaagaacuacacuguaaugaaggacuggggagcaggcagagagaaacaaagacugagaagaaacacaaaccccucuacuccccugucuccagcggaucacaugugggcggcucauggccaaggccuuccccaauuccauuuuuuguugauucgccaagaaaggagugagagcaacuccauuuuuacaagaaguuuuguccaauuaauauaggaaaauaagaauguaccuguuaauuucacaaugccaguagucaacacuuaggcagaagaaauguaugacgugcuaagagcugcacaucuucuggaaagaggccaggucagccucgaaggcuguggugucuggaaucccacaggaugucagugagggagagcacagugccaagaugggcugcccguguaggagacugcccuaguguuagagccacccgagaacaaagccagucuaagagaaaugaacaagaaaaugaccucaugggagugaauccagccuggaaacgcuaacacaugggacacacuauuuccacaaauacccccaaaucucaaugccuuuccuauagaaccucgauguuuacaaacuacauccaacuuuagugacucuugagcugcugaccuuaaccacaacacagcauccgacguaggguuuaacuccaaaugcucuagcccagcuggcuggaaugcuuccucagcacacccuuaucugagccccgcccugccagcacucuuccucguggugcccaccauaauaucucccaaaugaguccucuugcccuuuggcuggaaacacaucacacacugugccaaccucaacauggggagagcccuggcccaacccugucacuuggucaucccuagcacugccaccauucuggaaaacaagcugaauuuccaagaaaccucagaggcagcaguuagaaccacuaagaccugagcagguaaugacagccccugacaaugugacuaaggaaaaaaaugacuacauaagcuuagaagccgucuucugaagcaagcuuaggacggacccaagagagggaaaaggucuaacggaccagccaguacaggcuggaaggaggguguguccauaagugauuccagaaaaucagaggaacauagcacugggcucagaaacagcagagcuggcccuguaggcucugguacccagauguccuggccuaaauucaucccucaccgcaccauuuaucugucaugcuggguaggcaguugugaucugugcuauucucagagcuaauugagugugcuggucucauuuguuagaauuacucuggugagaagaaagaggugucugucuguucaucuuuggcuggaggaugcuaucaaccaucuuugguuaccuggugguaacguucaccauccaccccaccuggaggacugcgcuaccuucaccuguuugcuauccagccucuccugaugagaaacaacaaaacuuuuagaaaugucacugucauuuugucccaauacagacauuucauucacuaagcccccaagaagauguaaaaaaaaaaaaaaaauuguuauaaccauccugauagaccagaauccaacugcaccucagccuucaugacccagccauccauggccagucaagaucaaguggggagguggggcgaugucuacuuuaacugucgagacaaaaugagaugcugcuugaggaaggacuguguaaaaagccauccaacaugccucagugagaggucucccccggcaccaucagcaucaggaaacuccaccccgaccccaaaacagaaccaggucacugaggaggaccaggcuggcaacgaggcucuuucccuaaaggccaaaggucagucugcccaugccagggauuucaaccaugccuccaggcagagggucacacaggcuauggcaccuuacaguaccguccgucaccugguccacagcaacccaucccaggcccccaaagaaaggcaauuccccagagccacuaggagagggugggaggaccgaagcugaaggcagcaaagccaaggagugcaccucccuggugaccugugaucugcuggccucagcacagcccccacuggacccagguacaggaaggccuccaaugccccguuaucggaacacugaaauacugauugcuuuaauuaucuguuccuccuugcugauaugcaaucuccauaagagcagaagccuuccuauuuuucuuaaauggcauauccaagcacauaaaccaaggccugaugauaguggugguaugagugugugugucuuggauuaacuugcaauuacgcacaugugguaucaaacuaaagucugcaguuaaaagcaggucugccacucucaacccucaagaaaugguagcuguuaauaacaauaauacaaauaucaguauacaaagucagccuuuucaacuaaaaauauacaaagaaaacuaaagccuuacagcugcacuauccaguacaguagccacucagcugccuuccccaaaagcaaaaacauaaauuucuuaaaaccucauuuuuuaagggacuucucuuacucuauauuucugucuacagauagguuuuuucaagaaguggugggaguacacguuuuaaguaacaguaagacucuugaauuuugucuuaagauagcaaaucaagagcacugaggaacguauacuacaaaaacagacagauggacagacagacggacagauagacacacacacacacacacacauauacauauacccuacaaugaccuaucuuaaagcaugaacagcugucucuggcagccaaggaagaggaaucuccuaucuuccuauggacaacacaccuaaauguccugaauacuuuucccauggacaaaaugucauuucuacagguuuggcacugauagucccauuaguuccaaaacagauggccugggaagccaacaaauaauccaccaggagaaaaaaaaaaaaaaaggaggaggggucuuauauuuuaaagaaaaacacaucaucuuuugaauacucuggaacaaacacuugaccagaaguccaggaaccugggucacuuuaugggauuuggggaaagccuuuuaaucaguuuacccacacguauaaagaaauaaugcaauccccccugcuggcucuuugcuuuguaucuagagcguuuaagaguuacuuaaacucucuaggucuuaauuuuucuaaugugcaaaauggggaugcuguuggucgucucccagguugacugagaacuaaaugauacgauguguguauuuagcaaauaugagccuacaacaaauggugguuaacagaagguauaguauuauacaaagucagcuguucaacuaaaaggacacaaaagaaaacuaauaccucagagcugugauacccaacauggaaacuucugagcaugugaaaucuaauuagugccauggaggaaaggaauuuuuaauguuauuuaauuguaauuaauauaaacucaaauguaaaaagugcuacuugauuuacuuguuagaaaccaauguuuggaacaauugggguaugugaaucucauuuuucaaagguaaauuauauucaaugaugaaaauaaagaucaagugucuggugaaaauuucacauccaaacagagaugugcuguaaguguaaaauacuggacuucagagacuucauaucauaaaaagaauguaaaauauguaucauuaguaauauuuagagagaauucacguugcagugauguuuuagacaaaauacauugcuaaaauucauuucaucaauugccucauuuuuuaaaauguggcaacuagaauauuuuuaauuacauacacggcucacauucuauuucugcuggacagcacagucucagagaaugcuagaaagccgauguuaaagaccuuguaugugacuucucauuuuuaugaacuggcauuuauuguaagcagagucauggccacagcucucucuuaucagacacccugucacacguacgugacuccaggaccgccagugcuugucagugcugacuuaggcuacggugaccuacgaggaagcuagaaucagcuggcacagcuauccugguuuccucugccaugcacagagcuauaaagguagccaggcuccaugcaaaucagcugugaggaucacaccagccacccuuucacggcccuuccccagugugauccacaaugauuacagacagcaauaauucaacaucuguucauccucagcugcaagggccgaagccaggaugauuaaugcucugguaaugaggacagaguaaaaaauauuaaucuuuauaaaagguauucaauaagcauuaucagcuuauaaaugcccaagcagaauaucugaccauaaccccauuacagcucuacauuaaagcaagaugcaaauacaagaaugaauuuguccauugaaaacauucauuuuuaugaacagaguaauguacuucuuaauuuuuaguuuggucacauuaaauaaaugauccauaaagugcauuuaauaacucuguguuacauagaacugagauccagaauaacacuuuuccuaagaauuaaacaguaagaaucauauacaugggggguguuugcuauucaucuuguauagucaauugucuuauuuuccaaccaucuaagaauccuggacccacagguuucaacauguucacgugcuuuccucccuccauucaagucuucaaacaacagaaauacagaagacggugccgacacuggaaggaaucgcagagccaucuccuuagccccacacuucacagaugugggagcugggagcugagugaagggaccuucaggacugcaccucuacgcaccaucggagucagaauuauuagaugucuauuccggccgggcgcgguggcucacgccuguaaucccagcacuugggaggcugagucaggaggaccaugaggucaggagauagagaccauccuggcugacacagugaaaccccaucucuacuaaaaauacaaaaacaaaauuagucggccacgguggcaggcgccuguagucccagcuacucaggaggcugaggcagaagaauggcgugaaccugggagacggagcuugcaguaagccgagauugcgccacugcacuccagccugggugacagagcgagacuccgucucaaaaaaaaaaaagccugauuccucagcuggagcccccagaguaaaggacccaugcagguacacguguguguaaaccuguaugauucaggcauuuuuacauaacagacgcaaagcaaauuuuucaagaaucauucuaaccuaacaagucaugaaaguuagcaguaccagagaauaaaucaacaucaaguuacccuugguaggucacuuuuccuuucugcaccuuaguuuccuagucuguaaaauggaguaaacacaaauggccuguacaguguuucuguuccaagcugcccgacaguaccuuuuacguguucugacuggaacagggccacugggcagagggcugaaauuguuagaaaugcgguaaucugcacuucacucuugagguauucaguaucauggaauuugaaaugaaaaggugacagagcaaguaaaaggguguuggaaauuggaaggagggggcacaguagcacguggacuauugaacaacaggaaaaagaaguuugucaaauauauguuuucuggacaucggcacaaggcuuuguaaaaaagcgagccauccuuuaaaggaaggcagugggggagcagauauuuuguaucuuuuacucuggaaaacuaaggauuaaacuuccauuacucuguuaguaacaaguugucagagggaagaaauuaaagaagagccaauggagaaaaauugcaaaugagucccauuuaucaguagaugaaaaaauuggcaagaugcaagaaaaaugcagaaaacacugugugagaagaauuggucaggcaggaagucuguuuucuagguggaaggggguacaucaaggauguggcuuguguuaaguucagaaagaauuuacagggcugucagucugcaggcaggaucucaccacauggaggaugagaaaacugagagagaauauacagggcuguggaaugguggguauuuuuuaaaccaggagaauaaagguagcaaaaaaacauaggucuuggcccaugugguccugcacaaacuccccuccugguugcucugacaauaaaauacauaugucaaaacccuauauuguguugcaguucaucuuagcggaaggacugugcacccagggaggaguuuaugcccaagaaaagacagagguccuaaagcagaaccuaggagacugcaugcugaccuggggcucuuuccacugucccaggcuaguuacuguagacaacacaucaugcaguuacagaaaucagcuaccaggagcuagaagaaaucauguacuaaagagacucagggacuugcuuuccuggugcccagugugcacaugacuaaauacagcacaaccaacacagucucuucucagaucguucuucuugcauucaacauccagcaacaggaacagaagcccacccagaagugacagcagaacucaacagacgaugauaaaguuuacaccaacuauaccauaaacuguuggcaccaccaauuugaucacagauaaaggucccacacagaaagaagagaaaaacuauuaaaacuccaugaacauauaagcacaacacuguauacuuuauacauuuaauuuauuuguauguuuauuuauucacuuauuuguauuuugucuugcuccauauggcauuugaaguaaauucaguuuucagaaugcauuacucauauggugggugugaaacaguuuaagaaaagagugggcugauagauuuguaagaagccaccuccucaaucagcaccacggcgguggacagcucccugccaggcuucuggcugaacucugguguccuuaucugagcauugagauaaucacucuuuuccaauucuacauuuuuaaguagaugacucugaagacucucaaaggaagcaaacucgcuaaucaaugguucugagcacacggaagauauucaaugaauuaugauggaauugaaacagaaacaauuaaaaaccugaaauugaguucacccuccuacauucaauaagucauuucuaaaauccugcaguguuauaacaaauggucuuuucaaaaacauauauaaugaaagacagagaaugauauacagaaugagggaugaaaaaggugcaguauuacagauaaaaaguuuucucaaggcaugaaagaaacagaagagaaaaugauguuuacauuccaccauuauuuaaaagaaucagucuucaggguucacagcugguaccguucaucagaagucaucagcacaacuaucuaauuaaaguacugcagaaugcuauaugagugguacauuaagugaauguggcaaaauugaccccaaccccaauuuuuccuucugcacaacaucuaucaaguuaacaaaacuacugcagaguagcuccagguuuaagaucccuuucgauauauuucuauuuuccacaacaguaaagcucaagagauuuuauuuugguuuuuuuaaucaaaaaugcuuuuaucaaaacauuaagaagguauauuauggguuuguuuuaaacacgcaacuuuucuauaauuuaaggcauaauaaguuuauuaauaggguaauuuuugagauauaaauuucuaucauggaucaaaucacaaugauaauaguguagaaaucugacuucaauauuuccuaauagcuagucccaguaagugucugggauuuugcccucagauuucaaagggcugcuguaacuaauguuuccaccauuaaaaaggagaguuuuacucugcuugauaacuagaagaaucauucaccuugaaaauaagaauaaggaaaauaauuuaaacuuaccaggcuuacacuuucaagaagcucaaaaaugaaagcaaaugaaguuugaaaagacucaugaacacugucuacaaggagccuguuugcuauagugaagggaggagccccaggagagccaggguaugagggaauggccucuuucccauuccuacucacugccagaguccaaccaccagaaaaacaacaaacagacaaacagaaaacuacacagagcaggcuuacagaaaagcaaucuaucuagaguauccaacuauuugcaagaccaaaaagggguagccuuaccacuaaaauuuacucucaaagucucauacucccauccaaaacaaacuaagugaggacaaaaugauaaguacacaguaagcuccaaagaaaaccuguccacugcuuuggccacuauagaaaugggaauauggaaaaauuauaccuugcaaagcaaauaagugacccaguguucauugaaacaagcuucccaaagcugucagauucagaaaggggccagugggugagagaacauguuccaggaggacucucaccuccacucaaaggcuucuuacaaguauagccaaugcucuuuacuaacuuaaaagucaauguuagcucagcuugauucauuuuauuccaauuucuauaacauuaauguuacacaauuuugugagcuuaaauccuaaacgucaguguucuaguguuuaauuacacuaaaacuuuucauuucuauaagauuuaagcuuuaauuuucacagcuuuugucagcuaugugggcaacaauauaaucacauggaaacaaagcuacaaaugcacaaaugaugaagcuuugacuuuuccuucucuuuguaucuaucuugcuuugaaaaucugcucacuccacaccacagauuauaugcaagagucaucuuuuggugaagcauguaaucuaucaaccagcuuucaaguagucaagucacauggcgagacaaagcuuaaagccaucacagccuauugacucucacacacacugcccauucacugacucacacacaguaugcuaaugcaucacaggcccucuaccucagcaaagggccaggggugggaacauccaagguggaugccuuaucagcauggggaucagcuccucugcacaaccucuucuuaggaacacuguuugcccucuguauuaccaccauacauuuaaaaugacaaaaaauggaaugcugugauggcagagauuugccucaaaauaucugggggacgggcauauagauaagaaaagauggacuggccgggcgcgguggcucaugccuguaaccccagcacuaugggaggcugaggaggguggaucacgaggucaagagaucaagaccaucccagccaacacggugaaaccgcgucucuacugaaaauacaaaaauuagcugaguguaguggcaugcgccuguaguaccagcuacucaggaggcugaggcaggagaaucgauugaacccgggaggcacagguugcagugagccaaguucgugccacugcacuccagccugacaacaaagcaagacuccaucucaaaaaaaaaaaaaaaagaaagaaaaaaaaggaucaugaguugauaauuuguggagcugagugaugaguacacuggcaugcauuacucucuucucucugcccuccuguauauuugaaauuuuccauaguuuuagccaaagguauagccaaaagguaucuugaaugcacagaucugaacugcaccccccuccuauuuccagaaaacaggaaugauuagaucagaugcaaauagaagagcaucuugauuuuauaaaacugcucagagaagacucuucacaccucaagucucucacucuucucccucucccuuugcuccugauguuacuccuccucuaagaccucuccuuucuccccuaugaucaauucauucaaugcuaagacaaggaaagauugccaauuuccccaugugaauccaaaccuuuaccucccuucaaucaagucaacuacacauguguguagcugguccugcuucuuucucuguacugccuccugguuaggaauacccauaagcauuucauucauucaauaaauauccauuacaggcaugcugaagccaggcaugcgcuagguaccagcagaagagcaaaaucuagaugaacaaggcccagcuuggaaaguucucauccuauggaaggccuacaaauaagcaaguaagaaauacaaugauuccacauggggggcgugccaugaggagccaugagguggcauguagggggcuuuuuaagcagggcaaucacaggccucuuggaagaaauacucugugaugguuaauuuuaaaugccaaaugacugcaccacggaugcccagagagcuggcugaacauuauuucugagugugucuguaaggauguuuccagcagagauuagcauugggauugggggacugagucaagcauguccauccugcagaguguggguggccaucaucuaauccuugagggccuggauagaacagaagggcagaggaaggcugaaugcucugugagcaaauggccgcagugacgcaggccugguguccucauucaggccagucccacauggacuggaccacacagagcugucuugcuuugacaagcccaaagacgugccuccuaugaagcccaacaaacucaggaugcaccuacgguuuccauguucuccaagagagagaaauggggaaaacaaggccagaaacaaccaaggcacuguaaggccuggccuacugggacccagaccuggcaacgaaaggcuuuucugcagaggaacaacaccaguuucagaauucacugccagccucuugcaaacagaucuacuugucauuauaucaggcggagauaaaaagaaauguuuuagugcaaagcaaccagugggucucuuucagugaguaaggcaacacacaagcugagaagcaaagacuugggaaucucacuucacccagggagcccccacgaaggagccuggaggacacauacagugacacauucugaacacauccuccagaggauguuuacuaagggcaagugcauucaguggcacaugcagcuaaauccaguuauaccaaguucuagaaaucugaacacaaagagaguucauuugacugauuccacugggaucaggaaacaggacaaaaacaaccacauuuguacaaauuaacaagaaacaggaaaaaagcaugaaaaucagauucaacaugucucaucagaaaacaguuuggcuuuaaauuguuauaccaaagguggcacagaauauuuugcaaaaguaaugacaucuuuuguaagaauggaccaacuggaagauuucuggugauaaaucucuccugaccaggagguaagaugucuguuggcugcuuugaacaagcagagagcuugcagaugagaaaaacagguuguuuuaagaaaaacgcuuaaaacucaaagacaguaaaugggaccauuuucacguuggccaaagcauuccgaaaugcuucuaggcaaccacuaagcauuuagaaguacauuugagcugccaguuacagcuuagacaacuucuacugauggggcaauucuggggcugcuuguaagacacgaagcuucgggcuaauuuugguucauuuagcccacaauaauuugggauucauauauuucauacaaccucauuuacuacauuggguacaacuugcuuauacuaagaucaaaauccuaauuccguacuuaaaaagaugacagcagguuaauuauuucaaaauauuacaugaccugguaauuccauauuaaacaaagcuaagcaguuauucacauccugcauacuuccaaaacaggacuucaggcugucuaagauaaaaggcuuagagaacaagaaugaaacagaaauggggcauaggaaagagggacagaacacaauuacaaacaccuaagcuaacaaaaucaucgaauauaaacaguaaguuuccuucaagcuuucuacgaccuaaagaaaugagcaaguuuuaauagaggaaaaaauaucuggggucaggcucgguggcucacgccuguaaucccagcacucugggaggccgaggcggguggaucauuugaggucgguaguuugagaccagccugaccaacauggugaaaccccaucucuacuaaaaauacagaaauuagcuaggcaugguggugggugccuauaaucccagcuacucaggaggcugaggcaggagaaucauuugaacccaggaggcggagguugcagggagcugagauugugccauugcacuccagccucggcaacagcgcaggacuaugucucgaaaaaaaaaaaaaaaucuaauugaaucuuucauggcuuacauccuuauucaaagaaacuaaaugacauacagaacaaaguuuugcaacagaaauuuaaaaauauauguaaauauauccugaagaagaucuucguuaaaucaacacuuaagaaaaaucaagcacaauucaucgacaauuuacaacaauuguuauucauggacgguugacacucauugacagcuguuaauuugaugaagauacugaugacgguagugcuggugaugcaguaugucgcugugugugucuuggcauugaaugguuaggagcaucaguaacccaccuaauaagacccagauauaaaauuuucggaggauuuuacuugcugugguacaaagcuuauucacuguaggaggaaacccugaagcagggugccuggccaucaccucuaucaucagccuuuccuuaagcccccuagaguacccaagucuuggaaaacaccuggugagugggcaauucaguuuccagugagaaacugaaauauggacagucaggaauaauagcucaauggagcgucaugugcuuugagucccagaccauggugagaacugacuuucuuuuaugaaaguaagaagugguuucugacuaaagagagaggucuacauggaggggcugcagaaagucacccacuucuugguuugauguguuuuuuucuagagaagaacacucucaccuaaaugaagucaacauuuucuuucaauauuagccuuagcaacacguguacacucuggugcauuuuauaagguuaagccaagaaagaagauuaaaauucgcaucccagaaggcacaaaggaccaagccaagcacagaguguguuccaaacccagcccguaacuuaacagggacaucccaagucugggauccgugaaagcacaggggaacugagaacaacaccaagaaugaggacaacagaaaaugaauggagcagccaaauguccaggcacaaauggaaucgaauaaauccaugcuucucagucagaaugucacucaacagacuucacauuugccuccaauaaaugaggaaguuuguggaauuaugcagagguuuuaagcuuucaauaaaacugcuugacaaggguaaaauauuaauuuaaucuguccaaauagaaaaaaaaugauuacuaaaaagggcagggagauaacauagggaaauauaaaguguucugcaggauaaaugaguugaagaaucauugaaauucuuauuacuuugaguaggauuugaagaaaugcugucaaagaaugcaaaguucagaauaagauaaaaccauuacuuucagauuuaaagaaaacucgaauucuuuuccuugcaaucaucacaauggagcgaagugauugccuccccaggacagacaaccacauaucuuaaaggcuacaauguaugcugauuacccuaggacuuugguguauaccuaaauuacaaacuacgagcuuuugccuucauuucucaaugaucuauuaccugcauuacaugucaauuacccuucucuuguaagggcuaaaucuuccugucuuguaauacagcaguuuuaauugguugcagccucuacuccuuuugucaagaagaggcaauucagagggucaaugucuucagaaaauaaauaacaggacaagugaauaauucuugggguuccacucaccaugcugugugaagaggucacuguggacgauuucgaucaagcaguagaguuucuggauggucagcaagcccaugggaacauugaggaugaauucaguaaacauuuugcugugaggaaaaacacaagggaaauaauuuugagacacauagcaaaaggauccaauguuguuacaauacugagauauaggucaucacauggucauuaaugucaccaguauguucaacacagccucucaugcacuauggggucaauaacucauuccaagaaaugauguuuugaaaguguucguuuucacuucacaaucacuaacgugccuauaauccaaaagacagacaauaacaaguguugguaaagauauaaugaaaugagaacagucacaccaagcuggugggaagguaacacagcacagccacuuuggaaaacaguuaggcauuuccucaaaaugucaaacauagucaccauccacuuccaggcauauaccaccuccccgagaaaaaaugaaaacauauauccacacaacaauuuguccaugaauccaaguggcauuguucauuauacugaaaaaguaaaaaaaacacgaaguccaucaguuaaugaauggaugaacaaaaugcaguauagccacacaauucauuuccaaaaacaaggaggcacugaugcuaaaacauggagaaaccuugaaaacuuuaugcuaaguagaagaagccaguacagaggccacacguuguaugauuccagcucuguaaaaugcccagaaaacacaaauguguagagagagaaaagagauucgggguuaccugggcuaggaaggaaaaaugaccagaaauggacacugggaucuugcugggguuauaaaaauguucuaaaauuggacucuggugaucacugcacaucuucguaaauauacuaaaaaccacugaauugaaccgucuacaauaggugacuuuaucguuuguaaauaauaccacaauaaagcaauuuuuuaaaaauacacuuuuacaaaaggcuaacagaccuaugaagaaauuuuagaagagcucuuguuaguaacuacauaaacacaaauuaaaaugggcagauacgguuucaccagucauacuggcaagguucuauaaaaugguaauucccaguaccagcaauauuuugggaaaacagacaccaacguauacugguagaauguugguuuuaccuucuggagggggacgaguagauaaaaucuacugaaaauccuuuaagaaaaugcaaaaccaaguaaugccauuucucuuuuuauccuaaugauauaaaauaggagcagaaacuacaauuaagcuacaggaaauuuuauccuagcauuuuauaauauauuuuuuuuaaaaaaacuugaauacaacucaacagccaucagguagcacaguagcuagaggccuguucuuuguauucaaaaagcccggguuggccuugaaccacugccauuuaccagcugaauuaucauggacaaguuauugaggauaaaauucggcuaacaauagaaccuaugucauaccauuguuguaaagauuaauggacuaauacaagugcuuugugcaaaaccuauuuuacauggugaaagcacauaauagaugcugcgucuauuguugcugcuuaaagauaggccagcaugggauggaucggcaugaaaguuacuaacaaugaugaugcagaagaugcccucguggcaugggagaggaagaugucuuaagugcaggagcugaucacaaagaauggugacuuuucuuuuuuuuauuuuugagacagagucuugcccugucacccaggcuggaguacaaugccgcgauccaggcucacugcaauuucugccucuggguucaaacaauucuccugccucagccuccugaguagcugggauuacaggcacccgccaucaugcccagcuaauuuuuuguaucuuuaguggagauggaguuucaccaugcuggccagguuggucucgaauuccugaccucaugaucugucccccucggccucccaaagugcugggauuacaggcgugagucaccaugccuaaccaaaaaauggugacuuuuuuaaguguguguguacguauguguguaagggauccagcacuuucugauucuuuuggguaguggacuuaaguuugaguuacccucuucugucaucucuucuguuuauuaaaacaugaaccaauuuucuaaauagaaacaaauauguaugugauuuucaaugucauuuuuaaaaaucaguguaacaggcauugaggaggaacacagggaugcacaaaucugagagaggccagcagcagccugcaucggcccuggccaagcaggucuuccuaggaccuccaagcacacggcucaaccacaaacugugagcgucaaugauacccuccaucggugaggggcuaauuugugcguacagugaggacaggcccggcucaagcgcaaacugagaguaucgacgauaccccuccgcgggugcggagcugaucugugugcaccaugagacaggccuagaguauggccacagcccacaccaguugcagcuuucucugcuuccucucaguuuuucaagaccugagcuacuaaaauaugagagagcccuggaagcaccugcacggggagggagguuguuaaaaucaaaugaccaggccccacugugcaguuucuaauucagaaggucuggggaggaagccaaaguuuggcuuucucuaacaaguucccaagggcuaccggagcugccauuuuggggcccgcucuuggagaagcaugugccaaggagaggacucuacagcgcgccaggugggcagacaccgcccgugagccuguguguuucuccuuuucucauguaggaccugcuaagcuuaugaccagcacuguuggugcccugggagcagaaaauaaauguuucccugcaggacacuaaauccuagggaacaucagauucacaaugauucgugggggacagcgccucccagagagccccucgcccuucaauuccagggcacgagugaccuaugguagacauaaaguacaggaaggauaaucauuuuuuauuccguuucaccgcucaguggacagauggcccuuuacuaauauuuaggagggcuucauuggccgguaaaaaauggugucuucacccacagguaguuuauugugucaaaucaaaaccaaaacaaaaaguaguugaggacugugcuauugaaugucugggguuuaaacgacugugcaucccuggggugggagcgguggcgcacgucgguaauuccagugcuuugaaggcagaggcgggaggggugcuugaggccaggaguuugaagcugcagugagcuaugaucgcgccacugcacuacagccugggcaacagagugagaccccuaucucuuaaaaaauaaauuaaaaaggcuguguaucccauuugcucacaauggcacuuucagaaugcagugauaccaacagauuaggaaacaaacagcacaccuggccacugagaggcggcaaguuagggagagaaaaggaaggauuugguguccaaucucacuccuuggucugaaagcccagugaccagcuuucucaaaguuuguuugugggguuuucuaaaaauuauuuucuuaguaacuucugagucuucugcuugaggcucagggccccucccaaagaggaguugccucuauuacagaagcagaagccggcgcaggaauauuaaagcuccuaugucaggauuuuuaggugcugaaaacaagagcaaaaccaacaaccacauacugaaauucaaaccucaaaguaugcaaaaugccaaauggacauuauauaccaauuagacuguaaacaaucuucuuaaaaaauguugucauaguugacuggugauaccuuuuccacauaaugucaugauuaucaaagagucacagacaccaccagcaacacauguuccagaaugauccagggcacugacauauggagacaugaggcagaacccugagcaucccauaaacuaagcacacugagaaggaggucacacacggcacgugacaagcauucgccugggcugcauacuuaccugagcucuuugggaucaaacaccaauuucacaucguugacgaucguugguaaguauuucagugcugcccccugcaaaucaagaaacaagaaggcugagcagcaugcagguuagggaguguucauaccaauuuguaauccuuaugagaagaaccgcagaaauacugagaagagaaagaucacuuccagaugaggggcugacggcuaacacgaugaaaauagagcaaagaacaaaagucaucaggcgcaguggcucacaccuguaaucccagcacuuugggaggcugaggcaggcagaucgcuucagcucaggaguucgagaccagccuggguaacauggcgaaauuccaccuuuacaaaaauauacaaaaaaaauuagccaggcauugguggcuugcaccuguagucccagcuauucaggaggcugaggcaggagaaucaccugagcccaggaaguagagguugcagugagccguguucacagcauggcaauccagccccggcaacaaagcaagauccugucucaaaaaagaaaaugaaucucuaaccuacaaagaaugcucaaacaaugcuaacuucucacagguuguccugacacauaauaaaauuauuauuaacagaagccaacacuuaucaccuguggccuaagugccuauacugugugcuaagcaugcaugugauuuucuccuuuuaccccugcagagcucugugaggauaaagcaaaaugaagaccugucccccucagaauaauccucuuccauuaaauucacuucaacucuucuacauucaaugauuaaagucaacugucuuuguuccauuccaaaaauguuuuccuguauaucugcauauauuuuaauuaugaaucauuuuguucuuuaguaauguaucuucuagaaaacaaacacccucaaaaaacagaguaaugauauuaaugauagauccugucaugcugcacacugugcuaggacccuuguauauuugaucuuuaauucuuacagaccuccuguauuaguccauuuucauccuacuaugaagaaauaccugagacuggguaauuuauaaaggaaagagguuuaaugggcucacaguuccacauggcugggaaggccucauaaucaugguggaaggugaaggaggagcaaaagcacaucuuacauggcagcaggcaacaaaguuugugcaagggaauugcgccuuauaaaaccaucagaucucaggaggcuuauucaccaucaugagaacggcacaggaaaaaccugcugcucaugauucaauuaccucccacagguccccucccacagcacauggggauuaucagagcuacaauucaagaugagauuuggguggggacacagccaaaccauaucaccuccuauuagaagguagcugaguaggaaggaggaaaaaaccaacaauggagacauuaauuacuuugucccuguucacaaagcuaguacugaacuaagcuagaauuaaauucagucgggggaaagucagacccugagucccuuugcucucuucuguugggaaaaguugccagauuuuaagugaucugacucuggcucugccaccuucuaccugugucuuuaaguaagagggaaaauaacauucacgccagauacuucaaggaauugcaauaaagcucaaaaucaaauuggaaaaugaauaggguaacacuuugaacacuggaaaauacuacgcaauuacagaaacaauuuuuacaauuguucuccaaaagcaaguaggcagaaacucacuucaaaaguauuccccugaacauauacagacgguugauggauuuguaacaaagguacacaguaccaugagcaaauaaauaaacuucaugcccuccucucucacacuguacaaaacucaacuuuaaauagaucaccgaucuuaaauguagaacuucaaaaacuguaaaacuuuuggaagaaaauacgugugaguuugggcuaagcaaagauuucuuagauaugauacaaauagcacaauguguaaaagaaaaaauugauaaauuggacuucaucaaaauaaagaauuucugcucuuugaaagguacuacugagauaacagaagaugaacuacacagggagaaaaugacuggagaucauauaucugcuaaagauuaguacacagaauacacaaagaacccuuaaaacucaauaaugagaaaacaaucuuccccucccugcaaaaugggcaaaagagaugaagaggcaauucuccauagaagauagauggauggcaaauaaguacuugaaaagacacucagcaccauuacucaucagggaaaugcaaauuaaaaugacaauaagauacaagcaacaucuauaagaaucaugaaaacaaaacagaauuccuacaacaugcucuuuguauaacacugcuagucugaaugcaaaaauaguucagcaacuuuagaagagaguucagcaguuucucauagguaaacauucauaauccguagcacccagccauuguacuccuggccaccuccucaaaugaagugaaaaccuacauucacaaaaacugaaggcauccucauaagguuaacaagaacucuggacagcaauacagugauaauuaagcacggaacaggcugcacuucagcccacuuacucguaauccaaagucacgcagcacuagauacuggucaucugcauccccaacguuccugcagauaggauuucugacauuagaaucauaagucuuuuguuuaagaauugcuuaagguguuucucagauccugaauuccagggaaacugcugcugccaacugguuugaaaacccccgacagaggaaaggaaucagcaaugcaaugcaguuucuucaucucccugucccuucaccccacgcucuucaacccacuuaggccugcuccgaaaaccuuaacaauaccuagccccaaacuccugcagcagacaauaugagguuuccuccuucuccuguuuuggcgguccuacgauuaaaacucuuucucugcugcaacccagagucgcagcacauugacuuggcacguacaugggacaggaaaccuaugacgguuacaaaacccuuauguggacgucucuagcagcuuuauuuguaaucuccaaacacuagaaacaacccaaaugucccuucaagaggggaauucauacaauggaacucgacgcaguaacaagaagcaccaaccacuguuaccuagaacacagaugcacgugaacgacacagugauaaauaaaacaagacauaugcaagaggcugcaucccaugugacucaauuuucauaacauucuggaaaaggcaaaacuacagaaauggagagcaugucaguggcugguggggaagcgggcaggggaauacagggggcucaggggcccucccgugggaugaaugcauuaugccuuugucaaaacuggcagagcuguacauuaaaaaagaauaaauuuuacuguauguaaauuguaccuuuuuuuuugagacugaguuucacucuuccgccugggcuggagugcaguggcacaaucuuggcucacuacaacuuccaccccccggguucacgugauucuucugccucagucuccugaauagcugggaguacaggugcccgccaccacacccggcuaauuuuuguauuuuuaguagagacgagguuucgccauguuggccaggcuggucaacacccaaaccaaacuccugaccucaagugauccacccaccucggccucccaaagugcugggauuacaggugugagccacuguguccagccuauaccuuaauuuuuuaagugacuaagaauauauuaccugggaauauuuccauagcuaucugggaugggaaaugacugaaagaauggcaggcuggugucucaacucuggugcacaggucaagucauuucaagugaguucauguugccucaucuaugacguaaguauucugcaccugucagacaaguuucuaggugcugggcucuauggacacauuacauccccauggcaaccugaugaaggaggccuauuacuauccccuuucacggaggagacaguggagacaugugaaagugaagucuuuggcccaggucagcacugcugggauuugggguuggucugugcagccccaaagcuaauuuugcaaaaccgccacacuucaacuucaccaaaaauagaguagaggauaaagcaacuuuagccccauaaaucuccacuccagaacgauccaugcuguuguucaccucaguguuugcccuguccuucaaggcccaccagaucccaaccgucugcuuugggaugcaacuuuucaaaagagcacuaaaucguaauaauuucauucugauuucaaauguucugcuuccacaaccucaguguugcuuugaaaaaaaacagaaaacauuuauugugacauuuaauagccagcguucacacaggcugauugcucagucucccggucucucguuucgcuugcgaacgcccagagggugaggcacgaacuggcuucaugcauuuuauacugugcccagcaaagcaucaaccgccuguagcaaguucauaaauaccauuucaccagggugaaucggccacaaacaagacaggccuuuauggcccaccugcugcuggcuccccuugggcugccggacacugugugaaucgggaccgacagaccgccaagcggggcgagggcucccaaagucuucccugccguggucuucccgagcuccuagcaucaaaaaugucaugaugacacccucagagaagggguugugcccccugaggcggggacauggaaugccagugaucccaaaaugcugauuaaaccagaauucugcuuaaccgaccaagaugauuuugugucuuucgguaaaugagguuuagcaagaacugggaggaacccgcaucugcuaucaguccugggugacagaacaaagacaggacagagagaacggaauucagaagaaacaugaggagaggcacgucuuacacuguggguccaccuguucuccugaagggccggguuuccucuccuucuccacucuccccuguggcugacucagucuuucuuugcucuucucaagccugacccccaccccucccaucucaugucaccaccuccuucagagaaaaacaaaagccaccacaagaaaggaacucgcuaagcuuccaaccacccaaaccaaacacaagacuccagcucccaaccucugccccugccuuggguuuucggggcaccugccugcccuguggggcuccaaccucuuccccugcugucugcucaaggcccuccugcccuuuguccucucucucuccucagagccuucaguucucaccccucugccuccugcuuucuaucaugaagcccacaccagccucucacccggaaaagcagccccaggcccugcgagccucugcuccaucggacaauaccccacagugugggcaaggccugcguccacuucccacacgaccccuccucacucccacugcagccugacuccggcccgcaccacagcucuguuccugccaaggccacgaugacuucaggcuguucucaaguggccuuucugaugacacuuuggccaccucaccucuggggcacgcguggcccucacucccaggguggccaccugccucuccacccuccuuccagcucccugcgcagggcccugcucccccagccccuugccuguggguuccucggggucccuccacauaucccacaagggaccucaccuccugccaugccaaugacucccaauucugauccaucuccagggcuccccuuccuccugagcccaacacccacaccccacacccaccgggguccacccuggcugacccuagacauugcaaacucccccugccuugguggaagccaccgcugccucgccuucccuagggauuccagugccaggcgcugcaccgccaagccccagcugcaugccacaggccugggcaucacaccggguguucucucuuccucacagcccccuucuaggcagcgacagagcccucgguucaggcuguuaacuccccccggaacaaacagcaccugggccgcacggcuacugccucccauuggcuuugcugccacagccuccuacccgcccucccugccuccacgcugaccccucaaggacacuccucacugggcagccagagcagccuucugaaaaugcaaauggaauuuagauacuguggcaacguccccugcucaugggacacagggaaccuaucccacacccauggagggccaugggcucuggccccaccaccccagacucacccuugguaccugcaggacucucucccaccaagccgagccucuuccaguuucccaggugggccaggccccucugccagcucagaggcuugagcacaugcuauucccucuucuggagucacugcucugccgccccacccaaguccaccccaaacacacaguuagacucugguaccccucaguccuuagcuuagacaucauuucguccaggacacacaggugccagguuaggaaucagauaugguuuggauguguguccucuccaucucucaugcugaaacgugauccccaguguuggagguggggacagugggaggugucugggucauaggggaggguuucagaugaauggcuugauaccuuccucgcaguaaccagugaguucccgcucuauuaguucacgugagagcuggcgguuuaagacaauggcaccucccugcgcucucucuuguucccucucuugccaugugacacgccugcucccccuucaccuucugucaugagcagaagcuucuggaagcccucaccagaagcagaugacugcacuaugcuuccugugcacccugcagaaccggggccaaaauaaaccucuuuucucuauaaguuacccaggcuuggguauccuuuauagcaacgcaaaagagaugaauacagcaucuagagacauuccuauuuggacugcaauggaaggucaauuuguccguauuccccauagacaauaagcuccucacagguaaggacagagacuauuucagucugcuuugucuccuucuguccucacagaggacauugggaagucgacccuccaugacucccaaacugacugcaaacuucauauauagucgugaccucuuuauuuucaagaagcauuccucucucugcauucagccacagaaaucaccuccuuaacuaagggaaaaaguugucuuccccauccaguuugauuagccagacaaggacaagaugcaaagggaacucagauuccuuccuaccacaggcucuggcuuuccuuggcaggaggguuccauuacccacuauuguaagagccacaccuagcuugauucauuucuaauauugguuauuugucagaguuucaaguguuuuggauucugcuugugcuugcaggaaaaaccuucaguuuccucuguggagucuggcugcuucacuaaauucaggucucuuucgaguggaaacagcuccugccucaauagcuugucaagacacagagcacccaacagacgaagcaggggacaucugcccuguggauagauggugcugcguggaaucuuaucugccgaaagacaccuccaaaaauaaaaaucuaugaaugcaugugggggacccuaaccagcaccaucaaaggaaggcagcaccaugguagacaaggucagggcucuggggugcuguccgggcuccuccaucacucgcuaugugaauuugggaagguagcauuuccuaucgggcuucucaugggcaaaacaguggugaucaacagggccugccucaaggggcugugggagaauggaaugacguguugugcaugugauaagcucgacucauugcuccugcucaacagacguuggccacagcuaccagcagcaguggcggcaggacagcguguggacccaugcacguguugacauggaaaaccuccucagcgugcacaucucucaaaccugaaucuucauucggugcaaacuuccauuuguaaagugccaucuucauuguggcaaauacugaguagaaucaguucccaaaucacaaaaaagaucagggugauagaaauugaggacauugaagauuuuuccuguuuuuguuugccuuuuguuauuuuuguaaaucagugaagaucuuuauuuaaauaaaacugugcucagaaugugcaaagcuguuuugaauugugggugagaggccaggaugccagucccucagcagguaucugcuccacggugccucccaggcacuggcaagguucccugcagcagagcgggauaaucacuaaucaguucacugggggugagggacgaaagugggaaggaggacaaaguccgugggauguccccaaaagacagagcugaguuuggagugaggcccacuuaugcuccccaaccccagagguaugaaccauggaccaugaaacuguacgaauacaccauuauggccuggcccagccaagaacagagaagaguacucuauacacaauuuagaggaagucacugauuuuagcuuucuuuacucuucgccuguucauuaaguuauaagugaacuuaccaaauaaauguuugcuauuuaagcaaguaauuucuucagauuuuauuuuaaacuuagguaaaauaacuuaauggcaguuuaaguccuggcuuauguuauucuaucaacuugguaaagcuuucgucuguccaccaguggggggacggucugauucuaccugcauuuaguccucggaccaaucaacacgugugcaggacccacugacacaccaagaacacauaccugggucccaugcacacucaggcaugagagaggccuaaggagaaacugaaauuaccaccaaaugcauaagggcucccaaccauucauugagcacugauggaaagccagcaagccacagaaagauaacacaaacaaaaucagagagaaucacagccagugguaaaacuauuucuauuuauauuaagacaggcaggcugcugagugucccucuuaagauuugguucaccucuuaauauccaggcaaucaggaacucaucguauucagcaaucacaacucuugggagggaaacugaggucaaaacugaaccaaaaggacaagaacacacugaaaccaaagcuuuagagggaaaagaagaaacaggaaagggcagaagaggcuaaaaguuuucuaauugcugaaauacuucagguuaaagaaauaaaauaauuuuuuuuuucuccuuucugagauagagucucacucuguugcccaggcuggaguguaaugguguaaucuuggcucacugcaaccuccaccucccagguucaagcaauucuccugucucagccuccugaguagcuagaauuacaggugugugccaccaugcccagcuaauuuuuguauuuuuaguagagacgggguuucaccauguuggccaggcugguguugaacuccugaccucgugauccaccugucuuggccucccaaagugcugagauuacaggggugagccaccaugcccggcccagaaauaaauuuuauacucgucucuaagcaaauguaauugucccagaucucaugagaaugccaacuuaauccaaacugaaaaauaaaacaauaaaugcacuuuccaucuaguaucagcuuaagguuguaagugucucucuggcuaaaaauauuacugaugaugaugauuaauagaugcuauuuuagaauaaaguucaggcuacauuauucaguauaauuauuuuaauuaaauccauuagcauaucuuuauauaagauuagaagaguuaugggugauacaaaauaaguuuuucuugaauaauguaugaagcaauuauuaauuuacauauuucucaagaaaacgcacauuaaaaugauuccacuuggagguuuugagcuaaaauauauaugguccacaaauccuccuuuuagacuuaaguguucugucuuuggaagauuuggggaagagccaaacagccuccggaaaaacagauaaacuugauaggggaaaaugcaccaagaccaguucugccaauuggugccccucgacccacucugcggacuugaucaaacaggacagauggcuggacgugauggucggaggcggcugaagaaaggaaauccacagcacuuugaagacacucaaggaggcaucucuauggugugugugacagcaguccagaacaaaaagaaagacgauggcaacaauugcuucaaucccuuauaucuuauuaaauuaggacugccuacaucuuauguauuuuaaauccaaaaauacuuuuuguaaucaauucucuuuguaaucagcuuccuuaaagcugauucugguuuuucagauagcauuccccaucucuaccaccaaugcuucgguucacucaaucccaaaugucaauuuaacgccugagggacguuguucccacaaguaucugcguguuucuguaucacaaagcccaaacugaaaaaaguacaaacuuccugagauucuucagugaauccaguucaaguuccuacacaaaucaauuuguuaugccuuccuugaagcauaucgaugaugaggaacgggucuccuggguuucucagggagagggauauugauacugucuucacugugcaggacugcucucagcaucucuggauccuguccauuaauugcucacacacacacacacacacacacacacacagcuuccuggcccacgugguugugucacagaugggugccuggcacacaaaauuccucggccuuugggucagcccagcaagagcugggccauggcuccucucuggccacagguagcugugccaugcagcaaugaccguuuucucugccuucagccuuggcuaaguaaauccccugcacuucucucccauaucccuucucuaacaguagucagaaucacuguucaaaugagcaaccgaagccugcaccugacucauccuuauuuccccaaagcuaggcacacaggagaacagaagaaaauguggucaaggauggaauaaucuauaaaagaacaggaagggucagaguagaagccaccaggacucagggcaucaggauagggcuacagugaugccuugcagaugacuagcuaggcagcagaaaccacguagcaaaaagcacgaggcgugaaaaagagaaagacuuagccaaccucagcacagacagcaagaacacccucuucugcucucugcucuggagccagggugcucuccuuaaccucccacaauccacuugccaggaauuaagucauucuaaauaggagcauuaccguaaucuaggcaagaacaaauuugaauuaaauuacugaaguauucuuuuuguuuuuucacuugauaccagcacagucaucuagcuaaaguggcucauggagagggcagagagccuuggaagaggccuccauagcccccaaauuggugaaaacuggucaccugucuagacagcuuccaggaggcaaagcgugacuuccaaaugauggagacuuucugaaaaacacuuaaaauucagaagucgacagacaggaaaacgguccaguuccacaguaucuuaagggucugaacugcaggaaaauaguuuugcaaacagugaguggggaaugaagcacaucacacuuguguuuuauucauggucugaauaaucugacaaaauggagcccuucgggaacagaaguggguagaagauaagugugugcaggacagcagaggaagaaagaugcaggaacgaggcaaaauggcgcagaauauucugccuguccagcgugcacccguccacccucaaccacccuccagcugccucgcugucccaggcucuagcccacccuaccaauacucagacucacugccaucgaggauggccaggguacacagacacucacagguagagggagcaggacaggggaagggaaggcuuugggguagagcaaaaagugaaugcagaguggagcucaagccccuggcuccccacccgcaggcauaccccuuccacucccauaugcagugcauggaauugugacccugccaaaaaaauuucaagaccuaaccuguguaauaucauuuaaauaucuguccccuccaaaauucaaguugaaauuuaaucgacauugacauuguaacaguuauuaagaugugggauuuuuuguuuguuuuucuguuuuugagacagguucucacuccgucgcccaggcuggagugcugcggaaugaucacaacucacugcagccucuaccuccuggggacaagugauacucccaccucagccucccauguagcugggacuacaggcaggcaaagagguaggaacuuuaggaauaaugugauuaggccaugaggacucagccacauagggaggacugggucauuguaaaagggagaguuuggcacccucucauccucucucacacucucaccuucugccaugggaugaccaggcaagaaggcccuuaaugcuagcaccuugaccuuggacuugccagccuccagaacugcaagccaguaaacugcuguucauuauaaauuacucagguauuuuaccgagucucagguauuuuguuauagcagcacaaaauggacuaggacauucuggugccugugaauacaaaugaacuuagaaacagaaucuuugcagauaaacuccaauuagaauuacagugggcccuaaauccaaugaugacuaucuuuauaagaaaaaaaaaaaggccaugggugcgauggcucacaccuguaaucccagcacuuuggaaggcugaggcaggaggaucgcuugagcucaggaguucaagaccagccaaggcaacauagcgaaacccagucucuaccaaaaauacaaaauauuaggugggcgcaauggcacgcgucugugaucccagcuacuugggaggcugagguaggacgauuacuugacccuggaagguggagguuugcaguaagcugagaucaugccacugcacuccagccuggaugccuguggucccagcuacucgggaggcugagguaggaggauuacuugagccuggaagguggaaguugcagugagccgagaucacgccacugcacuuuagccgggaugacagagcgagacccugucuccaaaaaaaaaaaaaaaaaaaagaagaaagaaagaaagaaagaaaagaaagaaagaaagaaagaaaaaggagagggagauucagaugcaaagcugcacacaccacaggaaggcagaggcagacacgagcaugauguagccacaaaccacagcacaucgaggacugccagcagcccuggacgcuggaagagaccaggaaggauucugcccuacagccuucuagagccuucagagagggcacggcccuggugaugccuugcucuuggacuucuggccuccagaacaaugagagaacacacugauguuguuugaagccccucguuuguauugugacagcagcccugagggacgaauacaucaccccaccccaugagacacuuaaagcaaggauucucccaugaccuggggaaagacuaggauuuccuuccauuuucauucuguuucugaccaauaccuuuguaaauuguaauaaaaaugaaugucugccgggcgcgguggcucacgccuguaaucccagcaccuugggagacugaggcaggcggaucacuugaagucaggaguucaagacuagccuggcaacauggugaaacccugucucuauuaaaaauacaaaaaaauuauccaggcguggugguggguaccaagucccagcuacuugggaggcugagguaggagaacugcucgauccucagucucaaaaaaaaaagaaugccuagaaaaccaaaaagccacuuggaugacagagcagcaugggaugucaagguuccucaacuuuuccucccagugucuguccucuucucgccauggagaagcaaucggacccauguguggcacaacccucacucuccugcccugaguggcacagagggcggccagugccaggcccguggugggcacacagggaggcuggggcccuguggcgggagcgaugccuugcugagcgaugacagagccaggacuacaaugacaccuuuccaggaucaaauccugaccucuccuccccgauccagcucauccuccucugugcacugggcaccuucucagcucccagcacuacugcuauggccacuccugugucuacgguccagccagaccugaccagcagaacuuuccgcagugaugggacuauucuacagcagcucuggccaguacagucaccacugggcacagguguccaucaggcacuugaaauacagguagggugacugagaaauggaacauuuagcuguauuuuauuugaauuucaauagggcaguacaaaucuagacgauauacuauggcagcaucccuaagucugcucuuuuuauccugaaauucaucccggcccucagguuccccgguaccaacuugucaugcuuucucccagaggauguacccuguaagcaugaaugggcccccacagggcaggggucuauagagcaugcagucggugcacaggagcuucccugagaacagggucuguguguuuuuggucacucugagacucuucaccauccuaggucuuacgacuuagucagcugauuuugcuuucuucaauuacgaaugcugcauuuugacacgcucuucucugggaagggacacagauuuauggugauuucugaaaucucaagacggauuugcuguccugugauucugaccucaagcauuccccuucucccucccucuaaacaacgcucucuccugcucaggagcaaacacagcaugagcuuugauuccuuggaccuugauccccagugaagaucucagagaucugaaaacgugaaagauagcaccuguguucaaccuacagcuaaaggcacaauucaaaaaggaaagagggaaagcgauccagaccaaccuucacaacucacugaaguaaugcaggagagguccauguagauagagcaauaaaacgaauauccuuucuucagucaacucaacagaaacagacccagcaguuucacuccucgauguauacccaaaagaauuaaaaauagacguucaggcugggcgcaguggcucacgccuguaaucccagcacuuugggaggccaagucgggcggaucgcgaggucaggagaucgagaccauccuggcuaacauggugaaaccccgucucuacuaaaaaugcaaaaaaaauuagccaggugcgguggcgggcaccuguagucccagcuacucgggaggcugaggcaggagaauggugugaacccaggaggcagagcuugcagugagccgagaucacacuacugcacuccagccugggcaacagaaugagacuccgucucaaaaaaaaaaaaaaaaccaaauagacguucaaacagaagccuguacaggaaugcucauagcagcucuauacgcuacagccaaaaggugaaguaagccaggugugcauccagagauaaauggauaaacaccuguggucuguccauacaauggaauacuaccgagccaugaacaguaauggggugccaacacauggaugaacccugagaauauacuaaguaaaagaagccauauaccaaaaaaagccacauauucuauagugccauuuauaugaaauacgcagaagaagcuaaucguagagacagaaaacaaauucgugguugccaggcagugugaagggggaaacagagugacuguaacggcugugggguuuccuucuggggugacggaaaugaucuagaacuaccuaguggugauguacuguaaauguaccccaugccacugaauuguucguguuaagaugguuaaaaggauuaacuuuauguuauauguauuuuaccgcaauuaagaaauaaauuauuaacaggaaaaaaaaaaagucccauucuccacuggaaaaugacacuucuuggaauagucaccgggugaccuuugcauacugauagcaagucaccgucugucacucacacugcagcagaccaugugacugauccacacaauggucuccagcggcgaccgacaaacaccugggaaccaugauggagccucagucuauguuaacacggcccugaaauuagucaccuucuuaaugaguuccggugccacugccugguacccaggaacagccaugucuugccaaaugcaagccacuaucagugccagugccuucauuaagcaagguuuaauagaaccugcccaggaaaaaaaaucccaggaagccagaaaggagaagcaucccagugucccgaacagcaaucacuguccagaacugccgcccacaccucccaccccuuaaacaagcuccugcugcuucucuacaguugcuuuucaacaauccuucagcugugucucaacaaacauuuuacaucaugugauuuaaacaugaacauccaaacuaauaaauguuuuaaaaauguggucagauauguaggacagggaauuuuuauaaaugccaccaaaaaagagaaagaaaaguuuacaguuauggaacuaaaaguauugccacaagucagacaaucuuuucuccuccaaaggaaaagcuaguuggggaagacuaaauggcacgguguccacacgccagcacugggcagcaucucuccuggagacaagagcauccaccacccaggacucgagggcucacuccaucuccacgcccugcccagggccucauucaaacaucauccauggccuggaaaggcagagccagccugaagccuggacuuggccaggggcagugggcaggggcagcccccucuccugggggagggaggcucuuuccuauuaucuuaggugugggggucagaauccuccguuuuccugagguccccaggagaaggaagcaguaagucacugagaguggagauugaggcuggagugaacagcagaauggaaggaaacaaagugggugcacaggagaagccaaggaaaaaaagaaggaaggggcuagguggaggaggcgcaagaggcccgagggguagggggucugaauccagaugugggggccuccagggaguggccaugggaaagagcaucaagaaacacacagagaacaggggcaagaagcaaaguccacaggagagaccaaaagaggcugaccagagacagaagacaagaaggccaacaggagcagagcugagucacgggagggguccagggacaaggcacuccaucaagggcagugcgggccaccguguccagggcuccauguguaugggcagggaaaaggauggcagagccgaggugacacaggggagccgccuagcuuccucaggagucuggagguuaggugcugguggcugcggcauggcugcgggugaagucuguggggagugaccgagcuauggauggucuuggguguuagggagagaggguuccagaccccuggugcacuaaguagggaggcugggggcauuucucugcagcgguggggccguaucaccaggaagccccuuagacucugaggggugcugaacuccucuggauauaaccuuccaaauacagggcuuucccuuucuuuuuaaucucaguuuugaccacugagggaggcgcagucauacaccaacuggcaaccaugggauucuaagucccuuucaggcugggugacucugaagugcaauacaauuaaacaugagaaucaugaaaaggucagcauaaaugcauuuaaauggaauccucccaaaacccggcuuccaguucauuuugaggggcaacauuaaaauaaauauaacauaccuuucacauucucuuucccacauaguuuaaacacauugugaguuacuuaaaaagcaccauaaucauuguuauuuucagagacaguaacagaaacaagagauuaauuucaauaaaagcaagaguucagagacauauauccaggacaaacgaaacaaacacaguugagguaucuaccaugcacauaaccacuaggcagcuggacagcuuuuaauaauuucuaaggguauaucuaacacaagcacgggaaugacaucucugcuuacaaucaagaaaaaaaugguguuuuguugcagaagaaugugccugcuuccaaaauugacugaaggcaagagaaaaugucacagaagacgacgguaaacaguacaauaauaagcgaaaaggacaaaagcaugcacauccaauuuauaaaagguuugguguuugaugauuucacagugugcccaaacauaugauaaagaaaaauaugaggcccuugguggcagcgaacugguuaucaaguuaaauaaaauuacauuuauaauugccaccaucagaagagaaaaccugcugccuuucacuacgcauuuguaaaagaugauuuagagcaaaucagagaaaacuuagcaauuaaauacgaacgcuggcaagaaaauaauuacauuuauuggaaaaugaauugagacgaucaucagagagaauuaaauaauucagcuguggagcuuguaaggucuagaauuugaucaauacaauuguguauaaaaauaaagcuaugacaaaggaaguccagggugagaguccccauguaauuccaagauguguauuuguagccaaaguuuccuuaucuauuuaaugaccaauuaauaccaaauuauuuugguucuacuucggguaaaugguccuaaaugaugccaauuccuaguucuacaaugcuacuuacauuucaucagaguaaccucaucaaggcuuggcuacuacccuaaacugcacagggacacuucagcaagagugggggauguuucuugagaauggggacuguggucuaacuuuaaggagucucccucgcccaccccagguuagccgcugacuguuuucuggaagugcccgcaggaccacaaucuacccuaaaggcuccggggaccaacacucuacccaauauucuccccaagauagguccacaaagcagcaccccucuacuccacuccccugccccuguuagcaucagcgucugagcccggcaugaauuucugugacucagucaaaacuagguucaaugucauaaaacagugagccaucuaacuggauucucuaaacaucacagaacuucucagcauccacuugagaagcugaugcucccucugcugcaugaaaaauuauaagcccaucuccugaaaacucacauuacuuugccaaguauaguuugaauucagcacacacauaucaugaagaaagucacucguuuagaaaaaugcccacuuagauauuuaauaaaccuggugcucuaagaacaagcugcagagugcuuuuccuuccaccagccugaccacauccccuggccuucuggaggcuuauguaguccaugaaccccucuucuaccaaucccgcucuauagaaaugcuuucugucccuaugagugaggugacucuggauuaaauaagaauugcauuacaaugagaaaaugucaaguuuuggccaccucaaguauuuacacuuuuauagauacagauaaaagccaagugccuacuaaaacacguuauuaauuuaauuaugcaugccuaucuaauauucauguauaggaauauuaaaguaguuucguccacucuccauuucauaaaacuauuuuacacuaacuuuuuacaugucccuuugacgugagugucuccaucaucaccaagacccauuuucgucaucauuuuacgucaaucugaagugcuuaagacacgggacuuuuuaagaaccacagaaaaauuuuucccaagccacaaucacccauuuaaauaauauuagcaguuuuuuuuaauuaacuguuauauacauauucaugaucuuucaugaucucugcaauguagccaauuauucuauuuuuaaagugacuuuuaaaagguuuauuuauaaugacauccaauaauuauguucaugccagcaagaaaaugccaaguucauguuaaauuucuuugcuucuuuuguauucauucugccagguaacuucuaaaaucaugccaaacuagcauggagguuucaagcaaauguguuuuugcauuucagauaaaaauguuauaaggacucaaagagaagguuacucagcuccuggggacuaauuuggggggaaaugugggaagucuacauaaguggguggucacauaaugaagacuaaguucccuuccugcaccggggguggggggaugggaggugggguuuccagggcugguuccuaagaccugcagagcaguuucauccaacagcagcacagaacaggacuguaaggggcggggggugugucucccucacugaaucccucuugcauccccgcaccgagucacgaacuccugaagagaugaggcucuaauaccuuuccagcaccucccauagcaucuggccuucaguuggugcuggaaaacauuuguugaaugaaagcaaguaugaauaaaaucaccaaaggcuuuaaaaaggcacaguacccagaaagaagucaugccucccaaaugccugugugcagccugcagugauccacaaugucccacaacuggacugugauacaauaagaaaaauggugaaaaauaauaauaauggcuucuauaauuuagaucuguucucuaugaagaacucaguucccuccugcucuaagaaggcaaagaguuccuuucuuuuucuuuuuuuuuagauggggucucacucuguugccaggcuggagugcaguggcgcaaucucggcucacugcaaccuccgccuccuggguucaagcaauucuccugccucagccgccccaguagcugagacuacaggcacccaccaccaugcccugguaauuucuguauuuucagcagagaugggguuucacuauguuagccaggauggucucaaucuccugaccucgugauccgccugccucggccucccaaagugcugggauuacaggcaugagccaccgcgcccggccaagaguuccuuucuuaaauaagaggacagagauaauaaacagcaguggguauuuguuguuuuaucccuaacugauggauaaugcaauucucuacugucucuuugccaugaugagaacauaaggucagcuguauauuacugccaccuguacccccugcccacugauagagcuccaugccuagaauauugccuggcacauaccagagggcucaaaaguaucugguggauauaauuuguuuaguuggcacugaugugguuuuuaauaucuacuaguucauaaaagccugcuuacuguuguacaaaaagaucgaggaagccacauaaugaagaaagcaaaaagauaaggauucuuaaccucccuuucuuccccuccaaauuccaggcccaaggcuucuccauuauuacagaggccaggaguugagaggaagaggugagaaucaagcuuugggaagacaaugggcuaaaacgcagagauucaaucagaggacaacgaacaagacaggaauaaaggcaagauuuccagucuuccaugccaacccaggcuaagguggucucaaugccacaguagcugcccugggcuccagaaacaucucccucccaucacccaagucuucaggagguaagaugccucagauuaacccccuuucacagagccagcucugcccaucaaccaauccccacccucuuccucacauuugcuggagucucugugccuugguggguggaggacagguggagugagagcagcaggagcaucccuaggguaagaccuacucugcauagaauauccugugaaguuugagcuccauucccucauguaaacccguuagaaagguauagcaaaguacauuuugugcagacauucacuuguguuguguuccacuugacaagugacauaggaaacaaucaaugguaucucagccuccuauucccaggcaggcaauugugccuuguuggacagaauacugcaucugaauggggcauuaccaguguugguauuuuccccugcagacuaccaaagaagcgcucagacacccugaggacagccacgaccccaguauugcucccaagcccauuuagggaaagggccuuuuucaacaugcuuagauugaaugagaaccgcuugcuggugagagagggucuuugaaccagaugucuuugcuuaacaaaaauaaggucagagauuacuauaacgugguaacuacagaacucuugaacacaagccugguaaagaacauacacacauuuaacuagaaauggcuuuaugcaugaucuuccuaauugcaauaugaaacaaucacucaccaaccaagaauuaacuaauuaugaaucauuagacaccugcaauuauaaacaggagauuaugggugaaggauuuaaggauaaaggagguaaaaaaauaacaauucuuuaaucaucaaauugcagaacaauauuaaauaaugggauuuagaaggauuuagacccauuacaaauauuaauuuuuuagggauaacaagagaugggaaauuauaaauauuuuuacauccagaaucucaucacuacauuuaugacaaguaucagcagcacaauaaugugaucagaagaugucaagcaauccuaacccuacguuaaagcaagguagagugguugccuguaauuuguuuucucuccugugccauaauauacuaagggggcagaaagauuacucaguucugaagcuuuaaauggcuucuuaaagauuuuaagcaaauuuuaauggguuuuucuuuuucuucccuguaucgcaggaauuuguugggaagauuaaaaaaucaccuuaggaaaaacagaaaacagaacucacuaaucaucuuccauuuagccuuuuauaugaguaaauggggaaaucauuuauaaucacauccauuauaaagaauucaaauuauuccacucuguuuuauuaucuaucaacaggaagcauacuuccucacuaugaaguucaguuagugaguuucuuagaugauuaacucauauuuuaauagccgaaggguuucucaaaucaaagcaguaggucaggagcaaaaacuaacaaagcaaaggguggggagaucgcuggcacccaagcacgcccucaaggcucaccagacaaugccccaccaaggagccaggacugcucguccagcuuggagggguccugggaagggagggcaccagguauuuuacaucuccucaaaugccacagcaggugcauuuucaaaauaacuuacugaucuccaguucacuuauucauuuguccagaaaguguuggaaccuguggcaugccaggcaaaauguucaauggccaagagcauugcccugcuagagaagacagaucugcaaaugacauuugccaacaugccuccucuauguguuuaaugaaaacaugguguccuuugcagaggacucugggaguccaauggcacagaggacaggccaccaggacaaaucugcagaaacaaauggccucugcaguggauauagaaggcugacugcugacaggcagauguccuggaagacaggaagagaacaggccuuccaaggagaaagaucccugcucacaaagacauggagacagcaaagcacagcauggccaggaaaaugagcagucguuuugugcuuggggcuguguacagagacaagaagggagccaagggagugugaggagggaaucgggcuccccagggcuagguguggggcacggggaaaggagacgaaggcccagggacagguucugucuccuuccccuccagccagacaguugcugucacucuugauccucccacauaagccucugcaacccugauaugguuugggcugucuccccacccaaauugcaucuuuaauuguagcucccaucauccccauguauugugggagggacucggugggagguaacugaaucauggggauggguuuuucccaugcuguucucaugacaguaugauagugaauaagucucaugugaucugacgguuuuauaaagggcaguucuccugcacacgcucucuugccugccgccauguaagacaugccuuggcuacuccuucaccuuccgccaugauugugaggccuccccagccauguggaacugugagucccuuaaauuaagccucuuuuucuuuauacaugacccagucuaaggugugucuuuauuggcagcgugagaauagacuaauacaaacccagacccgggcagacaccaauucucaggaccuggacagacugaguauggcuuaauauuucuacuuacauaagaaggagaagaugacugugagaaaggaaagcguuuguuuccugaguaaggaaaugguuccugccaggaaaaccucuucuuuguuacuacaauuaaccuuccccagccugaggcgccaacagucauucaugguaauagaaaauaggaacuaacaugacaaaauccuguaguuuagggauggaucagagaggaagucaaagaggaaaggaaagcagggcucauguucacccucuuugaggucagcugcuuucgcgugaagaaccaccacauguaugagcaucgccaggggccagcaaagggagaucacugggguggcgaaauguuccagcucuugauuacgguggugacgagaggacauuugggacauuuucaaaaugauccaaaaucagauacuucaaaugguucuauuuuuuuguucauauaaauuuuaccucaauaaaggugauuuuuuuagaaagaacucguaagggccacgauucuauuuguccacggcaagacagaagaaauaaagagacugccuguucugaaccaggacacaggcauuuuccccuagccuugaaaucaggccaggaaauccacagcaauugaagccaccauuacuggggaggaaacaacuaagguuauuugcuuaugacagggcagagacucaccaggaaagagaugaaagcggacagaggagugaagacagaaacacacaagaaacacacugacccuuuggguuggauuucauguaaggaggggacccaggggacacaccacauucucaaacuugagaacaacagaagcauuaaacguaugaaaggucauugucuacuccuaaaggcaggaagucucaaacaggcaaaaaaaaaaaaagccccacauacaggguccacaaauuaauaggcaagaauuauuacauguccucugcagaggacucugggaguucaauggcacagaggacagaccaccaggacaaaccuguagaaacaaguggccucugcaccagguauggaauguuccaaaucagauacuucaaauggcugcauuugaaguaaaaccgccagcagucccuuccuccaagaaggugaacaucagcugauaacugcucaucuaagaaaaucguucuaucuucuaauaaaaggaaauaaaauggaugggucuuacagucucugaaaauaguauuuauuuugccaaaauacagcaccauggguucaggaacauuucaaauagagaugacauaauuaauucauagagaaagcaaaaccucauuuaacuaccuuggaaggucaagaagguugagagcaagaucacaccaggcucugaggagguuaagaaaacaauuaugagcuaacgacuacacacuggggggcggagaguacagaggcaaauugcaggguggcuaacucggcccucgcuuaugacaaauaaaagaccaaaggugucauuuuaaaauauuaaauuauugaacaggaaagucaaaauucaaacacaaaauaaauaaagcugauuuauaauagccuggcauucaagacaggcugagaggcagacucaggauccacugugauagauaauuuuaaguacccaggcaagguuuccuuccuccuccuagagccuguucagcucugcacgaugucaugagccaggugugccaggaaauacccaaaggaccacaaccacacuaccccaacagcuccaggcgacgugacauuuucugcuugcaauacaaugugacugcagugaagcaaaccucaggagggcuggauauuaaauaguaauuacaauacaaaagcaaauaucaaucaaacccugggguacaggagggggucggcuaugggaggggacaggucagugaaaagucugaagaaugauaaauuuccaaaagaugaaaugcuacucauuuucaaaggaaauuuuucaaaggaaauuaucaacccagcuuagcaugauauuggcaagaacucagaaugucucauccagagggagacuuggaguccaucaguucuaaacuccuugguggagaucugguggaaaugagaguuaagaaggacucauacauacugugguaccugaaaagacuuaauucuccuaggaaguaugagcaugccaucaaugacuuaauccuguuuauauuuuugcauuccucucgcaaagccucauuuuccuagcuguaagaggugaauggcagcccaaccacuaugcuaauuaccccaaauuaugaauaaggaggauauaaaugagaccuugcuccacugaauuuaacacagucaaaaaaaaaugagcuagggaaaagauuuauuuauuuauuuuuuauugggacagaguuucauucuugucgcccaggcuggagugcaguggcgcaauguuggcucacugcaaccuccgcuucccagcuucaagcaauucuccugccucagccucccgaguagcugggauuacaggcaugcaccuacacgcccagcuaauuuuuguauuuuuagaagagaaaggguuucaccacauuggucaggcugaucucgaacuccugaccucaggugauccgcccuccucggccucccaaagugcugggauuauaagcaugagccaccucacccugccaggaauagacuuuuacauaucacacaacuggugugcuaauucugagaaugauuaaaagacaaaggaacaacacuucuaaagacugacugccacaugacacacucaacagauuuuuuuauuagucugucucuaugcacacuuaaaagaaauuacuucccaaugcaagcaaaggugagcacuuugcccuuuucagccuaugcaagguuuuccuugauguucacugccuauuuuaaagagguaaccacuuuguuuggagagagagaaggauuccagagaggaaaugcagacagaauugcagaacagaguuuaaaucucuuccuuucuugauggaaacaagaaaauacugugggauagaaaguuucagucugaaggagucagaguugcugaggcaaaugggaucaagagguucagauuccagacgggaguauggaagaaauauacccaacaccaccgguaaaugcauccaauguucagagacuggugauggagauguucuuuaaucuggugcaaacaugccaguguggguuacaugagugucagcauuugucaaaccugauuaagcugcauacuucagauuugugccuuucaacaucuauaaauuuauccaucaauuuauaauucagcuguuuuauaaagggauuauuaaacaaacaaaaagcaagggauuaaauacuccaaauaaaagacauagguggucagauuggagaagacaaaaacaacagcaauauaccgcucccaacacgcugucuuuaaguaugagaacaaggaaaggcagacagaaaaaggaugaagaggagauuccauguuugguuuuccauuccugaguuacuucgcuuagaauaauggucuccaacuccauccagguugcuguaaaugcccuuaauucauuccuuuuuauggcuaaguaguacuccaucauguucuuuaucuacuuguugacugaugggcauuugggcugguuccacaauuuuuguaauugugaauugugcugcuguaaacaugcauguacaaguaucuuuuucauauaaugacuucuuuuccucuggguagauacccaggaaugggauugccggauccaaagaucaguaucuucuacaaauacauugcgcauacacagaaugucauguuaugacacucucgccucuucagcugauggaggcagccugaaugcagaggagguaccaaccccagaaucucccaggcagcugaguggaaaggagguaccagcccuagaaucucccaggcggcuuccugggaugcaagguugccccacacccccaaaggggcuccuuguaagagccacaaaacucugaaagcagacaugcaaguuuccaggaaagcuucugaauuuuucccaugacaaaaauaaaagaacuaauaaaaaaauucuauaagauaaaacuuuuaagaacucagguuauuuacauacuaagagaccccuggaaaaauaaugcccauuucuccuccuaugucuucucuggaagaucuuaaccuuuauuuaaaacauaaauaaaauaaauaaauaaauaagcccauaugucaauuuccagugugucagcucaggaucucuaauacugccucucauuagcacagcaccuccucguccaaauuccuuuucucggcucugaauaccagggguggaacgaggcugccugccuccacuccugccccugggcucccaagagaacaacccauccccaccaccuccuuccacuguccuucucccucccauccauacccuccugccccuccauggaaugcucccccaucucaacucacacccaccccucaaagcucagggcaguccaaccugcucugaggaggccuuaacuggugguuucagugcacuugccacuuucuuuagguccuugucuugccugcaaucucucgucuggacacccaaugaugcagugauguaccacacaaucugucaucuauuuggggggucgaauaccugguuuccucuccugcagucagaauccaacaucuuccacuguacauuccucauggcaucugcccaguacgaguccauaacuggcaccaaauaagcacuuaauaugcuauaaagucgaguaaucccacccacccaugccauccuugaauccaugugaaaagcgcacguauauuaaaacacuacccuuuccaauaacauccacaaagaggcccaugucuggagaagccaaccgacaugaagcagugcuggagaaguacuuagcacugcuuucuugguaagaacuuuuuuuauuuuuauuuugagacacagucucgcucugucaccuaggcuggagugcaguggugcaaucucggcugacugcaaccucugccuccuggguucaagugauucucccaccucggucuccugaguagccaggauuacaggagcccaccaccacgcccagcuaauuuuuguauauuuaguagauauggagcuucaccauguuggccagguuggucucaaacuccugaccucaagugauccacccaccucagccucccaaagugcugcgauuacaggcauaagccaccgcgcucggcccucguaguaagaacuuaauuaacaacaagcaagcugaccucagagaaauuuaaguuacccugacauuuucuuucaagaaucauccuccuugccauucgcacagggcauccaaccccuaaucaccacacucucaagggcuucuggcaccucccugccucuguucucaaaggccugcagacagcagugaaacuccaggcaagaaggcaggagcaaaaugccagaggugcuuaagaauuccugcaccccagggacaagcaggggcccccaacauggaaaugccaccaggaggaagaaggaaggcacaggcccugggguagaugacggagccccccugucagcccugggcagagauggggcugaggccaggccuggaauggagucuuggguuucaauggagcagcuccaccaaugaggugggaaggcaaggauuccagaggagcugagcagugaggagaaaucagggugcuggggugggggaugcagcugcauaugcugcaggaacccucaccacucccuggggcacacucugccuuucaccuugaauuccaagguccucaccaagguuuacgccacgacccguuuucugguucuugguauuuucuuuucuuuuuugagacagaaucuugcucugucauccaggcuggagugcaguggcgugaucuuggcucacugcaaccucuaccucccggguucaagcgauucuccugccucagucuccugauuagcagggacuacaggcgccagccaccacgccuagcuaauuuuuuguauuuuuaguagagacgggguuucaccguguuagccaggauggucuugaucuacugaccuugugauccgcccaccucggccucccaaagugccgggauuacaggcacgagccaccgugccuggccgauauuuucuuaauggaucuuugcugaucauuuuaguugagguuuuggugucacuugcugucaggaaguucucaauuuaucagcaacuccuuggaugcugauuugacucaaccuuugcaccccucuguguaagaaggacauauuaccugugcacauagcaagauguccacacacuggguggagaaacacagcacagaacagugcuggccacgaguguaucaucagcucacucaaaaacacacauaagacccacguaggaagagaaaguuuugugaaccaucauaaacuucucaaacacugguaaauaauaaaaguauaaagugcccuaaaauaacacacaggaaucuagcacucagccugggcaacauggagugauaugguuugguucuguguccccacccaaaucucaucucaaauuguaauccccacgugucgggugagcggcauggugggaagugacuaaaucacgggggcagaccucccccuugccguucucaugacagugaguucucaugagaucugaugguuuaaagugugugucacuucccccuccgcucucucuccugccgccaugugaagaagguccuugcuuccccuucgucuuccuccaugacuguaaguuuccugaggucuccuaaucaugcuuccguuaaaccuguggaacugugagucaaguaaaccucuuuucuuuauaaauuacccagucucagguaguucuuuauagcagugugaaaauagacuaauauaugacgaaaccauaucucuacaaaaauuacaaaaauuagccaucugugguggugcuggccuauagucccagcuacuuuggaagcugaggcggaagggucacuugagcccaggaggucaaggcuacagugagccaagauugcaccacugcacuacagccuaagugacagugagacucggucucaguacgucaaucaaaucaaucaaucaaucaaugaaagaaaaaccaugaaaaaacuugauggccaccuaauuucccagacauaacaacucuccuuuuuuuuuuuuuuuuuuuuuuuuuuuuuugagacagaguuucgcucuuguugcccaggcuggagugcaauggugcaaucucagcucaccacaaccuccaccuccuguguucaggcgauucuccugccucagccucccaaguagcugggacuacaggcaugcaccaccaagcccagcuaauuccguauuuuuaguagagacaggauuucuucauguuggucaguuggucaggcuagucucgaacucccaaccucaggugauccaccugccucagcaucccagagugcugggacuacaggugugagccaccgcacccggccaaacaccucuccuuuuaaucuucaauagggaucauauaaaauguuuaaugucagaauguguauuucuuggaauuauaugaaaauguccuuuucaaaaaucaacgagacuugugucacguuucaccuaaucaaaugaggacuacuguucuuucuuaaucauuucacuagauagaagacaauuugugauuuaaaaaauagugaugcuaagaauuacuaucuaaaggugacacaggcaagaagaaaaccuacuuuguuuuaauaagauacacuuuuuauagccccuuuuuucuucuaccucuuugcuaauucaauguaccauauugaauguauaggauuucccaagggaaaaauaauucuacuugaauuauaaaagugucacauucacaguucauggagaauaauacuguucagcuucuaaucaaaacuauauugccuggcacaggauucuaaauaaagccaguguaaugcacaaauuuaaaaucugacuugagugaugucaugaaaaaagcacugggcugaagaacagagaacuggggucuggucaucccaccuaggaccccucuguuccugggcaaguuccugaaaaaaacuaaagaugugacuuucuaaccuccuaauucccugauucuugauguugacuauuugggugcuugagaaauccaaacucauauaacuccaugauuucaucaauacauacacaaaaguaauuuauucuaucauaaaauucugcaaaaacaauuuuaaugaaauuuugcaaguauucaauauaacagagcuaaugauuuuuuaagcucacauaugaaauauuccuuuuucccucuugauaaugcuauagugguaguugacauguuucucaauaaaacguuuccugggacauauuuaaagucugcucuccucccaggccuugguuugggcuacuuggcaugcuggcagaacaccaauccuaaaugaagcuuuuaacuacccuuuccaucaccucagcagacagcuccaaagaauagcugcaaaacccauuucacaaagucgccaauuugcacuggcuucagcugcauuuacaaaugucccuucagccuuccugugaguccucucaucccucuuucuccauuuucugcauuaugaagcucuacuucuguuucaacuucacagucuuuuccuuucagggauagccuccugcuuaaaagaagguuaacgaugguucugucugaagauuaacauugccuuaaagagggagacggucacucuguguccucgaagacuauuagacaaaaaagaaaauugcaagccucuggcuacuggcagccacuuuucccucaaauggagagaaauaaauacuaagccaagaggaggauaccuucuaaauccuaaacucacucaugcuuaacacuuggacucccaaacuacaugaaucaauuaauuuccuucuuucuaaugugaauuggaguuggguuucuguaauuagacuacuggagcuuuccagcagacuugaagucgaguagugccaguccucugacuuuguucuccauaaauauuguguugauuauucugggucuuuugccuuuccacaugaacuucggaaucaguuggucaauagccacaaaaaaacuugcugggauuuugauugggacugcagugaaucuguagaucaaguugggaagaacugaauucuuaauguugagucaccuauaagcaugcaauaccuuuccuuugauuuagaucuuauuugagguuuaugcaauuugcaaucaaaauaggccucaaugcugcaaacuuaaaacuuaaaacauaaaaagaaucuacaaacaccuacggugaaugcauuuauaaaugccacaucguaagugaagugcagaugagcguuugcaggccuaguaucuucaguucacuugagaagaccuuguuuagacuggucuguucuaaaugcugguaucucuaggaagggguccuagggacaggugcauuugaagaagccagacaagagccaguggaugugggauauaaauguuuccaucaaugagucagcuauuaagacgcacagacuuugcaugaugauguucucugcccgucccuuuagaaagcuuucucauuauuuuuaacaaccaccauggcagugcugggaggauccuaagagauaacacgcaucaaagucuuuggugccugagaguacugcacgaacagaagggauuaggauuacuucaugcuccacaaccccucuggacaaaaguggcagcacaguucucuccaaaccauacgagagucuggguuuggcauuuuccucugcuguauuacauauccaagcaccucauggugacuaccuuuguaucagcaccuucuuugaaccccuaaacuacuuccaaugccccgauauaccuugucacccugaccuuuacuuuuucuuaaaaugagugacuacaauccacaaugauaauuuuaugucugugauuugcuuaaaaucacauauugcaacuaugcaacuauacacauaggggaugguuacugaguucacgccugccuugcucacuccaauggaaccaccaugagaauacagagcguaucugugugauuggugcuguaacuccucagugccuagcacagugccuggcacacaggagaaugaacauaugauugaaggaauuuuuuaaacaggugaauacauaacucaacaaugagguacuaagcauaacucugagaccugcucacuuucagagaaaugcugaauaaauccugaccaugauggaggaaggagaaaggggcucacuggcaccuugcauguuggcagcaggcagaauccaagaccgagggcacagaugugggaggagcaccuaacaagagagaucucugaacaagaucaggggugggagaagaaaauaaguucagguuccugagcacugaagccaccauggccaaaggagagauuuuccaccagugagcaucauuacuggggacaaggcaggagggauggcaagcaagugccuagaauucugcaaucucaaauuaaagcauuguccucuaacaaguggcaaugugaaggaaucaacauggaaaaauggaucauaaaauuaaagaaaacauaaacacacacuacuuaucaaugaaauaauuuguugcaggcuuaaaaugcuaaaagcaacacgguaguauucaacaauagaaaaauuaauuugaggaaaaaucauuugauuaagcaaaugauugcacaucaauucaggcacauguucugaacuggcauacagccauuacaauuacaacuacacauuaauaauggaaagguguugugauaaaaugauaaaaaaaucaguaaaccaaaaacuacgcagguugcaagcauaaacauuuugaugggcaugcacuagaauuggaagaaaaccaauagaaauacuugguuugcugaagaaacgguggaagagagaugauuuucauuucagcuacuguugcauuucugcaagguagugcuacugcugcauuucugcuacuguugcaaaguacugugcacaguauaaauguggguggagaggugcucaaggaaacaaguguauuuauccagaccucuccugauuaauucuugccuaugugagugguauuguucccuccagagcgggcaggaagaauccuaggaagcaaccaagaagacuggaaugcugcagcaccuggugaguucagaucucagccagacuacccaacccucugcagggccacagaccagcaagcaguauagugaaauggggagcauuuggacccacagguccucuaagagcaagccauaaaauauuuucuucacuucccucguuccuucuucugcugagucuuucuuaacaugacacacuugcaagugugucaucaucuguguguagggcaaacuuaucaaaucaaaauaguccagaacgucagacagcugagggcaggcagccugaaugaagccagccuugaaggcugcaagaacugagaccaggugcccuacccacaaacacuacugcucacacagcagcugucugugcaaggcgaggcguggccacuucugacucaauauauggccagggacccacaaccuuagcaucagcugggaguugauuauaaugaaacaucuugaggcccccucccuacagagucggaaucacauuuuaacaagaccuccaggugacucaugugcacacuagauucuaagaaguuuccaguccugcagcucccaugucaaacugacugugggugccuggcuaaggacccacuuccucuccaguccuuuguucaccacugaccugccagugaacucuacacugacguccacgaugacgucuaccgugggugaaacuguguccuucaaaagguuacguucaggccaggugcagugggucacaccuauaaucccagcacuuugggaggccgaggcgggcagaucacaaggucaggaguucgagaccggccuggcaaauguggugaaacccugucucuacuaaaaauacaaaaauuagcuuggcgugguagugggugccuauaaucccagcuacucgggaggcugaggcaggagaaucguuugaacccgggagguggagguugcagugagccgagaucacaccacugcucuccagccugggugacagggcgagacuccaucucaaaaaaaaaaaaaaaaaaaaagggcuaaauucaaguuccaacccuugggaccugugaauguuuuggaaacagucuuuuuucagauauaaucaaguugaccugaggccacgccacaguagaguuggcccugaauuuaacaaccucauaagaagagaagagacacaaagacagacacacagggagagugcugcgugaagacgggggcagagacuggagcaaggcaucugcaagucaggaaauaccaaggaucaccagaaaccuagagaaaggcacagaacacaucaucucuuggagcagccaaaaggaaccugcccugccgccacccugauuucaaguuucuaaucuccaaggcucugagagaagaaaaaaaccacuguuuuaagcuaccaaguuuguaguauuuuguuagagcaacuuccaaacuuggccuacucaccuccucgacucugggaccucccucucuucucuuuguugcaggagaacucuccagaaggccuggccuguugcugauucucaacaaguguaguccuuccugucaugguuggcuucaccugaguugccagccucagcugcccaauauucuaauucaacaagucugucuccauacagacaaugugaccuagacgguccucauucaaaccaccgcaucuguguccccacgaaugaugagagacucucaaauagauuccugacucaugcccaugacauccucagaucaauuaacaccaucagugcacccccuccuccacucaaaaucaagaaggugaaaauauuuuauuacuugcucuugggaaacccuucugacucaaaauacucccaaauuucuuuaagcugcuugcuggucuaugacggugccaacaucucauugguugguuugcuccaggcccugauucgucaggucagagggaguggaacgcaccggaguucucgucuccuuaccuaacuuggccaacaauccuguaccaagaaacacaaaggucacagaagcagguggcuucugagagagggaaguggcucccgacucauccaccauggcagcugcauagcccaaugacaagaagcauagaaggaaguggaaaagaaacagacgggagcucuaguggaaaccaaggcagggcagacacacggcgccaaugaaagaagcacagagucaucacccaggaaucaagcccuaaucgccuugaucaugacuuucaucggacuuuagagcauuugaaaaucuggaugccucagagcaaaccagauggagcaaggccuuugccauagacagagaggucagccaagcacuguucaugaaaacugaaaacuagaaaccagcuaugugcccucaaauggaaaacugguuaaguaaguuaucauacagccaugaggcaauguguaaccuuucaaaaugugugcuugaaaaauacugaaggacacagguagauauauacagaaaaaugcaacacuguaaaaguguguguguguguguauacacaugagaauuuauacuauacauauguuacauuuauauguguguauauauagguguggguguauacauauguguguguauauauauaggauaaugcuaaauaagcaaaaagagcucaucacuguaaaaacaaaaaugcuaacaguguaaucucuggaagguagggugauaaaugauucuuauuuuucuuaauuaacuuuuuggcauuuuucuaaccagaucacauauuacuuuuaaacugagggcaaggacacaauaaauggcugcuuuguuuaaugcaaaccaggacuugauaccuuuaugaaaaucuggaacacauauaaagacgaaggggcgaaggcaggagcugcuguaggagaggugccagacaggcccaaaguuacucagugaaacgugacuuccucaccugccagcaaauccuauuccaucugaucuuaaauuaucaucaucccuaacacauucagaucauuuguucugaggacaguaaaguucuauguguacaaaucugugaguagccguguggaucccagaugcuagcccggaaauaaauacacaaaaagcagcaaaaacuccucauaaggaagaauucuggguaagauuuaaggcaagaaaauacaguucauuucaaaucaggaaauuauuuuuaagggaaucaaaaaaugugccucuuggagggcagaacucacccaucagcuguauuuacugagauuacagaauagcuuauuucaacacagcuccucucuaagaaagccagauggaaauggcgccaugugaugguuagaauggaaagagauggggaagccugcucccuggggacagugccccagaaggaagacaaaccuucugcaucugugugccaaccucagcuuggggggccucaaauucaauuaaucuucaccccaguucaauccgcaugcuggucaggaaaguugccugagcgucaggggccuggggcucuacacgacaauggaagaaaugcagaaagcugacaauauuuucauaauaaacuaagcaggagacagaggggcagaguccugagaugaauaaagaggaguguuuuuccagugcagguugagauccauuagugcucaugaaauaaauuuagugccugucaaccagcaauuuuuuuuuaacugaaauacauuagucuagaauagacuaaaggagacuagacuagaaaaugccagaaugcaucacagggaaucaguguagaacuucuucaugagcauuuuccagcuucauaugcacaacacacacgcacacauacacacacacacauacaaugcacacagacacacucacacacauauaccaaguaagcaucaauuuccuacuguggaucauggucaaaguuuccuucuauagaaaauucuggcauucucagccccagauggaacagacuaugccaagguccugcaugcaguagucuuuucccagggucauccuaagggaagguaguaauauuuguggacuugaaaugaugucaaugccuguaagaacugacugcaaagccccaaacgccucaauccagcacugcaauccacgaguggccaagauacagccaccugcugccaacacaguggggccaucgccaaggucuccucccacaagccuucgugaccagccccuucuaacucuccucccuccccuucacacucacccaauucuuguggcauuucaccagaguuuuuaaguugcuuuaugcauguccacuucgauggaaagcuccaccagggauaaugucggcaucuuuccagcccaaagcauccagccuguucuccauugauguggauggcaggcaugggcccuguuuccaaacaccacgggauagccaggacuuagcaacacugucucuaggagccaaaugggaaagagagugguucuggaacuagccaaccaggguuuaaaccagcgcguuaccccaucccagcucuuguggccuuggguagguuaauuaaggucucuaggccucagugucuucaucagaaagcaaucaaaguaucuacuuaauagggcuauuguaaagacuaaaucaguugagaaauacaaagcacguugaacagcaggcgaucaauaaguaucagcuccaguuacucuggcacuaggcgcucaugcuauuucuaucaaccacugauugggggagcuaacccucaggaggcuccucacacccagauguuugguguuuccuggggaacgcacugguucuacuugggucuccacgagggaaaaaggcuuggagagccaggugggcugccuaugaagcugucuggaugucacacacuggaaucugacccauuucuccuggcagcugaagaacagcacaguuuucugagaaacagcaagucaucaccagaugggaguuucaggaaaacaccaaaagagaugccaaggaaaaaaggggcagguccagcaucagcaugcaggaaacgguuccaagacuuuucugcccuaauuucaagacgaagaacuggggaccuagcaagcccagugguucaugaaaccacagucacaguagcacagagaagagaagacagcagaagggaauuccgaggcugacuggagacaccgcagcugggggcggcgggggcaccugggaggaacagcagccacaaucucuuggggcagaacacagaacacgacucgagggcagaggcaauggggccaaggacccucuugucagguaggagagagaaacgccgagggcaaagaagaauccagaaggcacggguugaauuuccagaacaucugggccgggugaaggggcagcucaaggugaagacagaagaucugagauggugaggaaacagcuagggguggagcgggucucagggagggggacggucagcacugcacagcaggugggcuucuccucuucagaggaaaacagacaggaagaggugauaccgagagaccccaggucuuuucuuuuaucauuuuuuuuucgagauggaguuuugcucuuguugcccaggcuggagugcaauggcgcgaucucggcucacugcaaccuccgccucugaccccaggccuuuucaaugcagcagucggagccgcaucauucacucaagguaggugaugugcggcagaggauaugccuggagcuggaggagcugcggaaagggcugcugagggaaagucaauauggaauuucaagugagguuucgguagcaugguggggugcugggaaaaacaggaugauucuucaaaaaauucaagcauaauuaccacgagaaacagcaauuccacuucuggagcacuggcagcagggucuucaagaggcaucuguacaccccaguucccagcagcaugaaccacaaccaccaugaggugggaacaggccgagccucuauccagggacaggugcggaggcaaaaugugcacgagacacacagcaacaugacaaccuuaaaaaggaagaagauucugacacaugccaccaccugguagaaccuugcagacauuaugccauauaaaagaagccaaacacggccgggcacaguggcucaugccuguaaucccagcacuuugggaggccgaggcgggugaauuauuugaggucagguguucgagaccagccuggcuaacauggugaaaccccgucucuacuaaaaauucaaaaaaauuagccgggcaugguggcaggugccuguaaucccagcugcugggaggaugaggcaggagaaucacuugaaccgggaaggcagagguugcugugagccgagacugugccacugcccuccagcaugggagacugagcgagucuccgucucaaaaaaaagaaaaaaagccagacacaaaaggacaaaugugguaugaguccacuuccaugagguucccagagccauuaaauucuuagacccagaaaguggaccgguggcugccaggggcugcagggaguugguguuugauggggcuggaguuccauucaguuuggaaagacguaaaaguucuaaagagggauggugaugaugguugcacaacagugugacuguacuuaaugccacugaacgggacacuuagaaauggggaauuucauguuauuuggccacggcaguauguuuucaaaaaguauuuggcugcagccccagggcugagggccauucacugagggacggugaggcgguacugaaacaucugggcacggcgggcgccuggggagcgggggugacgggagacggccgcugggaaggggagugaaggcaggcagcauccacacacucaguggaguuuccuggacauuugacuuaacauaaaaacuggcccacgcguccuccauuuguguuuucucacuuaaaugaccuuggaaaaauuuugucacuaaaucaaugaaaacaguccuguugaaaauucuagcuggagaccaugcuuauccugcaauaaauuacuucugaaguuccuccugcccucccucuucaaugaggcguaaaaccccguggcugacucuaauccgcaaaguugaugccaguggcagguuugguaccaagaaggggauggagccuuucucugcuaaaaauucaaaaaaauuagccaggcaugcuggcgggugccuguaaucccaacuacugggaggaugaggcaggagaaucacuugaaccgggaagguaccaaccguuugguaccaacgagggccacacuuggggaaacaauguuuaaccuuuaaaugucacagucugaaaauauacuuugucuauggaagaugguucacaagguauuuccuuccauuuagacacagcaaaacugaaagaguuaaaacaacacaaaagucaggcucccacgaugggaaucuuuaaauuuccaacgucaucgagaaagcaccuauugugaaauaauacgauaccaauuaccagaagggaggugacaugccuaauaaaacgccgugcgucugucuugcagauguaagguuugcaucaaugcacacacgucacucaauucacuugugucuuauaauaaaacacccacugaagcauggucuucccggucccuagucacuaaguaaucugacuucaagggagggaggcagacacaaaucaagcccaaucaaauuuaauaauguaaggauauauuuagcaaucuaaaauuacugcugggcucaaaacuuccuguaauuuuuaucuauucuuacacuacacacgucuguuuuucuaaaaugccacugaauucaguaguaaauguaccaaacacauugcuaauuuuaaccuugggacaauaagacagcuuugggcaauaucaaguugcccaaauaaccuaaaauuuuaauguaugcaccaccuacauuucuuucuguauaaaucaccaauuuuuauaguaaaucauguaaaaaaaaaaucaagaaaucguagugaagaguccaaauggcuccaccaaacagcugcaccaccucugagaugaaagguaggcuccgacuugauucaugucuacuuaugcugguuuccuuggucacagcaaccaucagccacgucucagcacacauacaucuuuguuccagggcauauggcaaagcuuuaaggcugggaagcgacuugaccaaaauauuuuuaagacacuagccauaagaaugccuucuaaaauuauacguuaaacaaacauuaaaagaggaagaacagaggcgucuaccaugaucagucgagugaaagauguaagcuaaucauuuggaagauucuuguucuuugaaggaauuagugcaggcagcaaauugcaaguuguacagcuccuucugcaauaagucagcccagugaaaaccgccauaacuaggauaaccaagauuguggggguccugcggcugcuccaugggccucccaggcacuuccacaccagugagcauccuaaagaacacucaggccucaugugaguggaagggaucuuucuuccaaaggacaacagggugagaccaggucaucaaaagagggaagaaggacagaaggacaggggcacuggaaggcucgcucuucugcacaggcaaagauccacugaagcaugaagguucaccacccuuuccagggcauggacacccugagaaauuagguguaaaacaugauucucaucaauucccccaaauuuaaauaaagugaauucagaaucugucuugccaaacagcaaagagagaagcaaugaaaauauuuaagagcaccuagggaggaggaagaagggauuucacuacacauggagcaugauuauguucacuacaaaagaggcuccggggccuuucccucgaguucaggcuuggcagggcccacagccccuuagcucagccacaggaagcccuucaucuacaaguccacuuugauacaaagcuacagcuagauaagaagaauaaaguccaguguucuguagcaaugcagagugaagacggucaacaauaauuuaguguauauguucaaaaagcaaguagaaaggauucugaauguucacagcaaaaagaaaugaaaaauguucaaggugaugcuaugcuaauuacccugauuugaucacaucguauaccuguacugaaauaucagcguaugucccauaaauauguacaguuuuuaugugucaucuaaaaauaaaauuaaaauuaaaaaaaggccgggcacaguggcucacgccuauaaucccagcacuuugggaggcugaggugggugggucaccugaggucaggaauuggagaccagccugaccaauauggugaaaccccaucucuacuaaaaauacaaaaaaauuugccaggcaugguggcaugcgccuguagucccagcaauucgggaggcugagacaggagaauugcuucaagccgggaggcagagguugcagugagcugagaucacaccacugcacuccagcaugggcaacagagcaggauucugucucaaaaaaaaaaaaaaaaaaaaaaaaagcacagcucuugaaaucaaauugagaucucugacauuaacaacuaugguauuuggggcaaguuaauuaacuguaaucaaaauaccuaccuccaaaagagauaaugaaagaaaaaaagaaggagaagucugccuuggcaguggccggcacucaccuucacccggacggucuggucugacaugcugcucaucaugucauugauggaccugaagagcugcagcaaagauuccacgaagucagccucucccuuguuuucauacagucugcaaagaaacacacaaacugugggggccuggcagaaacaccucaacauuuuuugaauccaugucuauagccaugaagggaaucacuugggugacaaguuagaaugagagaccacauccucaacaucuaugaagcaaggaagguaacuuggcagugagacucaugcagaccacucagccaaggcagcgugccuccacauacagaggcugacccuuaaugcuaccacucacugcauuuuucauuguaacauacuacaucuuauaaaucugaaaaacacagaaaauauacagaaagggaggguggaaagggccgaggaagagaaggagggaaagaggauggggaaauucagcuuuauuucuaccccacaaaaauuacacuauuaagaugcaguuguguuuucuaccaguguuuuuauuuuuauuuuauuuauuuauuuuuguaauggagucuugcucuugucacccaggcuggagugcaauggcaugaucucggcucacugcaaccaccgcuuccuggguucaagcaauuauccugccucaaccucccaaguaggugggauuacagguggccaccaccaugcccagcuaauuuuuauauuuuaguagggaagaaguuacaccauguuggccaggcuggucuugaacuccugaccuaaggugauccacuugccucggccucccaaagugcugggauuacaggcgugagccgccaggcggccacuaccaauguuuuuaaacccauuaugucacaaauugaaaaucaacaacacacuccauugccuaaauuuaccaugaucuucuaauccuuuaaaaugauaucacaagaguugcuuuuuuauuccagaguaauggugcuuuacaaacgcauucauuucaacaucagugguaacugaaaaguauucaagaggugggacauauucaauaaauagguaauaaggaaguugugcauugguuacauguaugcuaauauauguuacuaauugaaaauaagucucguuuguaaauuauuuauuagcaguuacuucaaguugcuguguuacuaaaaagcaacacauuugcauuuuaaaauauugugacucagauguuuuauuaauacaguguuuacuaauacuaguuugcugccuaauuaaaaauauacgauaccugaaaacuuguguacaauggaaaauuuuguaaacuaagugauaauuaauuacccuagagguagucugauauuuaaaugaauuccacuguaaagcaacaaauucuguguaaaaugggaaauugcaaccuaguggaucuguuuuguaaauaaggguuuucaaaugggguuugcuuaaaugauguaccaaacaauuaaaaugauggaaucaugaacuucugcuugcaaguggcaugaagaacaccugguagacuggugcaacccuucgggagccaucaagcugcaaucauuuuuccccucaggacaucuguaauuccuagaccuguaugggauagaagacuaaaaaccaaaacgaaaaccucuauaaagcaaaguggaauuugcaccaaucaucagagaaaaugacucgaguuuggaaaacgccagggagagaguccccagguaacagagccgacucucagaugaaaauccuagaaagccagaggcacaguaaauggagacugaggcauacuaaagguccaguguagccucaaaacugagcacagucucugauuaaaauaagauggucagccccacuuugucuagaagaaggcaggaugaauuaucucuggaagaagaucacaucaucugaagcuucuacaguuuuacauacaaacagucuugacuucaaacaaaaauuauuaaacucagcagaaaaccagaccacaguccaagugaaagaggaaaaagagagcagaaacagccccacagauaaucuagauauuacaauuuccuagaacaucaaaacaacuauaaucauauuugagaacagggaaaauaagauaaaaaaaugacaaauagaagguaagagaaaaauuucaguagagaaaugaaucuaugaaaaaaucaacuggaaauucuaaaacuacaaaauauacucucuaaaauuaaaaauuuauuagauggauuaacaaaauagagaguagacacagcaagaggcagaauuaguaaaauggaagacaauccacagaaaauaacuaaacagaaguacugaggaagagaauacagaagagggcuaggaaugugcaggcauauugaggagaucuaacauacauguaauugaagugccaggagaaaaggaggaagauaaugagacaaaaguaacauuagaacagacaauggccacaaaucuuccaaaacugaucaaagauaucaaucaaaaaauucagaaauucaaugcaggauaaauaaaaagcaaaaacaauccuaugcaacccauaguaagauugucaauaaccacagaaaaggagacaaacuaaaagcagcaagaaagaaaauaauaccauuuaaauucaaagauguaacaguaagucugaaagcuaaugacuuacuauaaaugaaggaaaucaaaauagaauagaauacauggaagaagaaaauaacuuccaaccuagaaugcuauagugagugaaaauaucuuucaaacacaaagaugaaauaaaucauuuucauacaaacagagucccauaacuggccaacacuaaaagaaauaauacaagugaguucuuuggacagaaagaaaaugaucccaaaggaaaagugaaauugaaggaugaaaaacaauuacaaacauaaaacacaucaaaugaauacuaacuguauaaaauaacaguaaugucuuauggaauauaaaacauagaauugaaauacaauaauaauauaaaacagaggagaagaaaauggcaauuccagcgugcuauuuuucuggccauaucuagcauuaucaguggauugguaagaguaaucauuugaaauacucuaaaauaaguccaacauggauguuaccaucucuagaauaauuguuaaaaauaauaguaaaagaauauucaaauaauauguuuaaaaaucagaaaaugagaugcuuaaaaaaaguguaacugguauaaaagaaggcaaaaaaggaggaaaaggggaaaauaauacagauggggaagggaaaauuaaugcaaaaauaauauauaaaucuaacauuacuuaauuacacuauauauaaauggaugaaaugcucaauuaagaagcuugucagacuggaugaaagaaaaauacaacuauauguuguauuauaagaggcacaccuuaaguauaaagacacagaaagcaugaaaauaaaaggauggaaauagguauuccaugcaaauacuagccaaaagauuaagagaaacuuuucauauugauuaaggaauagaccaacaggaaagauaucaugauuauaaaucuguaugcccccaauaacacagcuucaaaaucuauaaggcaugauuaaugaaucuuuaauauuuuuuaaauucuaccagaaccucucaugaguaaaaauguaaaacaguuucucuugugccaaccaacauguuuagaacauagcauuuugccgugauccuuuugaagcaucuuucuguaacaaaagaucacuguuaaagucucuagaaucuucccuuuucauuuucccagauaaaccagggagaaccacuuuuuugauccacccugaaguggauaaaaaacugagaaaaaacaacucagaaacuuaucgauaaauaaacagaugaauaagaccugcucauuccuugcucuacuuaaauaaguguucauuaacaaggaaugacaggaucuuugucuauuaacuacauucuauuuugugacccagggaaugauagcaaaaaggucuguacaacuuauucaugaucaauaacuaauuauuuacaaagcuaacaccagaugacaggcaaaaacucuacaaagcacaagaaacccagaagagaaggcaggcaauaacuagauuuaguaauuugauucugaugcagaauaucuguuuucuggcuuucuaguuaaugugauccacccacacagaaaacacagacaaacaaaaaccaguagagaagugcccccggcugucaggaaucuuucaguggguuccccaggaaccaaaugucuuugggccauagcuuuuaaacuguuguucucauuucaaaacaaaaugagcuuucuaaacaaaacaaaaaauaugagacugcauagcaagaaagauaguaaguuaacaacauaagcuucaauaucuucaucuucaaaguuucaccucuuuguucuuuggaagaauaauuacugucaauuauacuggaauuuaacaaagcuauugcacuauaggaaaacacaauagaccauuuugaaagccaaagaaaaauaagaucucaaaaguuuaucccagcugcaaaaaggaaaacacacucaugaauuccagcugugagcacaauuguuuuucucucaagguaauaaacaugcugcagguaagaagaugagaguccuaguuuguuuucuuccccaccucugacagcaccacacaggagacucauuuggagcuugucacggaucaaacauccuagauaucugugugggacguggggcucuuuuuccuuuaaguagccuauacaagcuaggaaaacgauuucagcuacauuucagaccugugauagcacagaugaaguaacaacugacaugcuguggugggaugauggggagcaggggugggauggggaggacagaaggggagggauuacuagaagacuucugcccuaccguccaauauucuaagggcauggguuuuuuccucucauaaaaucuaugaaauaucuucucagccauuuuagaacacagauuuaaauugaaguauuuguugucucugcacaaugcggcuaggugcuccacaucucaaagaacguuauguccuucucuccccucaggaaugaggguaggcagccaggauccacauucaggaaacguucagagaaaaaauaauaaagucaaacugugaaagucugggauacacuuggggcucauacacucauuaaguauucauggaaggaaggaaggaagggacaaaagagagaaaaaaggagggaaggagagaggaaagaacgaagcgaggagagaaggaagaagcuagggaagaagggaggaaaagagggagggagagaaggaacaugaguaucaacauccccagaaucagugggguacaggggcucaugccuggaauccuggcacuuugggaggccacagcaggaggauggcuucaggccaggaguuugagaccagccugggcaacauagcgagaccauguccuacaaaaaauuagccaggcaugcuggcaccugccuguaguccuaguuacuugggagacuaaggcaggaggauggcuugagcccagggguuugaggcugcagugaccuaugacugcaucacaguacuccauccugagugacagagggagguccugucucaaaucaucaucaucaucaucaugaucaggagcagcagcagcagcaucaggaucuccagaaucacugcaguacucgguuagcuaaagucaggaaugcccagacaauggccucagaggcuuagggagccucacuaaguuguaacaauugcuacaacuugucuugugaccacuuuguguccucaacagucucaacucuucuaacaaacaaguuauaccagcaaagaaacucaguuuguggaccaugccuggcuccugcuggguccauaccaggacaaaggcagguagagcgaucauguucugugccaugcuguugagcaccagaaugcaggcauucagaggacuuuagcacuaaacacuuccugucccaaacacgaggagcagcugaguacuucaguccauuucuauguaaccugguaggacuaaaccaugccaguggaucacuuagggccuaaagagauacuuaaagccaaagagauacuggugacagaagucucagagauugacucccaaacuaauggagaagaaaggcucugcaaaaccuaguuaaguaggauuuaguaacccagaaugaguuagggaagcucucagggaacagaccaucuggguugaagguaugaggaagagaauguuaacugcccauccauuaucuauuucucccuaacuccuuuacuaaaaucacucugguauuguagaaagcaucaaccagcccaucuaaaaauccuuuccagcuuccuugcagguaggguggucaugugacaugguucuggccaauaagaugaaagcacaugacacuuucuagggaugaggaaagcucuuucaaagaagaauagcuggcacagcuguuucuccuuugccuuccccucuccuccaccuggaaugcagagcugaugcugggaggggcagaagccaucuuaggauuaggagauaaagagaccccacuaaggaugguggggcagagagaucaaaggagccaaggacaucaggacgcugaguccucacgcaggugcaugaacucggaacucuuccuccgggcugcacauuaugugacuaaaaaaaaaaagugaaccccauaugguuaagucacauaaaugguguuuuucuauuacaugcagccaaucauauuccuaagcacuauuagacugaucaaacgaaaaaaaaaauuauggaccaugaaucuaagauuuugugccauuuguauuuugaaauugaaagagauuaaagaacgaggcagagaaauaauuugcuacuggucaaccuggguaacucaaucuuuucuaaagcagcauuauuguauaaaagacuauagcauuuacuacuauagcagaaacaccauuaucaaugcacgaucguuuuaaguacaaaccucugaaugaaagggaaaguccaguguuaucgggugagaauaugcagaucaucaaaugccugagucaaugucauauugaucacaaacugcacaaaauuaacauuuuucaaauaaaacaugacaaaaaucuguaacaucuuucaaguucauccucccacccuaguacugacuuggguuuagcauaaucagagauuuaaaaucagugaggaaaauauaacagcaaggcagggggggccaggaaguucauuuucauagaauuaacuuuacugaaauagaauuaaaauacaagaaaacauaaccuagcuuaccaugcuguguuucacccuaacaaagagaaaauaaaucacaacuuagauccuugagggaaagcuucaauccacaccaaaggucaugcauauccauaauaagcaaaauaaaagaguguaauaucuaagucaaggacaaaaccaugaugcccucaaacaugccauauuuguaugcaaaaauggcagcacgaggacugugguuuugaccauggacacgccagagugaacagaagcacacuccagucccugaccaguaacacaucacuagugguuaccacccuguuuaugacucugauaggucaacacacagucaauaacuuguugcuuuguccuuauuacuaucaugguagacacaugguuagauuuugaauucuucccccuucuccugaguccuucuucuggacacgacugcuucagacaaacgaaaacacagugaggaggaaacgggaaggcacugaugugggcccacacuuucaauuccuuauucucguuaauagguuacaagggcaccaugcuuuucaaaggcaaauguauucgcuaauucagagggacacagguucaugaaucccaucuguguguggaacucacaacaagaacaauaacaacguagaaccaccaacauccauugacaucacucauggcaggucacccacaaaauagccaucccccaaaaaaacaagcagagggagugaaauuccacaccccacccucaacacacuuacuuuucacaucuuuugaaucauacagugaagaggcgugggccaacuuagaaaguccucauuuuagcgcagcucuuaaccugcaucuguaucuauacaauauuaaggcucucuauaaaauaagccauaaauaucccaauuuauguauuuuauugaggcaaaauauacauauauauaauucaccaucuuuaccauuuuaaguauacaguucaaugguaauaaauacauuuuuuguuccccuuuaacccuucgauuuacuuuaaagcucaaaaaucauucauaaguucauccacacagcgugugaaaacugucacuaggcuaaagcaccugaguauccuuccucacggaaauacccuauguaggaagaguucucccgaaaugaaacaucacucuacugaggaaaagaggaggaggaaaucccagagucugcccaagugaggcaauuucacuugguuuugccuuuucauuguuguuuuauuuauuuauuuuguuuuugagauggagucucgcucugucgcccaggcuggagugcaguggcgcgaucuccgcucgcugcaagcuccgccucccggguucacgcccuucuccugccucagccucccaaguagcugggauuacaggcgugagccacugcgcccggccuauuuuuguuguuguuuuucuuuugggacuuuuugccauauaaagauauccugaaaagggcuucugagcccucaguagacgcccaggauugcaccugcgucaucgccaaugcuuucaggagccaaggcucgacucacaggcacacaucucagaccaggaacagggcucccgccucagcaccggcagggacccaggcggguaaggaaagagugggcagcucaccccaggaucaacagugcucucucagccuagaaagcaagggggaaaaagggggaagaagaaaggaaagaauaaggggacgagagaaggggaaggaaagaagugaaggaucuccugccaguccucugagagcccgggcauggaggggauagguacgcacugauugaacaggauccuggagcgcacgaugaacuugaagauggauucuagcgcuuucauggcuuuguacagcugcucauuuacucccggcuucucagcaccguccacguaguucuucaacacuuuugucaacuuccuauucacaaugcaaacacgcacaaauaagcucaggaaaggaaaauaucucaaaucuuaacugcuaaggaaauauacaaguagguuacuuuuauuugguuuccaucuaucaguauaugaauaucuguaaaacguuuucucuuuuuuuuuuuuuuuguuugagacaguuucacccugucacccaggauggagugcaauggugcaaucucggcucacugcaaccucugccuuccgggcucaagugauucuccugccuccgccucccaaguaguuggaauuauaggcacacgccgccucgcccagcuaauuuuuuguauuuuaguagagacaggagcucaccauuugcccgggcuggucucaaacuccugagcucaggcaauccaccccccuuggccucccaaaguguuaggaucauaggcguaagccacugcacggccuguaaaacguuuucuaaucaguaaaugugccugauaaaauaccucugagagcaaaggcugagcauuuaauaagcccuuucuaaguguagacguuguucuaagcaggugaaaugcauuaucuaacuuagccuucacagcaacacuaugaggcaguauuauccuauuuaauggaugaggaaaccaggacuuccacagguaaaacacuagcuuccccaagguuaaacaauaaaaucgaagagauuuucauuacagccaaacagagacacaaaaauuuuuuucauaaaggcaugacaccaaaaauacucucugauggauaguggugacgauuuucucaacauugcacuuuaaaacuauuagguaggggccaggugcucuugcucacaccuggaaucccagcacuuugggaggccaaggcaggugaaucacuucaacucaggaguuugagaccagccuggacaacaaaaugaaacccugccuccagaaaaaauacaaaaauuagccggguaggauggcauauggcuguaguccuagcuacucaagaggcugaggcaagagaaucacuugaguccaggaagcagagguugcagugagccaagaucgcgcuacugcacuccagcauggacgacaagagugaaaccuugucucaaaaaaucauaaaauaaaauaaaaugauucggugaauuuuauguuauguguauuuuacaacaauuuuuuuaaaggcaugaaacaguauuuguuauuggaaagcaucucagacacuuuuauucauuuuaguugauuuucuaaaacuagaguucuuacaccgaaaauuaaaauuuacaaauggucuuucaaauaggaagcagucuuaaauuuuuaauaauauuguaaaaauccuuauagagaagacuauaaacaauauauaagaauaguaagaauacuaucaguggacacaugaagauuuuaaaauauugacauuuccuaauaagauuccccaaaaacauuuaguuuuaaaaacacaaugacuacuauacucuuagucuguuuauuuauaaauugggaucuaaaaucaaguaacauccuaauaugaaaacauuuaaaaucuuuuccaugauaaaaaaguuuacacacuuuggaauacacaaaaauugaguaaaauuauuuguaaauuuuucauccuacuacagaaguaauuauagacaguugguauaaauaaacuauauauuaggagcuuaauauuaauucauggcuucauaaauauuuucaguguuuaauucauagauagguuuuuuuaauuccuugcuaaagaugaagggaaauguauuaaauuauuuuuacuuuacuguaauucaaauaacaagaaaguucaaaugauaauagaucuacucaaaguuuuagggaaugugagaagcuuaauuuuuuaaaaucuagaaauauauuaaucaacuucauuaauaaacacaugaaaauuaaauaaaauuucugccuaguacagacaaacuuugggguaucauaacacugcuguuggauaaaugggcauaaaacuuuuuuuuuuuuuuuucagacagagucuugcucuguugcccaggcgggagugcaguggcacgaucucagcucacugaaaccuccaccucccagguuccagcgauucuccugccucagccucccacacagcuacagaugcacaccaccacgcccagcuaaguuuuguauuuuuaguagagacaggguuucaccauauuggccaggcuggucucgaacuccugaccucgugauccacccaccucagccuccccaagugcugggauuaccggugugagccacugcacccagcagggcauaaaaauuuuuuagaggguaaaguggcaauauguauuauaauaucuauuggaaauaucuauuauauauaauaguuggaaaaucuauuauaauuaagaaauaucuauuauaauuaaggaaauaucuguuauauuuggaaauaucuauuauaauuaaggauauuggaaauaucuauuauauuggaaauaucuauuauaauuaaggauauucaaauccuuugacaccaggaauuccaacucuaguaacuguccuacagaaacaauuacaaaugaaucaaaugauguuuacugccgcaugaucugacuaguaaaaauacauaaacaaugcaaaugcccaaccucugagagccgguucaauaaaugguaauacaucccuacaaugaaauacugcacagcaguucaauacacuaggugggcacucccucaucacuauaguaaaaaaaaaaaaaaaaaaaaaaagaggccaguuuugucauuaugcuguuaaaagaaaacagcaguuacaaaaucgaaggucuauugugaaucuguucuguauuuuauauucucuccuucugaacuuuuugucuguccuuaugccaauaccaugcuaucuugguuacugauguuuaauaauaaaucuugaaauuuugaucuucuaaaauauuauuucgguauuuuagacuuuuugaaaguauaaauauucaaauuaguccauuuuuuuuucacaaaagcauacagaauuuucauugagacuguguucaaacuauaauuugaaauaaacauucaagcaauauuuuauuuuucaauacaugaacaugguauauauuaucaaauuauuuacuuuuuauauuucucuuagcaaauuuugcaauuuucagucaucuaccaguaaauuuaucccucauuauuuuauuuauuuauuuuugagacagagucucacucugucacucaggcuggcgugcaguagcgugaucguggcucacugcaaccucucccucccaaguucacgagauucuacugccucagccucccaaguagcugggauuacaggugcccaccaccacacuuggcgaauuuuuguauuuucaguagagaugggguuucaccauguuggucaggcuggucucaaacuccugaacucaacugauccacccaccuaggccucccucccaaaguguugggauuauaggcaugagccaccaugcccggccuaugacuuuuugauaagacccuaaaguguacuguacuguaccauacuguaauucuacuguacuuuuaauucccucucaauuauguguauauauacaauugaaguuuccuuuuauguuuguuuuaaaauaaauuauaaaauagauucaggagggcuuuuuauauacaaaaucaacgugaaaauacaguuuuucuuuccaauuguuauacccgcauuuauuucuucuugcuuuacuacuuccagcgcaauaauaaacagauauaguaagaagagacagccacguuuguuccugaacuuacaggaaaagcuuuccauguuccagcauuauguauaagguuagcuaugacuuuucguagaugagcuuuaucagaucaaggaacuucccaucuauuccuaguuugccaagagguuuuaucauaaacagaugcugaauucugucaaaagcauaaagcauaaagcuucugaaacagugaugcccaacagaacuuucuacagugauggaaaccuguuucugagcuguccaaccuggcucagcacuugaaacacaccuggcacaacugcggaaguaauuguuuaguuuaauuuuauuuaaauagccacacgaggcuagugcugugacauuagacagugcaggcauuguuaagaccuuuggcuaggcaaagauuguuuagccacaaaaugaaaaucccuaucuguuuuuuuaaaugaugauuuaggcuucaacaaaauaaaagauuucugcucaucgaaagacaccauuaagaaaagggauaaacagaggcaggaagaaaauguucaaaaaucaugucugacaaaaaaaaauacauauauuuauguguauaaacacacaaacacauacacacacauaccauaaacaucaauaagaaacagacaacaaaauauaaaaugaaaaagagauuugaacagacauuucacaaauggcaaaucaaaauaaaauaaacagguacucaguaucaucaguuauccaguaacugcaaauuaaaaucaccaagagauauaauuuugcccccaguacaauagcuacaaagucagacacuacuaaauguugaugaggauacagagcaaaagaacauucacagauugcuggugggaaugcaauaugguacaacccuuuuggagaacugucucgcaauaucuuacaaagaaaacuauacacguauccuuuagcccggcaauucuaccgcuaggugcuuauccaagggaaacaaaaacaaacuucaccaaagacuuggacaagaauauucaucgcagccuuauucggaauagccaaaaacuagaaacacuucauguauccaucaacaagaaaauggcuaaacaaaucaugaaauauucauacaauaaaauacugcucagaaauagagaggagcaaaaucaaauauuuaaugaugcacaaagcaacaugcaugaaucucaagagaauuauguggaagggaagaagccagauacaaaaagagugcaugaccccacugguguaaaguuuaagaacaggcaaaacacauuccuaacagaaaccacagaguggcugcuugucugggagugggaugggcucagauaggccaagagggauguuuguggggaauggcaaugucuuaugucuuguuuugggcaguaguuccaaggguauacaaaaaccguccaaacaaaauuaaaaugagcauuuuguuguaugcaaauuauaacaauuuuuaaguuuuuaaauuuuaagcaagcaaaaauaacaaugcuguuuuguaaaauaugcagacauauuagucauaaucuuaauaacaauguuaauauaaacauagaaaauaaaugcuggcacaguagauaucuccaauauguagcauuauauacaagggaacuuuuaucgucugcacuauaacauuugaguaaugugagauuucuuuacuauuuuuuauccguugagcauguguuauuuuuaaaugauagaggcaguagugaggaucugccauuuuuaauucuauccacacuucuacacuuucaaccauuacugacucaucaaauaauaaucuuguucauaaggaugacccucaagcaauagcuuacacauaauaaaagaacaacugaauuaacaacaacacacggucauuuuuuaauguacugagcugcacugcaacucuccaaaaacuagcaccaugcgugcagccaguaagacaccaggaagaauauccgccacccaaacuucuccagucaccaacaucuuacgcauccaacaaaauucacugaggcuuuuuaaaagccacaugaaagauuuuuauguucauaaaagcaaucugcugggguacugacagcaugucugguucaguugugagccaguaaaggccagacugcucacucagguuauggaauaagacacucagaagagcaaccuucacugcaauuauggaugagcuaagaguaccuauuuuaccaauacaucacaaugaaaaucuuuuuuuuuuuuuuuuuuuuuuugagacguagugucgcucugcccaggcuggagugcagugcugugaucucugcucacugcaaccucugccucccagguucaagcgauucuccuaccucagccuucugauuagcugggauuacaggcaccugccaccacacaaggcuaacuuuuuggguuuuauuuuuuaguagggaugggguuucaccauguuggccaggcugguauugaacuccugaccucaaaugauccgcccaccucagccucccaaagugcaaggauuacaggugugagccaccaugcauggccugaaaagcuuuuugggagacugaguggaugugaagccauuucuaacaccgaucaggcaccagagcucuaguagggagcccugaugcucucagagucacacuccugcucgcuguucugaagaggcgaagucugcagauccuccugcuacgguguccaucuccauuggcuggaaaacacaccuugccauauaggccucugcggguggugcucacugcacaagagagcaugcaacacccuggcaugaagccugcuucacucaguuuuacuuauuuucccaaacuuacuggaccacgcaccucuuauuacauauauuaauaucccagggaauaaacauuccauagaacacauuuugggaauucuucaaaccaauuaaaaaaagaaaaauaauaaugauuugcaaagagaaggacuuagaaccaacaaauguaucuuaaccuggaauuagacagcaaaaagaaagaaaauaaauaaaagaaggaccuagaaccagcaaaugaaucuuaaccuggaauuagacagcaaaaagaaaauaaauaaaaauaaaucugccaggccaucuuauaccugcacaaaaagcaaccccuuggcacuggcuagagggggcggagcagauggagcaucaguugccagugaggagccugcagcagcuccauaggguggacaaaaaggagcccagucaugcugguuuuauggaagagcagcccccaaagccgaugccucccuucauucucacuuguaccagugcuggucaguccaguggggcuccagcauccaugaacuacccacgcaggggagccgcagacacagcucgaggugcggaagaggacugcccauugccaaaaucuuucauuccuucucuugguguuguugggaagaagggcuaaagaucucaacauuuaccaaaggagagaggcuacauggacaagagucuaaaguaagccuguaccuaccaaagccuucuagaggagaagaggacaaggacacucugggauaauauuacuggaauuucgccuggcccagagaauacuguaagcauaucaccaaugcggaggcgaccuuccaugauguggucagagcuaucucagucgccacugacuccuuuggaauuucaaggugcagacaugcaaauucaggcugcugaggaaccacgugagguugccaguuuaccaaaacaugcuaacaauacuuauuuuccacaauaaaaauuucuuuuucagcagauuccauagauugaaugacaggauccuuuuuuuuuuuuuuuuuuuuuuuuuauugagacagagucuugaucuguagcccaggcuggagugcaauggcacgaucucggcucacugcaaccuccgccucccggguucaagugauucuccugccucagccucccaaguagcugggacuacaggcacgugccaccacgcgcagcuaauuuuugcauuuuuaguagagauggggguuucuccauguuggccagacuggucuccaacuccuggccucaugggauccacccaccucggccuuccaaagugcugggauuacaggugugagccacuccacccggccaugaggauacuauucuuaucucagucccaucacagcauaaagaaaaaaugguacuuuuuguuugucucauuaggaaacucaucaaaaucucccauuuuucuuucuccaccuaugagaauggcugcaucacuccuuccccaacagcacagcauggaaaggcuggcgccaaugaagagauguggcugcagugugguaagcugauucaugccucucaucuucugaaauucaagcacggagccuaaucugagaagaguucuuuggccacauuucaaucaaaaggcagaauuuugaaaaugagcacacguggaggccgugcuacguuugcugcaguccacaggccacuuccgcaaaccccacaagcuccuguuuuggucacaagagccaggaaaagugcccugcaaugcacccuccccacggucuguaaggaacuacucgacaugcccacacacugggcaucuccacucagcgaacaaaauguuuuaaacaaacguuuauuagcaagcaagugcaaagaacuagucacagcuuguuccgcaggcuugaggaccucacagcucuuagccuuccuggagcuccacccaccaccuuacaguaaacacgcacacgaggcagauaugaaagaauccaggugcaggaccaggguauauuaacagcuggcuucaggaggccagaguccucugaccugaguucaugacugcacacagggaggaaaaacagguauuuugcaaaguauguugaagacacagaagggaguuuuaacuaaauuuacucacacuaaaaagaauccuuucuacugauucuaagcgggauguucuuaaagaaauuauguaaaucuuuauguuuugcuguaacucacacaauaaaaagucugaauaaaugccaauaaauuccaccaagaaagagccgguaagucaucauaauaaaucuaaugauaaugaaacccaauaauugcuuagugcuuucuaagugccagggauuaguccaagcacucuacacguaauaacuuauuaaaauuuccacacaagccuacaaucaugcucugauuacagacaagaaggcugagguacagagagguuaagcaacuugcccaagaucacagagcuugugagggacagagcugcacaucaagcccaggcagccugacuccagacuccagggcucugcucuucaauaccaggcacacugcuaagcuggcccaggcaccaugcauagccucuggugucuuccuagaccucuggggcacagacgggcagagggguggauagaaggaauccaagacagugacagcugaagcuugucaaagaaaagggaaggugcucuuuaaagagcaaggagauacauugcaaaguacaaaacugcaucuaauucacacuaaacaaccaaucuccuuaacacgggaacacaugcauuuauccauucaucaaaggcucgcgaggaagccgcggugucagacacuccgcauccaaagcucaguuucaucgaacauaaagugaagauuucaaagauaaauggaaggugugagggagaacaagaauuuauuccagaauauuacgaugauuuaucacauaucucuuucaacaagguuuuuagguauguuaagagggaaacaauacuaaaaauuauuccaguaaacucagaguuuugagcaggaguaaauacacagucauagacaaaaguacaugaaaaagacucuaaauaacacaaauaccaaaaaaagaaguauugguuuuaaaacaaaguaggaacuuacguguaggcuaacguugcacuaaaguguuucuuaauguaaguuuccaaaacaggauuaaaaugcugaaauuuucuaucagcaaucaguccaaugauaaauaccugucaaauuaaucaauaauauuuucauuagcaacauaauguaagccauuuuauaaucuucaucagaaccaucugcaccccuguguuaggauaugaaccauaacauuuucagauagaaguugguggcuaguuuaccuuuucuuacccuagaaaugacauuugccuaacuacaguuuuacauuuaaaaaaaagagaaaaaaaaucugccaccccaauucaucucugauuggauuuacaacugaaaaugcguucaaggucacugugacgaagcccccgacuccagccucagacgcugcagcauggaagaacgcuguguuauccaagcauaugagaaggaaagcucucuuaccagagcaucaaagacuaacgugucaaaagucucacucucugaguucuccaucaugauguugaagagggcauccaacguguccugaagaaacugcauagacacagaaggucgggugacaaugugaacccaccggacuucccccacacacuggaauaacuaucaucucugcaguacuccaaauacccacuuugcccccagcacuaccuauaaagccauucgggauccuuuucagccacuagauacacaagacaaaaauuuuggaugagcgaauucagaacaaagaaaugccaccaguguuaaauggagagggucaaagcaaggagagggccuacugcuucccccagggggccuuuccaacccucuuuccgguuuucauaaggcuggugacaaagcgcugaauggcaacucugggaagaugcaucucacucauucuacacacuggguacaggacuucagcuagugaaugggcagaagccacacagggacaggacccagcugaguggaaggaaggaccuucuaccaaccagggugcccaggcauggaagaggaucgugauucugaaacuggaauacacagcaguaucccaguuuugagaccagaaggugcuuacuuuauucaacaacaaugucgaaauuacaguuacaguugacuaaaauuuaccaaauaaauacuacugcaaagaaggacaaagcaucauacauguaauuaggaagagacuucaaaggcaugucacacuacaagucagcuucaagucccaccccauccuccccugcaggaaauguaagacggacugaagaucacgguguuggaagugaugauucguauuagaagagaaggucaagaagaggcagaacgccacacaacgaaauacuggccauaaacaugaugaaguacugaucuaucaugauuacucauuagggacauacaaagggaaaccaucaugagcuaucacuucacacccacuaucugggcuacaauuuaagaugacuaauaagaagugggcaagaacgcagagaaauuggagaccuugcacacugcugguagaaauguacaauugugcaauugcuaugaaaaacuguuugacaauuccucaaaaacuuaaacacagauuuaccauaugagucaacaguuucauuccuggccaucucuccaaaagaaaggaaacauauguucacaaaauaacuuguacacaaauauuauucaucaucuccaaaaaagcagaaucaauacaaaugugugucaacuaaugaauggaaagacaaucugcggucuauccaugugauggaauguuaucggccauaaaaaggcauaaaagcaggccaggugcaguggcucacaucuguaaucucagcacuuugggaggcugaggaggccggaucaccugaggucgggaguucgagaccagccugaccaacauggagaaacccccaucucuacuaaaaauacaaaacuagccgggcaugguggcacacgcuuguaaucccagcuacuugggaggcugaggcaggagaaucaguugaaccugggagguggagguuguggugagccaagauccugagauugcgccuuugcacuccagccuggccaacaagagcacaacuucaucucaaaacaaaaaaaggugugaagcacugauagucacuacggcaugaauaaaccuugaagacacaaggcuaagugagagaagccagacacaaaaggccacagggcguaugauucaauuuacauaaaauauccagaacagguaaauccaucgagacaggaagcagauuagugguuacaggaagaggagaaagugacuacuaauagcuaugugguuucuuuugggaugaugaaaguguucugaaauuagacagugguaauaguuguacaacuccaugaagacacuaaaaacuucagaguaaaaggaugaauuuuuugguaugugaauuauaucucaaugaaacuguaauuuaaagaaaaauaaaaauaaaugggugaggugaucacacagcaaggacaucagaggaaaggcugggucagguguuugguucagauuccuccuggacugugcagccucuucccaacacccagggggcuuuugggauggcauggaagaucucaaacugcuauagccccaagauuaaagaagcaaaccacaaacuccugcucgcaaaggagugcuguggaaccacagcagcagcaacagccucgcccgccuccuucgggagagaggauguccagcaugcccagcaugagccucauccguuuccuuugggagagaggacgcccagcaugcccagcaugagaucagagacccuuuaaggaguaaaauccucuccaugcuuggcugugccagccaccacuuacuuuauaccagaaaaugucacaugcaaacagugggaaacaaaaccaaccugaccaaaaggcaugcuggucuggaugucaagggauuaaucaacuccuaacuauguggaucuguaccacuuuguuacuuuugcaccauuucccaucauuuucagaauguagauucuuugcgaaggucaaaacuugaugccaucugcuaacagccgaauauuucccugccaacaggcucccagguggcaggaccuggccugucacgguucaugcaaagucccugaaguagaccaccuggucccacccagacacaugacauggucaguggcacagaaacagaaccacagggagauggagcugcacguauugggcugcggagcugcaguggggcaggggcgagcaccugaaggagggccuucacacggagccaugaaagggcuucaucuggcaccccacccucucucuaagaccauguucaagggcaccaaagucaccauuuccauuuuccaucuaaugggacagcguaucuuuugcuaaauacacaaauaccuuccucaaucuaccaagcaaugccaucucucugcuaucagucaucaauacucagaagggagguccugaauaaauggaaccaaacccacaaucuaucagcaucccuaucagcaaaaggagccccgugcaggcaggaauuccucaaguccuggcuggccauuaacagccccguggccucaagucaguuccacucucuaggcucacggcgcaugucagacacgccagcagagaaaaagcacaaaguuaggcaagguagguaagggcuggacaggucacccaggcuugcgugguaccagcacgcacaggaagaaaggaaagguguaaaggccaugucuagggaugaauaaucaaaugugagaaucuaugagaugaggggaaugggggagaaugacgggacaagaucauucuacauucuuccagguaacugugguaacuggucgccagaaauacaacucauuccuaauaugauacagggacuucaaaaugaaagaggacaaaauuucauuaacuggauucuucucaacuacguucauguauuucaccuaguuuccaccugaauuagggaauuuacagaacacagggaaguuuaaaaugcaauuaacauuguccaagccauugggagaacaccaggacugagaagaugauuaaaauuuuaagauuagugaguauaugucugaagaguuauacgauucaggaaacuggugcgaccaaauuaauugauacugaagugaagcacacugcugguuaauuaaggccauuuuaaguaauuaguuuuuacagagauaaggucgucucuuucugcaaucaccucuccuagagagugaggaacugaggcggcaacacacagaccuugcuggagagucuaugcuuauagaacgccacaugccagugacccccuuaucgucccauagccaaaaacagaaucgacuaaaaauggaaauucgcuuccucacguacaaggaaaaguugccccagcaaauugugggguaucugagagcagagaagagccuaauacugcagaaaacaucagaaccacaaacaauuacagaguaaagaauuccagaagcugagugcucccaggaccuccggccauguaaucugacugcccucucucacagauaaagaugcugaggccacaagggucugaaugaauaauuauacccgacacugcugcagagcgucccgugggaagaagacggcccaggcaagccucucagugucgugaucuuucuaccacaccacagaccucuccuggucacuuaaaggggaucucagggagucuaguacgaaugcugauggcaguaacaaggaucaugacaacaguaaaaagaccugaggcuccacaacgacccugcagaaggcacuacuguuaccccacuucucauggcaggggaaagagaggcuuaaagaggucacugaacuguugugaguccuguagugaggaccuaugggaagaggacgcagaacccacgaugagguugauugcaaagccaguccccuucacggcuaacccagagaguccccccaaaccagaagccaagaagcacucugugcaccuagagguguaugucacuauuuuuuuguuuuguuuuuuugagacggaguuuugcucuuguugcccaggcuggagugcaauggugcgaucucaacucacugcaaccuccgccuccuggguucaagcaauucuccugccucagccucccgaguagcugggauuacaggcaugcgccaccacacccggcuaauuuuguauuuuuaguagagacgggguuucuccauguuggucaggguggucuugaacuccugaccucaggugauccacccaccucggccucccaaagugcugagauuacaggcguaagccaccgcacccaaucccuaugucacuauuuuuuaaagggaguauaaccacaauccuauacuaccuuugaagucacugccuacuucuguuaacauacauuaaaaaaaaaaaaaaaaaaagacccaaaaagucccuuugggcuccauguuaccuucacuacuucaccaccaucgacuuucaucagcugccucaaguucugcugcagcaggcugguguuggagcgccauuucaagagccccagaagguccacuggaaacagaaaaugacaaucagaucuucacaagcaagaaacucuguucugucucuguuaaucaugcauuaugugagguucucuauaaaauuuugugaacagagaaaucaacccuauuuuaaaagauucaccugcuaaauauuccauuccuuuguagcaacauacuuaacaccuaguacacuugaauucauuauucccaacgacauuuaccaugaaaugauuuccauguagaagcuuuaaaagugcauuugggaaacuaaaaaagaacuugucuuuccauucuacaggaaggcaguuucagagcaccacaaggccugaagaggccugcucacccagaaagcgcugcccaggcacuggauaccaaaugguuuguuucuccugcucaagaacaagcugcuauuuuuuuauagauaauauaaauaaaauaacuaacacaaauuaaaguacugagacugcaagguuaagaguccccacagcuacaguagcucuggacaacugagaccacgccugcacugagguucacgccugcacugagugagcuuccggcccucaccaugucugggcuuccacagaaguuugugguuguuaugguuguguuuuuguuuguugcauuuuauauagaaaaagcaaggaaugaauauacugguuuuuaaagagucaauguggaagaagacaguguccagaaauguuuuuguuuaaggcaucaagauauucuuuuucuuuuuuuuuuuuuuuuccuugagauggcguuucgcucuugcugcccaggcuggagugcaauggcgcaaucucagcucacugcaaccuccgccuccuggguucaagagauuuuccugccucagccuccgaaguagcuaagauuacaggcgcccgccaccacacccagcuaauuuuuuuuguaguuuuaguggagacaggauuucaccauguuggccaggcugaucucgaacuccugaucgcaggugauccaccugccucagccucccaaagugcugggauuacaagugugagccaccaugccuggcccaagauauucuuuaagguaagaagucaggauccaaaagcucucuaggaaaguacauaugccuacccaaguuucaccugaaguuauauuaacaucccauuacucgaaaaaauaccauuaacaaaguacaucuaauuuaccguuaugcucaugaaccaacuucagcuacagaaacugucuccauaaaagaaagaaucaaaaaacaaaacucuaguuaauacugaagaagaaaaaaaaaacaaacucuaauugugacuauagguagaaaaucaggaaauacagacauccauuauaacuucagcaucaaauuguacaaaaggcaugcaggcaauaagcuccaaaacaaguacagcugacaaagggaagaguuaaaaauagggagacaaaaaaggagcacccaaagaucccguggaagacgcccaagugugggccuaaccaccagcaugcagcaaccacuuggccuggggagguaacuucaccucaguguucucaucugaaccauggguacaguguugccugauucacaaggugguuguaagaauuaacugacaugacguguagaaagcacuuagcagaaugccuaguccaaagcacaaauggcagcagucaucccaggagaggaugacgaauugagcacucuacucuuuuuuauuuauuuauuuauuuauuuauuuauuuauuuauuuauuuuugagacagggucucacucugucauacaggcuggggugcaggagcacaaccacagcucaaugcagccucuaacucccaggcucaagcaauccucccaccacagccucccaaguugcuggggcuacaggugcacgccaccaugcacagcuaauuuuuaguagagacagggacucgccauguugcccaggcuggucuuaaccuccugggcucaugugaaccucacgccucagccucccaaagugcugggauuacagaugugagccacugcaccugggcaacaugucuucauuucuaagugaaagugaaguaauggaaaaggcuccauccugcccagacacacucuugguccuaggguuaagggagauuuccaucucacaagaauuaccaguauuuccuuaauagacaguaauaaucuggauccccuucauucaaaguugguggcacgcuguauuguaaguuugagacaaaguccaauugggcuaaugaguaguaaaacaccuuggagcaaagggagugcuggaagaaaacagggcuuguccagcccccaugaggcugcccaaggcagaugagucccaccccaggcccuuauuaccgggacucacagcccauauucaugacuccuuucuaauuauauagucaguuaauugagaagaggaaucacaucuuguacuucuuucauaucccccacagcaucuagcauaaugcugaggacagagaaguuuaauaccaaccucaaugaauaauucagccacugcguuucccuaaguaauggaacuucgcaggaacaaaucaugguuucagaaaaaugauucccucaaaugagaaugugggaguugaugcuuagacgccauuuggggcagcuccaucuuguacacaccugacaugccacaaucccaagaaggggaaccguggcuggugagaaaugaaaggcagacuucccaucaguccuggugaguggcaucacaucggaauuuccuuguugccuggcaacagcugcugcugagagcagggugcccucucccucagucuggggaggggauuacucugcagcuggugagacuuaaggagcuugagggugaaaggagggauugccacugaccccaccccccggggggauguccugguccacaguccccuuucuccagggucauaaggguuaagaaggauucuguggaugggccucaucaccuaaccgcagcucagagcauugcuuugaauggggaaagaugagcaaguuaaguaaugacuuccgagcaugcuuucggaacaugacccaauuaugagaugauggcuuccugcaccaugagcacugcaacacauggcaccuacugaaaugcuaaaguguggcccaccuggagaugucaccuuuggguuaaauuaggcucuggaugcugucaucugucaggcgaguggagcuaucaaggccacauccagagacuaacaugucacaggggagcauccuuuccauaaccaagucccaaguugagccccgcacugcugaccacaugauaugguuuggcuauguccacacccagaucuuaucuugaauucccacguguugugggagggaccuggugggagguaauugaaucaugggggcaggucuuuccugugcuguucucaugagagugauaagacucaugagaucugaugguuuuaaaaagagaaguuccccugcacaagcucucucucucucuuucucucucucucugccugcggccauccacguaagaugugacuugcuccuccuugccuuccaccacaauugugaggcauccccagucacacagaacuguacauuaaaccucucucuuuuguaaauugcccagucucagguaugucuuuaucagcagcaugaacagggacaaauacacugcacaugccucgggcaugccacuagcaggcucccugugcauucucucccuuccccacugcacggcugcauagaucccacacccagguaaggcuuuucauaugcucauggagaccacuacacaaccacaagcuaggacccuucauaaaugguucgagaaaugcaugcaaauggaauauaaaagugccccaguaggcuuaaggcacuuaagagacuuacugcucccacaccaagcaguuuacucagcagaccagcagugggaaaguguagcccagaacaacagagugcaaagugcagaaacggaaagauccaaaagcauuugacccagggcucgcaugcccaaacaugcagcacacucagugcacgcuccacuacaauguccugacuuccagacaauggcuuuacuuuuguccuguguuuauccuauuaaaguccaaacgaugacugucccuugggcaaauccaaaacuacugccaugauuuacggacaaucccccagagacacaacucaugauagcaacagacaguaauaaucaaaaucuguaucgggcaguuaagaggaaaaaauuggauuuucaagcucugcuucaagagagcauaaagucacucugcacagcugugauacggcugcauuuggaagauucaauuuuuaaauguaggauuucugccucuuccagacggagugacagcaacaacaucagugugcucugaauaagaaguaccccuggcuggacagcaaugucacuggagaggcugcaagcagugguggugcaggcacucaaagcaucggccaaaccccacacaagggcacggcaccagcugauggaugagugaucugccacauuagggcugagcuuuggggugugggagucagcagggggugccuuaucccacagcacgaguagggcuagaaaguaacauccaaaccagcuuuuaaaaauaaagauaacuaguaauuaucucagagaguagcugagaauggggaagacauaaagagggaggugagcucccagcccacuguucauguaacccucacuaagcccuuugaggcaggcacuauucccguaucgacagacaaggaagauaagacccagaaaugugcagaagacuuguugaagggcauccccaggguuaacacagggcuaugguccgauuccagguuuuuagucugacuccaaaucuugugcacuuuccuuuaugucacgcuaccuuccuuuggccaaaaaucauuuuaagaaguaaauccauugcuuuaucucccuuuaagaguaauacagcugggcacaguggcucgugccuguaaucccagcacucugggagaccgaggcgggagguuugccugaacccaggaguuugggaauagccugggcaauaaagugagaccucaucucuauaaaaaauaaaaauaaaauuagccaagcgugaugcugcacaccuguggucccagcuacaugggaagcugaggugggaggaucgccugagccuaggaggacaaggcuggagugaguugagaucacaccacugcacuccagccugggcaacagagcgagacugagaccuugucuuaaaaaauaaaaauaaaaauaaaagaauaacccuuagaccagaguagaagugugaauuuuaaauuacaacaaaugaacaaaugccaccuucuaugcauugauaaaucaucacagcccgaugcaaugaaugccuuaugggugacguucaugcaccuacggagcacaccuccacauaggaaggagcauggaaaagacaggacuggggcagagcuccuggggugaguguguuucuccucucgaacgcaccguucugagucaguuugguggagcacacgagcguggagaucuggaaggaguccuugcuaauggugcagcucccaaggcucugcaugcucuugccgguggccgaguggcccuuuucuuccaacucugccuucguggagggcagacucaaguacguggcagcaucuuccagcuucuuugcuucggccuguggauuuagucaugccguaugucaaaggcaauucacaaacagcaacacaccauuuuugccacccuuuguuaucccuaauccuuguaaccaucguaauugcuuuguaucauauuaaauacacauuuuaauaauuucccuuauuacugcagcauaauucauguucacggcauuuuuagauggcaccuauuguuauauuguauaucaucuuuucccguuaggaacaacaaaagggcuggucauuggaaauguucauuugcauaauuaaauguagcuagauagcagcuuccucacaaugaugggaaagguugguccaggucagggagcccagaaaagacugaaacugucuauagcagcaauauugcaccaaugcaaccagauaccuuauagacgauaagaucgugcucuccgucucgcagggugguaccaucguaucucaucagcuugacaaaugcuagugcaaauauuuucucagauuuauccuuagcuguaaaacaaaaaacaaaaaaauugaugauugcuuucaauuaucaugacaaaauaacauuauaagaagcuacaaaggcuaccuuuaugaaaacaauuacaaaauuauacaaacagguauuaaagcuaaucuaauaaauauauggaaaaauggaccacguuuacaaguaagaagacuccuagcauaaagggaucaguuguucucaaauuaaucuauaaauucaaagccauucuaaucaaaaucucauagaagagauuuuuccuggaacgugaaaacggauuccaggauaaagggccaagaagagcagcauggucuugaagaaggcagaggaaagcccgcaacacuagaaagcgagaguaacuguaaaaugacaaugagaaagacugugugcuuucaaccuaagacgcccagaccagcggaaaucaacagggccuggaaacaagaggccacaguaaacgacagaggcugggaaggggcagaccauuccaccaaggaaacugcgggucaauacagaaaacuaaaaucaauuccugccuugcaauauccaucaugugaauuaccaauggacuaacgaccccaaugugaaauugugcugccuuuggcgagaaaguucaucccccagguaucugcauguggggcucacucgcuucauucaaguuucugccaaaaugucaccuccuccaaagugaccauaucuugucuaaaauagcccauuagucacccaaucacccucuuuccucucaccugauuuauuuucgugauaauucuuaucacuaccagauguuguguuuaugugugugugugacagagagacagagauagagauagagacagagacagagacagagacagagauagagauagauugauagagaaucuuguugaucuuguugcuauuuauuguugguuucauccacuagacccuggaauguaagugaccuuuuguuuuacugccauuuccuaguacaugaaauagagccuggugcccaacagguacucaauccauauuugugccacuuugggagacagucaacaaacaaaugagcuuucagaugauauagaaaacaaaacauugugguuucuuaaggggucacagugacaacggggacaauccaauuuauuagucagaagacaucucucugagaagcuggacagcacauaagccaagaugucaaugcugcaggaagagggggaccuagcgcagaggcccucacgaggaccaguguggcacaucuggggacagaaguccaguguggcuggugacagacagcgagggccaaaggcggggaaggacugauaagccaggacagaugaggaacauggacugaagaaauggaucugccagaaauuccucaaguugcaaucccagcagagcacagaaacagaggaccagagcuggaaacuaucucuacaauuacagauuccgagcuuucucuuuauagaugaaaggacagagaucagagagggagaaugacacauccacccgccuugaguccacggcucaaaauauuuaccgucggaucccacuacccaagacaacauggcuuaucaccuuugccuuccugguugugcucaauacauccuggcaaauuaaaugguuccaugaauaaucaaccagccaaaaaacacaggaagaaacagaaguaaaauauauguacccuaggauucuaaaaaaauaacucuguaaaagggcaccagagcacaugaaauauuucaauguucaaauggcaaagaacagaacaguuccuccuaaguuuggguggacuuggaaacaacggcaacaaaaaagacaugccuccaggaaaacagccaggguucagaaggaugugugacaauaauggucagcagaaggcuucuacugacccuaccaguaaguaguacaguaagugcaccuuuuauuaacauucugcaucuucacauccgaggaauggaccgcuuuuuacugcaugcucacuagcagccaucaugagauggaugguuuauaugacaaguuuacagaaccuuaggaacagcaguagggguuguguguucuggaguguggguagagcugcccauucucuaggccgcccuacccaacaagcccacuacaaucaaggaaaacucagcuccuggccagcugggccugagagcugcaagucugccuggcuccguggaccacacggucuggugcagcuggaguugccgacagguugcuggaaagguauuauguuaacccaucgacaccaaacuuuccaaucccaaggucagaucccaggugagaaaucccaucacuuguucccuuugcuagccuccucuucaggguagcaaguggggaccaauguggccucagcucuuucuaccuguuucugccccagguaucugcaugcagggcuggcuggggaggccccgaaggccauggucagcggccgacauccaggcuuucaucggcaucgcaccugcgaugcucaacauguuuccaaaaucccacaagcuguggccacggagacuucauuuauuaugcagauguguccugguauguugggugauagcaucuugucuauaaugaguacuuaaaacugacaagaaaaacaaggauuuugaaaauuaaaaugcuacaggagcuaucgcucugcccuaguguaauuuauuaauuagagagaaugagcuuguuaaaagacgggagcguaauuuugagacgaguccucuguggauuccagaaccccguucuuaaccugcuuccuccgugggccucaaggugauauaugcguggagcccuagagggucuggggcacacugcagcccacuaggcuggcccccaccaugcccuccaugccuuggucgaggacacaccugugcccacagccacccccauuccaccagcacccuccgcucacaucauaccucugccuaauucaugugauacucacaggcugccacgcccuagcugguucuugcaaacuaaucucaaaccucaacucaaaccuaagcucugcaagaggagaaaccccagcagcuuguuguguauacagcaggaacucaauaaaagccaaaggaaagaaguggccucgccacucccccaaggcauuggagcauaaggcucgggcacaaggaccuggcuuagaaccaaagcucuuccacugacuaccugggugccuuucagccccugaccugggguuuccaagccccaguuuccucaucuguaaugugggaaguaauaauacugauaccacaugggaaucuugcgaggacgaauccaaauaacacaauaaacuucuugugucgggcacaugauaagagcauagugaacgauggccaacaucugcugauaguuguuauuauccuacagcuucggccaccaaggauguugugcaccauuagcagauccgacuuggucuggggucugguagccuggaucugauccuggggcaaggaugagauggcagggaacugccuuccaagcuggcggccuuccugccccugcuucucccguuagacauaaaccugaugcccuuguaacugaaccccuggccugcaugcacuguugggacaggacaggaaugcaaugaugcuuucggcagcugccagccaccacccaccccccgcacucccccgccaugcaccacccaccaccaggcacuccaugcugcuugaaaccccuccagucagccacaucccaggccgggccccaccacacacacaucugccauugacagucaugggccggcaccccagcucugcagaccacacaccaggccucuccaacuccccugaacaacagcaggcccaagcuucucgaugaucugcacaccauaacaucaugaccgugcucgugcauuugcucuccaggcugcucuccugcagccccccuguccaggcacacccaccccacauggagggcccagggcaggccaggccccagaaauagucaggugaaugaacacauuauuccagcagcagcaacuacaauggagccccuauccauaccaggcagcgugccagaagguggccagccuccaccuugccugaccuucaagaauacccuaggaggaagguuuaauguuuuuuuuguuuugcuuuuuguuuuugagacagggucucacucuguuccccaggcugaagugcaguggugcaaucacagcucacugcaaccucugccucccggguucaagcaauccuccugccucagccuccugagcagcugagacuacagguauaccaucacaccaggauaacuguuuuaguaaagaucgggucucacuguguugcccaagcuggucucaaacuccggggcucaagcaaucuuccaccuuggcuucccaaaguucugggauuacaggugugagccacggcaccagccagaaagguauucuuauccucaaaugaagauacagaagaggcucaugcuuaagcuccauccagagcacacagaaccugaaacugcccacugcacggugugacccccacggggucaucagugacaaagggcggucugcccuccacaccacucuuuuccuuuaacugccugcggcacacaagccuguagccaacucucuuugucauuuauugucccaaauaugaauaugucucaguucccaaugccaaagagacacacacccugaaagacgggaaucauguuuuccuucugugauaucuuacugucuagcacagggcuacagcuuuaguugacaauuaauuuaacaaaaugugauggaacaaauuucagucaucaauaauaaauucuuuuugaaggagagugauucaaauagcaguucuuuccuccuaaagucuuggcaccauggucaguauucacaaaaaugucuaugagaaaagccaucccugagcuccagacagcaagggccaccaaggaagacaaaaaggguucaagauuuccaauucuaagacaggcaccuuaagagcccauguuugagagguauuuguuacagcucaguaacuuuucugauggauggcauggauggauggcaagucaacacggaagacuggaaagcaaaagaaagaaggggaccagcaacacuggguaggaggaacuggagaaggaaauuaagaucuccuccugagaucugcucaaggaaaagagagaagaauguuuccaaggaauagguuccggugggaaaugagccuuauuguguuaugauagcgaguuccagaacaacugagaguggccucucgcgcuuucccccaguucucccuuaaaaauacuugggggaagaaagugcuugacuacucacaguccugugaugaccuguggcggaagguaaaccgaaggugacugcgguuaacguccucgaugggaauggccaccuucaagaauugaaaaagaaguuuaagcacuguuaucaauaucauccagcguaacagcuuuauucaacuggagcuaucagguacaacuguaaacauuucuaacugcaguggugaaaauacuguacaccuaguccccuauaugauuuuuccaaagacaaaaugccucugcaaaauuuuguaucauauuguaacagcugccaagccaacugacuccgugacacagcugaauuuuuuuuucugaaugcucugaccauuacuguuaagauucuuuuuucuuucuuuuuuuuuuuuugauacagaguuucgcucuuguugcccaggcuagaguggugcaauggcucgaucuuggcucaccacaaccuccgccuccugcguucaagcgauucuccugccucagccucucgaguagcugggauuacaggcaugcgccaccacacccagcuaauuuuguguauuuaguagagaagguuuuuccauguuaggcuggccucaaacuccugaccucagaugaucugcccaccucagccucccaaagugcugggauuacaagugugagccaccacauccggccaagauucuacuuuuaaacguugcuguuuuugggccgggcaugguggcucaugccuguaaucccagcagucugggaggccgaggaggguggaucacuugaggucaggaguucgagaccagccuggccaacaugauaaaaccccaacucuacuaaaaauaccaaaaacauuagccaggcaucaugguacaugccuguaaucccagcuacucaggaagcugaggcaagagaaucgcuugaacccaggaaguggagguugcagugagccgagauugcaccacugcacuccagucugggugacagaaugagacuccgucucaaaaaaagaaaaguugccguuuuucuucuuagccccaaccuggaagggucuauauuccuuccacagcuguggugaccugcccacagcugcgccaaaaaagcuuuccuguugucacauuacacucaaagaaaaaagaccuaauacaugcugccucuaagcaaaaauugucccuaauucucacaucaaacaucuguauuccagagccaaccccuggccugguuuucaaauauucaagcucuuggcggugagacgguguuuacuccaucguggagaugugagcacgcugcauuaugaaaaggcaccauaucagagcuacagaacaggaucccacuccccagcaaugaccuccacaggcuggcagcucgguuuuuuuguuugguguaaagacagcaugccacacauaaaacaguacugggaagagaaagacaauagcuaucuuaaaaagacucugucauuugucuccaugaacguccuauuuuuacguccaaaaggagaugagaguaaauguauucuaagaaacaccagugugguuccuuagcaaccuugaaugacuuuguugggagacacucugccugccuggagcagcucccgggcugaggaggauguuaggauguuuccuuggguuacaaaugagcauuucauaaucagcgccaugugauaaaaugaccauguaaauaauaccuuaacagucucaaaccagcguggcugcuuuacuugguaguaaaucacagauuuguacucugaaaucgcuucaucaccagcacccgggaaaaucacaugcuuuaaaagaagacauaaagagcucacguaagaccucauagagcuugacaccauauacaucucccacuauauauguggggggacagguacgcuccaagaacaccaacacacccccaccacaaaugaacacguucccagcaagggaagcacagauccaccugaagccagcggccagcuccaaccccuguucucacacauugaagaucuugaugguuaugacacauggggaugacacugaccuccaguuccccagacccucaacccuaauaacuuuaacauuaggaucugcaggaaguugccugauccgucccauaggucuagggugagggacuguagacuaaaaagugggaacccuccccuccccuuccuccagccaugaacacuguuugcuucacuccaaccagaaagaccaguggcaagggcagcaccuauguuuccagggagacgaggcaggcagugaugcuggacagaguucacccagagagaaagacauaaugcuucucuuggcgacacugagccuuaggcacaaccccaugggcccagaaaagcccaguccuccagcacuggugcaaagaggcaccucacagggacagcagcucugauuugaccucuggucaucagaggaggcaauagcuucuaaguaccucccagguggacccugcaggcugcuguggccacggaagcagaucuucaugaucgccgguagguagagcacgaggucagagcucuggcugucaugagcaggugcucaguuccaccccuagagcucucuaacgcugagcaauuuaauugauuucuuagggccuucauuuuucuucaucucucaaaucguaacaaugguaucuguacuucuagugugacugcuagaccuuuaggccuugggcuugugacagcaaaugagacuccacgauaagguugggcaaagguggucaagaccacagggaccugcucgggcacuguggcucacgccuguaaucccagcaccuugguaggccaaggcgggcggauuauuugaggucaacauggugaaaccccaucucuacuaaaaaauauaaaaauuagccaggcacgguggcacacaccugcagcacuccagccugggcaacagagcuagacuccaucucaaaaaaaaaaaaaaaaaagaccacagggaccuccugagauaggccagcugccaggaccagaggaccccaggcccugcauggcaagcuggagaaaaggaaacaagaaccaacgccaaucccaagaaacgggacuccaaagccccacccugacgacaucuaugcuguagcagagccaaggugagcacuuggcaaguaaaacugaaacacuacagaugagcccucgccacaauaaauaccucuaaucguuucccauccucaucguacacagacaccgugaccuccacguucuucgcuguuguuuugcuuccuuuaucaaaaucuccuugaacuaauguuacauagauaucauuucgaacaucaccugaggggggagaaaucauacauuuaaaaaacaauccauuauuaauagcguaauugugaauuuugcaagacugucuaccuauccucauagauuauuacaaauacauauuagaugauuaugaaauauuuucuacaaaacagucucaccauuuaaauacaugacaagagcaauuuucaucaugauaaaguuuucuagaaagaggaaaaaucucaaaguuuccaaugaucugcuugguuaucaucugggcagaggacacucuaccccucucaggguagccgacaaccagaggggcuccaauacuauugauggcauccaugacccauggcagcccacaccauugucccuuguuagacggcuggcuacggcugucugaguccucaguagccaaggacuaucgcaguauccacuggcacucccagguaacuggcaagguugccuccuaugcauucuucuuaaaagcaugacuccaagaguugaacuaaaaguugauuaagaaugaggaccggccaggcgagguggcucaccccugugaucccaucacuuugggaugccgagguggguagaucacuugaggucaggaguucaagaccagccuggccaacauggugaacccucaucucuacuaaaaauacaaaaauuagcuacugggcgugguggugcaggccuguaaucccagcuacucgggaggcagaaguugccgcaaaccgagauccugccacugcacuccagccucagcaacagagcaaaacuccgucucaaaagcgagcuaaugggugcagcacgccaacauggcacaugcauacauauguaacaaaccugcacguugugcacauguacccuaaaacuuaaaauaauaaaauaaaauaaaaauaaagaaaaaaagaaugaggaucaccagccuagaaucagggaggaaaaacgggucuagggagaaacuuucugcauggcucuucccuucuggcaggcagcuaucaggaucccgaauggggaccacagagagaagaacaaaacagaccugucuguuuuaaagugagaugggcuuuuaauuguaggggguaaaaaaaacgcaagaaaugagcucaagacucuucuuccuacugagaacauaggaagccccugguaauggcccaacugggagaacuucacaagcuucauuaguaacaugauuuagaggaagccucguucccagccacugcuccucugcugccugccuggccaccucccacgcccugaccacccgcucucccaaggagccaaagagcgguuccgucaagagcagcaaaugcccauucuggcugaagaccaaggaucccuuaaggaaaauaacucucuuugcuccuugcuuucuuguuuuggcuuuuuuuuuucuuuuaaacugcucuauuuuggcuuuuaauguauccaacuauuaaauuaagcuuucauuuaaaagucauuaucaucauaaucccaguggguugccaccacagccacaguagcuguguggaaggaggcgcggcugccgcccacugauacugaccacgagaagaaccguggagcacaggacgaggggcaggugcaaggccacccaaccaagacuuguugcucauuugcugugugaccuuggacaagucacuuagccuccaaggccagcaccacuaaacagccucacugauaaggaaggcauaaacuccaugaucucucagccuaaaaauucuaucaaggcacaaacaccaucaucaaaaaagaacuucaaggccgggugcaguggcucacgccuguaaucccagcgcuuugcgaggcucaggugggugaauugccugagcucgggaguuugagaccagccugggcaacacagugaacccccgucucuauuaaaauaaaaagauuagccaggcaugguagugcgugccuguaaucucagcuacuccggaggcucaggcaggagaacugcuugaaacugggaggcagacguugcggugagcugagaucgugcuacugcacuccagcccgggugacagggcgaaacucccacagccucacucccaaguacaccucaagugcguuacuccagggccagcacagaaguaagaccucauuuacaguaagcaaaccccacaaaugggcauucaccauagacccucaucaaaugccuccccagguuacagaacauucuggggaagaaggaacuagaagcagacauaguggacuccugcuaccuucccagcucaaaggaaaacuuggcaucgccugccuggauccuucauaaggauuccaggaguccaacgagcuaugagaaaguagcagagcaggccgcugggugaugggacaggcucugcgcuguccaaagaagacgcgcaucccugcagacagugacaaaaccgggugauacacagguucugcaggcuaaagacagcgagacagacugauaaccgcccauacucucucucucucuggugcccacagcgcggccagugauuacucggccaacagagaacgcagaugacccacccaagcuagaaucacuuccugugagauauauacccgaggacucagcacauggaaccugccagaacaauggucaacuguaucauuucccuaugaaucuaucaugagaugaucuacaaguuuagacuuaguuuuuuuuuuuuuugagacagguucucucucugucacucaagcuggagugcagugguugugaucauggcucacuacggcuuugaccuccugugcuccagggauccucccaccucagccucccuaguaccugcuacuagcagcuacuaccuggcacucaccaccacgccgggccuagacuuaguuuuuaagucuauccaucauaagggaaacacuauuggcaugaacuggaagcuucugaguuucccuuugaacaugaggacauccuaaggaugccaagauaaaugcauauugccaauugcuucauccuaauuuauaaaucuguaucucaaaugcaaauacaaauaauaaguauacaaauuaguccacucccauuaauaaaccuaaauuaauuuccugcauauagacuggacacacacaagcaauagcuucagaauugacuaaacgucaugcuuuucuuucuguacagguaagccuagcuauuauuuagccuaaccaauuuagaugucuuucauauggauuuaccagaccgacuauucaaugacccacaacagcccugaaagacaaaaggaguagaaagaaugugucuugaaguugcacuaaaguaagcaaagcaguaacuccuacagcaugcacccugaauagccaccacucuccuggcuauacagcacaggccuauaaaaggaggccgcguugaauaugggggaguuuguccccguuuccacggcucauuagcugagcgacuuuaggcuacaguuuaaucuggauaggaauucacucaacaccaauuugugggcuuccaagagccucacgugguucaaguuaguuuuguuuugagacagggucucaaucugucgcccaggcuagagugcaguggcgugaucugugcucacagcaaccucugccucccagguucaagugauuccuccaccucagccccccaaaguaacuagaaugacaggcauaugccaccacgcccagcuaguuuuuuuauuuuuuugucaagacgggguuucgccauguuccccaggguggucucgaacccgaguucaagugauccccccgccucgaacucccaaagugcuaggauuacaggcaugagccacuacgcccugccaagccacguaagcauuacuugcaaaccaaaaaguaucacacggauauaaaggauacaaauuaacaugcuuccaaagaucucuugaugaucaaaucagauuauuaggaacguuauuuggaaaaugaaaaguauuauguaaauaugagauuaauguuaacacgcaaauccuguuaucggucaguuuagaauucaugacuuagaauucauggaggaaugccaguauaacguacacuagcugagcgggcgcaggcacaggcauuuccauucagcgaccauccaacccugccauuugcccuaagugggcuucacaaugggcagcucccuuucugaccucuuucuucuuuugaccugaugucuacccagacauuugcugggugcccacgccccccucacacaauccuugcagcuggggagagcugauccauccagggguacagggggccagggagcauauucuaccacuccggucacagccccaugauccauaaccaugcuggggcuuacagggucaccuaccaggagcugagcccuuuccuugccagagcucauacaugaugcugcccacacgucauccuccguggccggcuacccccaugccaugcugagaagcccugaacaagccaguucuuaccaggcaugauuaucuccggaaacccuguuuuucgagccacagcugugguccuguccacuaaaugcggaaacucuuuucggaucugauggauaucuccaggaaguaauuucaauguuacccacaaaccuggaaaaacaauggaugcucuuaagucgcauuuuauccuaugcauuuuuagaaguuuucacgaaaccaauuucaaugaaugagagacuuuuaauucacaauucaacaucuugagagaaaagguggguauaugagaaagagaggggcaaggcaaaaggugccugucguggggacuccaugcauccaacgagcugggaugccagcccugcccuagggugacucacagacagcugaacgcacaucagcagcugcugugcacccacugugcugcugaggaaugccaaggaccaaugucucuuuugaguggguagacauuuaagauaaaucagcaggccaccuuuuucuaggagguggcugagaagucugucauuuucuagucucccaggaaagacaaaggcaggggaggauucuggaggugaauucguagcuucgagaacccaucaaaguuucaaguagcuaagcagcaucacacaaccugggcgagcaguggagcaccagucugcagggccaccagcaggacagcccuccgcagccaggacaggugcagccuguggagcccaggcccucuguaccacagugccaccgcaaaagaaaacaaagccccagccgcucucggcucuuuucuccaagagagaaaugaagacuuucaaagccucuaaaccuagaugccagggguauccuggggagagggcaguaaacccgguggggucuauguguaagggcgugugugcgggaugugcgcgggaucuuccucccugcaaggcugacaaagaacugugguuuguauaaauacugaguagcaaccaaauaggaggugacaguacaaggaaacaagccacacauuccaacaagucaaaggcggggcaggcaggggcucggccugagcugucuucuacgacgacggcaucuuuuccccccaugggaaggggcuggcacuauaagccagcacaugggggugcucugucccugaggccucagggggggcugccugcuugcuuccccccacucagcuugguagggccucaucugccccucagaacaucaaagccucuguccucauuucugcuacuagcauggguaugcgcgcaugccuguggcugugcguaugucugugugagucacugugugucuguguaucuguaucugugcaugugugugugugugucuguguguccaugugugucuguacacgugugugucugugugugucucuguguaucugugucuguguaucuguaugcguguggcuaaaucugugucugucuguguuucuguaucugugucuuucuguaucuguauguaugucugugucuguaucuguauguaugucugugucuguaucugugcuuauguguauaucuguaucugugugaguguauauauauaugucugugugcgugucugugucuauacccaugugugugucugugugugucuauauguauaucugaguggaaggggcugucuguaucugugugugucuguguuuaauggugucugcaucugugugugcguguguaugugugguguaucuguguguguguguguguuuguggugucuguaucuguguguguaugucuguuuuuaugguguaucauguguugguguguauguguuugugguguaucuguguuuauggugucugcaucugugugugugugugugugugugugguaucuguaucugcauaucuguguuuauuuguggugucuguaucugugugugugugcguguguauguauuugugguauaucucugugugucugugguguguguguguguguggugugugguguaucuguguuuguggugucugcaucuguguguuugugguguaucuguguguguguuuaugguaucuguguguguguauguguaguguaucuguguguguguuuguggugucuguaucugugugugugcgcgugugucuguguuugugguguuuauaucuguguuagugugugugugugugguguguguguguguaugugcguaugucuguguuugugguauuuguaucuguguguguguaugugugcauguguguguguguaugugugugugugugcagcuguccccucuucagaugccuccagagcagaaccugcccuccaucacccucagcucagcgcccugcccugcguggaaggaacugagacagucacaggccuguucuccagcagccugccuucugagcagcacugggagguaaccgacagcggugccggcaccuccggcugucccugacgggagcagcccugcuugauucaaucccgcaccucacgcccuguccucuggcugcccauuccuauauccgcuauccuggaaauggcauucuccuuugcucagauuuccauuagcuggagcugagaagucaaaagucacugaugauguuuuguucuuugccagcuggugaaacccccuuuccucuugcuaucuagugagucccucuaauuuauucaaaaguagcuacugagcaccuacuaugugccaggcaaauacugggcacugcaccuacuggagacauagggcagacccucacgaccuccccugacagguguuuagcuuccauugccaacggucaaacacuaacuccauggucucuuagagaaauaugcaacugcgaaguucucacgggagaaguccugagcacacugcaaggcauccugggaccacagucucaagggucacagaggaagggacuucggggcugagaccugcaggaagugagggaacugcaggccuguccucacccaggggagguggagcccccagacgcugugguaagacagugcggaggcugggguggcagggacuguggucuaucugaaggauggggggcacccagaguggggcucaggaacaagagucaggcucugaccugacacccuguggcuacagggaauggguaggcaggagaacagagcacaguggggauggaaucgcagcagggaggccaccgcaugauccuagcuggcuggcaggacgugaaugccacuauggagggugggagagggaccagcgugaaggucaagucagcagaaccacggggaguugggguaggaggaggcgcagcuuacagagacggugccccuugcaggcacaaccacuagcaagucccgggggcaccguuccuugaaauaggaagacccgcucgcuccaggcagagcugccugaagggcaagcacccagaguggggaaggaaagaagagccccgaagaggcaggagaaaggcccacuuugagagcucacaaggggacagagaccucagagauaacaggggaaauggaaaacugggacagauggugcccaugcagccacagggcuccuggugggagacgggggcagagggggcgggggcgcucagggagagggccgaugcugggaggcagaagggugaagaugaaugggagacgaagaccagagggagaggccacauagacagagacagauguauuacucaggguaggacugcuucuugguguuucuuuucuuuccuuuuuuuuuuuaaauauuuuuuuucuuuuuccuuucuuuuuaagauaugaaauuccagaucaugggagggagaguuugaagaaggaagaaccaccaauagaaagcgguccccaaagagguaucggggauggcacccagacaggagcacauguaccacugcccagaaugugcauuucacuagacaagugaccacaaaaggcaagugggagcuaaacccugccucuacucgcucacagagccacagguccuggcgcuggcugcaucucccuacucaccugguugaugaggccccuuuuucuaauucacacaaaagcacccugagcuaacagcagcuccagaccugcagaauagguaagcagacagaugggcaaagggccaggcacuuccucacccuaacccccagcccuggccuccgggagagcaaaccaaagcccagacccugacagaagagccugaggaacuggcaccguggcucacagggagcuggucuucccugggacaccaggaugcagcuaagaguuucucaaaucucaggaguuugaguccaaaagccucccuggagaaugaauguccacaaaauauaucuuacagaaagaugcucuuugaaggauugcaggauguggugaggucauuaucuacagaggucaaagguugagacaugaggauggaacacuuaacacuuaauauuagaaauccuguguuucaaacaccuuucucagaaacgccggccugcgcaaauaucuuaauacauaaacuaaugcacuagugacacauuaaauuuauuaccacacgcuuuaaaaauggaaauuaaauguuccugauuaugcuguguuuuaaaugcuuuucucacaggagaaaaaagugcauuugggguugacauuugcuuaagcagaauaacuaaaaacaaagaggauuagcauacauucuaucucaaacaacagaaccagaugucuggagucuucaugaauucacuguccacauaaaaugucccacaccucuggguucagggaucagaauaauuuggauuaaauauucaggauuuuugucucuugugaagaggaaacauguuggcauaaaccaaaaacuggccaaggccaaguggugagcucaagagacaggaggcgcauguggacagaggugugaaaaaacccagugguucucucugaagaugaguaucuccuccaugucccuuccacuccuggggccgcuaacagucacuugacagacaagcaaggaucagguuaagccugggcugcuggugauaaaaugagcgccggugggcagcgcccugcagucccggcggccgaucuguguggcugcccucacuggccacaucacucaccucugaccugaauuccacccaccauugugcccuggagaaaauucagguucaaggaaaacaagcacuagucauguugccuaaggccauucugauucaggaagucaccugugauccccuugacaaaacuaucacuguucuucucccucaguuuucacugugacuugaaaaugcccacuccucccagaaguucaaggaacuggacccccggacaugagcccaagguucgccggcuucaaagauccuggccacacaccagugagccuggcagaggcaggcuucugguccucuuucccagugauuuccugcuggccugacaccaaacuccacuuucccugaaugacucuaauaaaaguuuaucaaaacuccgaugacugcaaaagaaacuggagauccgagggcagucccagcucgaagcacugaaggaucggcuggcaaccuuugcacuggcacucccagccugagagugacuccaaucuaaacagcccuaauuggaccuccccgugguuuucaauuaaaguguaaauugggagggcuguuaauuuaggagaagauggguccugggucagcugaaaaucgcucugucugcagaggccacaucucauuaacguucuggguugggguuuuuguccugcuacuguuugccagaaagggggguaguucacaccagaagaaagcuggaggucccugcagaucccuaggaaggcucauucucuaaaacauucuucaggcucaauucacauucuccuuuagaacaguggaaaugaaucaagauaauuguuuuuuaaaagucuagugacauaagguagcuggacgaugaagcaggucuguucaccuaagcucuaccgcguuuacgggcagucugcauggaucagggagugagacggucaaguucugaaggugacuuccccuugggcuggaggcggggccucagucacaguuguuuccuggcagcccuccuggccagccaagugccaacugucaccagcccgaggugacugauucauuccuucugccagcagcaggucagcugcucagaaacgugucagugcaggauuaaaaacagugagugugaggcggaguguaggggcggagaaaucacuuaaaugacagaacucaggggagcaagucugcacaaaugaaaucaccuucuuagggagaccagcagggaagacccagaacaggcaaagauuagcacacaacacgggcagagggaguuacgccuaccgccugcauguuccucuaaacuucuaaucugaccccacucuccauccaggagugggcucucagcaauguucacaaaggugacgggcaagaaaaccaucaugcacuguacacaggggcaacugucacacacauucuccaccacgaucacugucauccccaucauuaucaccaccaucaugaucaacaucaaacuaaaaccaacccagacagcacugccccaacgcaugcaaauacacgcugauagaaacaaaauaggaaaauacguacccugccccuugugguugacuucuuuggcagcgaugacuuuguuuauaacagucugaaggaagucauucuccccugccacccugggugaaaaacgggaugacauguucagcggcuugugucgaauggcgucguccaacgcgagccuggagggcacgggacgaccaagaccacaggagacaaaggggcacagagacccaugggccacgguaacaagggaacauaagagaucaucgucaccgagugcgagagggaggcaucaugagucaacgcacgacaaaggaugggagaggugacaagagaaacagggaaaagcauugaucaggaaaaugcugaaccacgagagggaacagagcaaaugagggcaacccucuccccaggaauaaacgugcaccaggccuccacugcaucuccaucagacucuuguguuuaaaaaaaggagcuugucugaaagccacaugguugaaaggcauuuaaucccaaagaauguuuauggccauuccuccaauuucaauuaauucugaacauagcauaggucaaggggcagguugaucuaaagggaaaagcaaaaucaagauuuaaaaaaaaaaaaaucccuggaaccuaacugcuugcaaaggcuuucuacucuacccuccuggacuacguacacaauagucccucaagugacuacaugugagaagaaugguaccguguguggagaacaccacugccuagucccacguguggcgcuguuaugaacacagaccacccacguuuucagggcccaugaaccaggagccugugacagaugcugcgcuguacgagagacuggcuacaaacggggggcauaugcccaaauagaaauaccauguagcacagcgaagugcacuaugaaaugagcaagaaaauagacagcauggccauaauguuuaaaaucaauccugggaacaaggacagugcuauccaucacuugagccacaugacucgagggaacugaagacuguugucauuuacgucaccaaguuaaaaaagacagggagggagggagaugugcaaugugcuuccuucucuaaaaccaacccugugagauaauaaaucaguuuuaauggagcaaaaaaugguuucauuagcacgacauuucccaaagaacugguuucacugcuuauuuugcuauuaaaaaucaugcuguucuuuuguuuccaacacuucaaauauucaucugucuauuagucuuccuuuaauggagcauggagucacaaauuacauaagaguuacacauggaauaacauauuuuucaaguggacauuccacuacaagauagaaaaagauggcgucaaagcacaggcaaucucaaacaacucauaacauguucugugaaaaucagugaaucuaaaacuaauaaccucccuaaccuuucaaacaaucccucagguuggguuuguuuuuguuuuuguuuuuguuuuugacuuuucacagaggacacuagcaggcaacagguaauuucaacuuaguguuacaucugggcaucaagaaccucugaggucuaauauauaauacagcauucaaaacagcagggggcugcauuauuucucaugagagaaugaggcaauuuaauauuauaauuuuacaaagguguauuuuauuuaugaccucaauaucugcccauguuccaugauacuguuccccuuguuugcuaaggaaacuuccagauucugcagcacuguguucccuuuauaaacucuccucacuggaugggacuacaaaacaacauaauccagcagagcuuucugcagugcuggagaugugcuauguaugugcugcccaggacggggccacugaccuccccugcugcugaacacuugaaacaggaccaaugugacugaagaacuaaauguuuaaugcuacuucauucuaauuacuauuaucauugagacagaaucucccucugucgcccaggcuggagugcaguggcgugaucuuggcucauugcaaccucugccucccggguucaagcgauucuccugccucagccucccaaguagcugggauuacaggcaccugccgccacacccggcuaauuuuuguauuuuuaguaguuaugggguuucaccauguuggccaggcuggucucgaacuccugaccucaggugauccuccugccucggccucccaaagugcugggauuacaggcaugagccacugcgcccagcucauuuuaaguauuuuaaauagccacauggagcuaaugguuaccauauuggacaggagaguaaaccuaaagcauuuaagccacaaagagaccuuugccucuaguugugcaugcugagauacauauaacuuaacccugacucccagcucaauaacgcaggguuugcuguuauucuuacgucaagaagauagcaaaaucuccuacugagcuguacaaaaagcuuuagggugcuaugugaccacaucgcccgccugcaaagaaagccauacucuuccugucuuagccaguggcacucaagacccagaggagucgggugggguugagcgcggugguccaucaccaaggaugcguggggcagagggaagucaaccucacaucuccgggcccccaaggacagggcuccuucagccacccaauuacuacccgccuccuaaacccuucagccaacagcugaaaaccguaaaauuucuaaaaucugaaauguguuucaagucugaagucgauuaagaauaaaaaugagggaaaagugaaacugcagagcacuauggcagguggcuuccacugcccuuaccaugccuucuccccuaacaucgccacccaaccccacgcccaggaggaagcugucucuuacaauuaaccucaaccaucuggauuccuuuuucucuccuccucugugaggaguaggagugcuuaaguggccaacgaccaucaucuggguacacucuugcuuccacacgagggaaauaaacgccaguucuucccaccaguucccuggguucuacccacaaaucagauaaucaauuuaaugaaucuccuccaagagcuuuuucucagcuuccgugccucuuuaaagacuucaggucagaacuagagaaagccuaaaaacgaacacagauaggcuccacucuaagcaaaaaccgagacacaaaaaucagcagugugauuauaugcuuuaaagcauuauuucucgcuuuaaaauaauucaucauaauuguuuguuuuuuuauuuuaaaaacagcaaccuccuaugaugaauuuggaaguauugugcuuugaaaauacaaauagcuacuagaauaaaucaauuauguaaagaaacauucaggcucagagcagagcuguaacucugugccuucuauauaaggcaauucagugauuacaaguaaaaucuccuacuuccaggaccauaaacaaacuuugacccaggauucuuauggcuacaaaaaauuccauguacuacagcagugacuaaagagguuuuucauaauuacaaaauaaucaauccuuaguuauguuuauccauuuaauuauaaagauaauuauuacaagccuauguuuuccacauuauaucuggcuaaguacuugaauugcuccauacuuacggcugaaagggaaugaaaugcugcuuaucuucaucaucuacuuuuccauuuauuauaucuguuacauccaucacuggagacaaaaagagaacagagauuguuuuggcuuaaaugcuauaaucacagaacacaaacaaacaaaggaacaucagaauaucuucuggcaaacaacagcaaaagcuguuuucucauagucaagucuaaauuauuuccaugcuugaaagacaaauuaaguuaucagaaaaugcuggcccaaauggaauuggggcucaaauggcagaguuccauuuaauaauuuccuuugccuauuacccaacugucacccuagagcugcccuguccaauagaacuuucuguaaugauggaaaauguuccauuaacaacaagcaacgaaaaugugaaagcauaggccaggcgcaguggcucacaccuguaaucccagcacuuugggagaccaaggcaggcacagugcuugagcccaggaguucgagacuagccuggguaacaugacaaaaccccaucucuacaagaaauacaaaaauuauccaggcgugguggugugcaccuguagucccagcuacucaggaagcugagaugggagacuugcuugggcccaggagguggagguugcagugaacagaauucacaccacugcccuccagccugagugacagagugagacccugccacaaaacaaaagaaaaaaagaaaauguagaaagcgugauggaggaacugaaaauuuacuuuuauuucauucauuuaauuuaaauuuaacuagucacaugugacaagugguuaccacgcuggccagcacuguucugaagccucacacuuuugcuuucccgcaaacaauuaagccaacaaguagcuaccauuuaccaagcacccaccacaugcugguaucuguggacgcucuuucaagaggacacuucaaggcaaauccucaguaaccuaccauacugacaagaaacugaggcucaaagacaggcaugaacaagcaugcucaaagucuacagcgagaaagucuccaagacccaagcucuuucaauccuauuaaacugccuucacaaacacaccccccgggagauccaggcuugcuaacaucacaagaaaggcuaauauccuuugccaucuucuuguguuaaaagacauucccugaugacauucagggguaaacccagacacacugucuaccuuucaaacaauuccuuuugcccuuggucaugacagaacaagaaaguccaagaauaaccccagauggcccgggucacuuucccugugucugcuacugcuccaccgccacacuggacuugagaggaagaugccuuguuuauuuucuucgcacaagaccuuuccccagaagggucucucuguagcccagcucugcguucagguaagaggaucagucuaaauauauuuuguccaacauguaaguaaucauauauugaaaauuuuccuuucuaccaucaccaucaccacccuccaaaaaggaggagggauacauagaaccaaaaaagcagcauccucauccccuguuuggucugguggggccccaggggccucagcagugucguaagagacgacacccacacucacuccacucaaccaaggggccucaaagagccaggagcccacggcuguguuugcagauacaggucaaagaaucccaaauaacuugcaacaucaaaugacagcugcucagaggaugcauggucuggacacgggcccucaccuggccugggggaagcguuucccagcuuccagcacucuugggggugacugacccacacgcgacugacugcagcacccaccuuuuuaccuuuuuccaagaugcccgagaccaccaguucagcauccuucaauaaacucauuuaggcagcagcccacgaugagccagaaccaagggagucugacccgagcaggcccacccucacaugccagcugguccuggguggccuugcugggugccugcagagcucugcucugccaugggacucaucucaccagcugaccaugggacucccuugccacauccccagugcccagcccuggaacacaggaccaugugcaggaaggcagcaaacaagcgggaaacgcaaucagagccugagcacccacagguggaaaacaccccgagucccgcacccauccugagccucgaggagaaggccuugacgucaccagucaucaccgcucaucgcgcuucccagggacuccccugacugcucuuccgcacacagccccacgcagagggagugcucccugcaguuuggacaagaugucccugacaccaaaggaggaaauaaaggacuugggggaaaaauucccccagccagccagcccagggucucuacauucagggaagaggauggugaaaagacagaguccagcugaagucaguacagcugugugagggagaggccggguagacagacggcaccgcgugaugcuggaagacagagggcaggagaaggaaggaggcaguggcguugggacaagagugacagaggcccagggccagcacaggcaggagagcagaaggcaggaggugagaaacgucucgcagggagaggggcugauggcucagucccacugguggggcugcaucaggaugacuugcucacggcagauggacccccacacccugcgagucagcaacuccgcugcaggggcuggccugcaaacaggcacaggugggaugcuucaagccccaggaugcucacugcguagcuacuacaccgcaaggcugagauaaccucagagcccaaagcaaaggacugcuggaaucacaggacuacaggcugcagccauugagaagccgaauuuuugaauaaugcuuaauaaaaggacauguucauaagauaaugcuagguuuguuagaaagauaaaaguaugugcaaugcaaacauacuuacuacugaacugcacgccuaaaaaugguuaagauggcaaaaaagggacuaaaaagacauuaaaaaaucaaucaguuaaauaaacaaauacaugguaggacgggauauuguauuuaaaaaucauaugccacacacagaaaaaauaauuuggaaacaaacauaucagaauaaacaugagguacuacccuggcuauguaaaacuauggauaauuuauuuaacuacacuuuuccauaaaauuuccauuauuuuuacaauuuucuaucuuuuagaaaaagauagaaaagguuacauuauaaaaagguuaaaagacagaaaugugacacauucuuuucaaccgaagacuaagaacuguagacuuaaagguccauggacacuuucucauuuuaaggaacugaacucuguuaacacagacacgcagaagucauucuaaagaaagccucaaaauuaaauuugcauguggaaauugaaguagccuaugaacagauagaauacgauuaccaaaauguugaucaaccuucucagaugugggaagcaucccuucuaucccuuuuuuuuuucuuuuugagugucucacucuguugccuaggcugaagugcagugguacaaucacgguucacagcaaccucaaccucccaagcucaggcaaucccuccugccuuggccaccccaagcaugcgccaccacgaccggcuaauuuuuguuuuuuaguuuuuuuggguagggaugggguuucaccauauugcccaggcuggucucgaacugcuggacucaagcaauccacccacuuuggccucccaaagugcugggauuacaggugugagccacugcacccgaccaaguauccuuucuuaguaacaaagagaacaucugguuggacaacacacugaauaaguuagaagcaaguccuauuaaaaaaaauuccccagaugugcugaaugccaccaugugauaagcggggcagagcagggagggcaagguagucugguggcagcaaacugccagucacugaguggcccauagugacaaacaagcgauuuugguuaaaguagagauucugguuuaccuggacaggaguggggcuugugcaagacuuuuuucuuuuuuuuggggcggggggguggcggggcagggggccguugggggggacaggaugacucuguagcccaggcuggaguacaauggcacgaucauggcucauuugcagucucaaccucccuaggcucaggugauccccccaccucagccucuugaguagcugggaccacaggugcaagccaccaagcgcccagcuaacuuuuguauuuuuuaguagagacgagguuuugccauguugucaggcuggucuugaaugccugggcucaagcgaucugccuuccucagccucccaaagugcuaggauuacaggcaugaaccacagcaccugaccaagaauuuuuauugauagcucgcaagauuuuucucauauucaguuaggauugagaaccacugcauuaagauauuuacuuuuugugccaaaaauuuacauagccagaucacauaaugaaaugucucagagaagaguuucuaguaggaaacuggaaacuccacaagcagaacgaucagguccuuacuuuuguuuuguuuuguuuuguuuucuuuucuuuuuuuuuuugagauggagucucgccccaucacucuggcgugaucuuggcucacugcaaccuccaccuccccaguucaagcaauucuccugccucagacuccugaguagcugggauuacaggcacacagcaccacgcccaacuaauuuuuuguaucuuuaguagagacaggguuucaccacacuggccacgcuggucucgaacuccugaccucauuaucugccugccucggccuccuaaaguucugggauuagaggugugagccacuguaccuggccuuuuuuuugggggggaggggagacagagucucucccuguuccccaagcuggagcgcagugacacaaucuuagcucacugcaaccuccgccucccagguucaagcaacucuucucccucagccuccuaaauagcugggacuacaggcaugcaccaccaugccuggcuaauuuuuuuauuuuucguagauaggagguuuuaccauguuggccaggcuggucucgaacacccaaacucaugugaucugcccaccucaacuucccacagugcugggauuacaggcagcgcccagccaguuucuuacuuauaauguacagacacacaccagcugagcagggcuaggaaggcuggccccucuggagugagcacagaggccacaaaggcucagugcucagugcuuggcaccaagggaugaacaggacauccccacccagggcauguaguggagccaggcaaaccagcaacugcuaggcaacugugacaccagaagggacagagaacucaaaggacccggcaacccaacauuaacagcugcaggccugaaaucuucccacagaggaaaacaaaugccuauggguaucucugaagcacuucacacagguucacacagguucacgcagguucaugcagguucacacagguucacacagguucauaaagguuacacagguucacgcagguucacacagguucacgcagguucauacagguucaaaaagguucacguggguucacacagguucauaaagguucacacagguucacgcagguucaugcagguucacacauguucuuagagguucacacagguucacgcaguuucacacagguucaugcagguucagagguucauaaagguucacguggguucacacagguucacacagguucauaaagguucacgcagguucacacagguuuauagagguucacacagguucaugcagguucacacagguucuuugcaaccccuaagugaggggggacaccccaugugccagucagagcagagcagugaggagaagccacacucuggaaaauucacgagcaagacgacaaggcuagaacuuggccccagguggguuuucagaagccccgauaucaguggguaccagagacacaagacaggaagggaaggaaccagagaccaguccagacaggaggaaccagggaccaaaggggguguccaugugaucagcagauaucaggggacagaagucccuggaggccacacagccaggcauccaaacuccagggaccagauguagugucucagccaacacuacacagguaggggcuccagaaacaaggaacuauguccaggcugcccgcccugccccagugaauaacccaggcuucuguaauucauggagaacuccaggagcuggggggcccaaccuaacucuagaccccaccaagcaagcauaagugagcauguaagaaacaguggaaggccacaguggugucagcugagcccaugcccaucacccucuccauccauuaguaccuagacuuuccuggaauaucaacccaaugaaaacugaaaaauauuccaaauuuuuaaauuccaaaaauuuuaaucaaaagaagguaaaaacugucagccuguggucuacauuucaucuuuaagaaauauaacuacgcauucguaggaacuuaugacacaauccaucuuguaaucuaauaaccagagaauguguagcucugcuguugaaaagaggagcgacuuccguguguugucaaagaugucucugauugcucaaaugaagccaauuaugccugagacaaaaauuaaauauuuucuuaaaacuaccaucaagguggaaaagaaaaaaaacaauccuggaaaaugaaaggcauuuuaaauauaacacuagauuacauguaaaagaugcuacaggcucugacaaauagaggggcaauuuucaaguauguauucaagucaugacaugaaaauguuagcacggcaugugccuguggucccaguuacucaggaggcugaggcaggaggaucacuugagcccaggaggucggggcagcagugagcugucaucacacagccugggugacagaguuagacucugucucauaaaaacaaaaagacagaaagaugaaaaugcaaaaggauuuccccagcccaaggcuguggggacuucagaaagaacaccucacccucaccauuuucacucacaaaugguaaaaucauuggaacacuccguuaguuagcucuauggguaaauugaauucaaguaaauugaauuaauaugcugcucucauaaugucuauaucgcugcuauugcuuacuccuuaugauguaguaagucauuuauuuaaaugauuugaaauauuuuuccaaaaauuccaggcggagcacagaggacuuuuaggauggugaagcuacccagugagagacuacaauggugaauauacgguauuauucauuugucgaaacccacagaaggcacaacaucaagaaugaacgcuaauguaaacuacagacuucacagggcgacgaugugucaaugcgguucaccaacuguaaucaauguaccaaucuaugguggauacugauaauggggaggcagggggaaggaaggagaaauauauaggaacugucuguauuuucuguucaauuuugcuugaaccuaaaacucuucuaaaaauaauguuuauuuaaaaggcaggggggauggacuaaguucagaguuuccugguagccaagggaaagaaugucuuccauagcuguucauacaaaaaaauccagcuaugugucaagaaucaggaacuuuucccucauaaauauccauaugaaucccaaaaaucacaaaaauuaaaauaaauaucacagugcuagguaaugaaauuguacugcaaccauaaaagagagaaaaccacuucccaaaacuaugaaaaaugagagucacagugaacuagggcaaauaaucagaacuuccuggguaugccuuuaucuuuccucaacagagauaauuggucuuucacauuccucgugcugucaccaaaaauaacagagcaacagcaggguggaggaagagcaccagcacgguggaggaagagcaccaacauggcagauaaagagcaccaacauggcggaggaagagcaccaacauggcggagaaagagcaccaacauggcagaggaaaagcaccaacauggcggaggaagaacaccaacauggcggaggaagaacaccaacauggcggagaaacagcaccaacauggcggaugaagagcaccaacaugaagcuaaccgcguucucuucacaguuugccuuucuuccucuucuucguugcuuugaccguccugcacauauccauucuuauguccaucaccaagaccugaaaaccuccacugacuggcuucccuacagacugagaauaugggucaggaucacucccagggaaagaugggauccacuuuaaaaccaaauauaugauuuauaucugaaacuugaggacuagagcauccugagccuagcaggucaacuugaagccacaaugaaaauaacuaauaaauauauuuuuucucuccagcagaaaagcuuauaaaucacagcugugcauuguccaaucaacauucaacagugauucuuuugaaagugacugugaagaucugaaacucucaaggaaacacagagaaauagauuaccagccacuccaaaaggucgccgcaaccccgaggucaguuuccugguguuguugucccucagcuccaugcgacccacgcgaacaaucugacagacaaaacugauuuucucccuuuucaggucuuugcuuccgagguccuagaaauauuaguuuccauaaauuauuuuggagacccauuauucaaugcaagcuccaaugaaaaggacaguaaaaaaauggauugagacucuucucagaccaguuuuuaucauuuuaaucaguuauucauaugacaaaaaggaauuuaauaacaauagucaauuacuguuaagugagcuuaagauacacauuuaagggcuaggggcagugccucacaccuguaaucccagcacuuuggaaggccgaggaggguggaucacgaggucaggaguuugagagcagccuggccaacauggggaaaccccaucucuacuaaaaauacaaaaaauuagcaaggugugguggugcaugccuguaaucccagcuacucgggagcugaggcaggagaacugcuugaacccaggaggcguagguugcagugagccgagaucacgccauugcauuccagccugggugacagagcaagacuccgucucaaggaaaaaaauaaaaacgauacacauuuaagaggcacauuccauguuaaugggguaaaucuuugucacggugauucuaaggguggcuagagacucagaugauuucuggaaaugcgcucuacuuaguaauacuaaauuaaccuguauacaggcaucccagggacccauguucuagugucgcaggaaggcagacagaaauggcuaaaaguaguccuuagaaugguagccaauucaacuaagcaucuuugggugcacuuacaguaaacacggcucgcaaauuauguaaucugucuaugucuuuagguaauccugaacuggaccagcgaaccagguaguucucacuugaaaaauggagaaauaaaagcaaguuaauuuuccaaauaacaggguaccaaauguacauccacauugcuucauaauuaauaccauguacgugcacuauacagacaacuauugaguuuauaaauaucaaaaguaucacauacagcuacucaucaauuaacauccacagcacaaaaaccuugccaaguuuuaaugugcaaugucuuggguugucacuguaauagaacuacuugcaaaugguauuucuaaguugguuuuuuuuuuaagagccuauuuguucauuuagaaugacaauacuauaaaauucagcacaaugcauguuuauuucaaaaccuaugacaaaccaaauacauuguaaaauaaaaacugcauccuaugucaagaggaaacaaagucuuuaucagaagugagaauaaaauccacucguauuuuucuguaucauucauacacuaaguuuucaaauuuugaauaauacaagugaagauacuagaguuuuaacauauacacagacacacacauaauucauacauaguugaaccacauuguuuccaucugggcaaagagaaaguuauacugaaggcuaagcaggaaaaaauagacuuacaguguuuucauuuaacaaauauuaacugacagucuguauguggcaggcaccauucuaaaugauguauuccagccaaucaucuugcagaaaaaacaagacaaaacucacagaaauggcauucauagaaaccaaauuuugaaaaauggaaauagugauauuugagggaccaggauauauaaaaucuuacgaagacaacuuaggaaacaaaguauuacuucaaucuucagcuacacucuuaagauacggccagaguguaccugcaacugcuauaacucuacgagcaaauagcaaucuacacgcaagaagguucacccugacccagagcccaaccuggcugccaucacacugucuaagacagcucuugacucggcugcuugcucguguccagcagccauucauccaaggccucucagcaugaaugggacgcuucagugguucugaucccaaguuccuaacacuaaccaaagaggaaagacggcagccaagaaaugucacccaccugaugaauuuggacuccacagggucauauagagacaugaggacuucagcaucuucuccuauuuuacaaaccacauuuuugagguucacaaacaaggccagagaagggguugcagcaaacuuggcuugucuguuaauaucuauguucugcuuuugagacuguguauggaaggaaacagaaagucaaccccagcaacacucaucacugacacuugcuuucuuuauucccuacagaauagaaaauuguaauaacucauuggcauaacccagcaaaggccuuggugcagucacuuucuuaucuccccugcacauucuuaaaucaugcauucacacaacagacaaaaaauuguauccugugcaacugcugugcugaguauuuucagagauacaaaacuuucagguguccauccaauaaaucaaaauaaugauuauauauguguaguuauuuaauuuuuuguucccucauuagacuaaacccuccaaggacaucugucucauguaucauuaugucuucaacauuugguacacaguagaugcucaguaaguacuuguugaauuaacagaugauucaauuagucaauuucugaguaucuacuguguguguguguauauauauauacuggugggaggugacuggaucaugggguggauuuuucaugaaugguuuagcaccauccucucagugcuguccucaugauggugagcucucacaagaucucgucguuuaaaaguguagcguguagcacccccccgcacacccucucucuuccuccugcucuagccaugugaaguguuggcucccacuucgccuuccaccauaauuauaagauuccugaggccuccccagaagcagaagccacuauccuuccuauacagucugcagaaccaugaaccaauuaaaccucuuuucuuuauaaauuacccagucucaggcacuucuuuauaguaaggcgagaacaggcuaaugcauacaugauaccauuaaagaucauagaagacgaaaagacaauaagacauguacucucugcccucaaugagcuuggaauacaugaccugccuaccauuauccgagaggaaaugcagaaucaagucuugugucucauuugacagaugagaacacaaaaucaacaucauuaggauccugucuccuacgaugaaacacaaugcuguccgacccccuuucaugucaugggugacauccugugccaccaggcuccauuccacucaugacuguaggacacaaacucugcagcuacuccuuuucagguucuuucuuagugacaauuuugggcuugacugauacuuuacuaauguugaaaacuuauuacugagaaaacgugaauggcauaugacagagucaaacuuacuuuuuccucuuguaaccuuuccuccacuuguuuagaagcuauuucaugagcucugaagagacuaaucgugcuaguuaauucuggauccaaaauauucccaucuucaucucuaaccaccagguccaaaucuagaauucuagaacaacaagaauuuaguaaguucacagacauagaccaaggaggcugaauuuucuagcacaacuuccaccacagcaacugggcagguaaaaacaaccuagaaacucgggcuugcccaaaauauuaggaauauaaaauucuuggaggcugcuuucuuuagcuuaaaaugugucaucuugggagaaguaaaaaaaaaaaaaaaaaaaaaaauccucaauuuuuauuuccauugcaaucaacaguggcuuugucuugcaaggagaaguuuuacagaucuacaaggcccaagugaaguauguauuacuaauuauuauguaaaauaugaaaaguuuuaaggcauacuuuuuuuuuuuuuuuuuuuuuuuuugagacagucucguucuuguugcccauacuggagugcaguggugcgaucucggcucacugcaaccuccaucucccggguucaagcaauucuccugccucagccucccgaguagcugggguuacaggugugugccaccacacccggcuaauuuuuguauuuuuaguagagaugagguuuugccauguuagccaggcuggucucaacuccugaccucaggugaucugcccaccucagccucccaaagugcugggauuacaggcgugagccacugcaccccaccuaaggcauacuacauauguacacacacacacacauucacauauauaugcaaucacauauacauccaucaacccaaacacauagcuggcaguugugacaucaucagagaguugaggaaggagagagggaagaaaacuuggaggagagaucuauccaccaccuuuuuacuccccacugaccccaauagggaucccugcaugucuccccuucuacuucgaguccuuacaugaggccacaggaagauuuucaauacagauguucuauuguaugugaacaccaaacauauggacguuaucuacaauaagguuaagcaacuuccuggccagauggcuaaauguagucaccaacuaaaaacacaagcaacaucuggcuaauaaaucuguccagucuauaacaguacauucucccucucccucucccucuccacggucucccucucccucuccacggucucccucucccucucucuccacggucugccucugaugccgagccaaggcuggacuguacugccgccaucucggcucacugcagccucccugccugauucuccugccucagccugcggagugccugggauugcaggcgcgcgccgccacaccugacugguuuucguauuuuuugauggagacgggguuucaccggguuggcccggcuggucuccagcuccugaccgugagugaucugccagccucagccucccgaggugcugggauugcagacagagucuugcucacccagugcucaguguugcccaggcuggagugcaguggcaugaucucggcucgcuacaaccuccaccucccagccaccugccuuggccucccaaagugccgagauugcagccucugcccggccgccaccccgucugggaagugaggagcgugucugcccggccacccagucugggaagugaggagcgccucuucccggccgucaucccgucuagaagugaggagcgucucugcccggccgcccaucgucugggaucuggggagcgccucugcccugccgccccgucugagaugugaagagcgccucugcccagccacgaccccgucugggaacugaggagugucucugccccgccgccaccccgucugggaggugaggagcgucucugacgggccgccccaucugagaagugaggagccccuccacccggcagccaccccguucgggagguggggggcgccucugcccggccgccccgucugggaagugaggagccccucugccugguggccaccccgucugggagguguacgcaacagcucauugagaacgggccaugaugacgauggcgguuuugucgaauagaaaagggggaaauguggggaaaagaaagagagaucagauuguuacugugucuguguagaaagaaguagacaugggagacuccauuuuguucuguauuaagaaaaauucuucugccuugggaugcuguuaaucuaugacguuacccccaaccccgugcucucugaaacaugugcuguguccacucaggguuaaacggauuaagggcggugcaagaugugcuuuguuaaacagaugcuugaaggcagcaugcuccuuaagagucaccaccacucccuaaucucaaguacccagggacacaaacacugcggaaggccgcaggguccucugccuaggaaaaccagagaccuuuguucacauguuuaucugcugaccuucccuccacuauuguccuaugacccugccaaaucccccucucggagaaacacccaagaaugaucaauaaauacuaaaaauaaauaaauaaauaaauaaauaaacaguacauauuuuggggaauauucucucugauuccucaaauccaacaaaauuguaagaugauuuuuaccacaguuuuuauuuaaagaacacagacaacuguguaacaaaagagaucaagaguugugaucuggcaguagguucuggcuuucuuguuaacaaaacacgcaggucuaagggcagaaaauuaaccauaggugccucuuacccguuaggauuauauuccuguaauuaacaagccgauggaaacaggcuuuuuuaacaauaugaaaaaggaaacagagucauuugaaagaaugauaaauuucaauuagagaacaucuuuauaguuacaaauuaaagaggaaaguugaauugccaauaaauguuccaucuaaaaaacuacccugagacuucgagucuugaggucacacaccuuaaagccagauacgagucugccagcaucucaaacauauuuagucuuuggaguuuugcucaagcacuguaccacugggaagacaaauacagaaaacugauuuuuuccuuuuaauaucuauugagcaaauuccacugacagugaagcaggaggaccaacugggccugucaacagcaucaggguaaacagacuuuaaacaaauagaggcuuuuugcacugcaugaaaacagccgcaguggcugcaauguaagcagggugccucaagaccaacagaaagacaucuggagaaaauguaaaaagcauuuuaaggucucauuaguuauuuuuguaauaugucucacuaacaaagcaagcuccucccucccaaauacuacuccuuauccuaucccugaaccggccccuaggaacgugcugguacaggcagggucagugacggugugggcaugguuugugcugguguggguggggucaauacugguaugggcaggggucaguaaugcguggauagagucaguacuacuguggguagggcauggucacuucuaguguaggcaugaucaguucugguaugggcacgucagugcuggugccagggcagcuacaaagaaccagcuuaggaggcccagccaguagguccuacaggccacgcagaauuggguucccucagggaacacacgagaggacggcccugugccagccugcugugcacguccugccacaucaucaccucacaccugccagggcagaccgucagacccauugcacaaaggaggaaaccuaagcuuggagaaguuauuuauuccaaaaccagauccuggguucuguaucagaacucuccaauggcagagccaugcuccuuccagaaugccacaugcaaaccaucaaacgaaguggccugugcagucaacccuucuacgcauuguucucagcaaccaguguucagcugguucugaaucagagugaguuuccauuaugaaggugcaacuuaucacagcaaggcaauggagagaugaaguccauggaagcccaaugcaucuaugaggacagggugggagaccuccccaccugaaaucauguguagaacugugugugugugugugucugugugugugugucugugucugucugugugugugugugugugugugugugucuguguugggggggucugugugccuguguuuguguauuguguauguacauuuuucuagagauaugguccaagaccuucaucacauucucaaacagcuccucaaaccccuccacccagguuaaaaaucaaucaaaaaagcaagaaugccuaagcgaucaaugaaaaagacgcaaaacaucuuuuccuuauuaaauccacccaccuuaaaaucaaacauucaacacugugguaucauuuugcaucauuuagguuuucugaaggaagaacuaggaagauauaugcagagcgcugggcuuuggagaaauuauggaagagccuggagauccuugggcaaaaaaccugucuuauuaaggacuguauuuccuaucaaaguaguaaacuguauuuggaaacacuuccuuccuuaacuagauuuuuccaugauacaauguacuuugcuagcuuccugcagccaaauuaagcagguggucucugaacauaaguuuaaauuaugauacuccaauagaaaaucaaaucaaagcuccaaaagucugcuuuuuuaagcagguggucuugaaauggguuuugcugcaacaauagcuaauaucucaggcuuucuggaaaaaaaaauaaaaaucucuccuacagcauuucuaauccaaacccuacaucuugcucauaacguugcuuuaagaaguuuuucacacuucaaaauauaaauuaccagaaaauuaugugauaauucugauuuuacagaaagguuccuugauuuacccggacuccuuucugcugaauggcuggaagcaaaccccuucccuuuucugacuuccacauuccaauguguaaaaugaggggguugaauuaaaccagaaguuuuccaaaucugcuguccagcacaacccaacucuauuuuuaaaacuugagauuuccggcugggagcaguggcucucgcauguaauccuggcacuuugugaugccaaggcggguggaucaccugagguagggaguuugagaucagccugaccaacauggaaaaaccccaucucuacuaaaaauacaaaauuagccaggcaugguggugcaugccuauaaucccagcuauucgggaggcugaagcaggagaaucacuugaacccaggagacggggauugcaaugggccaagaucaugccauugcacuacagucugggcaacaaggccgaaacuccaucucaaaaaaaaacaaacaaacaaaaaaaaaacacuggagauuuccagccagcaucccagauaucacaaaucagagccuuaagggguaggucuugggauucuauaauucaacagcuaucccagugauucugaaauagaagagcauuugggaaccaugugaccagauacuuuuuaaggcuucuugcagcucugcuauucuaugaaaacuaaauauuaccagguggaaaagggcauggccucauucuaguuacaggacccagcagaauuaggaucagagcagcuuguuugcuuucagcaucaaaaaacacgugcuaacauagaagguacagcuguaggcaggggugagcacuaaaggcacucaugcagagcuggggggaugccugcuauggaugggaagaacucuugcucuggcaagagacauaacugcacaaagcaacuauuuguuguuuaucugcagugaaauuuaacugggcuguauuucuguuugugaaaacuggcaagccuacacaggugacaaacuuuccagugaucuaauguccacuccaaugcucagaaccugggauuccacagaaagaaaccuguugcuugucacuaugcaaggccccccagaucuggacucaaagucaaaaacuauggucagaaaguaaaaguuccuugcuaggggaguaaugaugggguucccuccagaacggugaaaaugacaggcucccuggcuucuugacucuaucccuugaagaaugacaagguuucaagaauggcucacaaaauuccccaguucagaauccaguggaaaauaccucauccuuuucaaaaugaaaaacaugccauuacuuugaugguagaaauuuuguuuuaugauaaaauaugaucuuggucuccugaagacuuauagugauguuauuacauuggauaauuuaagcguaaaaucaucuuucaaauaaacaaaccuguuuccauaaucaauuuuggcugugaccuucuucuucaguucuuugaguucauccugaggcagaguuccagaaagaauuugugaucgccauucaauaaggucauagaucaugugccgcacacuucgaaacaucucccuguuaucuugcuauacggggaaaaacccaaucagaaagauuuuguuauaaaacagcauuguggagaugguagagaauggcuaucucuucaaauacgcaugagguauaagcacuagaucaugagauuuaguuaauguugaauuaaaaggugcuuucagcauaaacuaaaacauauuauacggaauuugguuuccaugcgacauuaaaagauuaaaggaacaaaaaguaaugcauaauccccaagacuucauccaacauccugugucccacugaagcaaaaaggugaucccaacaggggcuagaccuugagcgucaacaccugcucgugagcuuccugcaucuggaucagagaugggcaagucuaaagcuccuccggaauuagucugagccuaaagaucugaauccuacaaccuacauacggucuucagaacacccugcacccuggacccuucucagcacacugagaaccugaacuccucggccucgcucucagcucagcuauagggaagaagaagcauuccacccugggcgggcugcugcacacugugguguguacaacccacaagagacacuucugcaagaggccaaaucucaaucuacaagcucuuggugcuuugugacaagaggaaaaugcaaauaagaugcaaaacucacacuucuuaccacuuucuaagaauuuugaugggauugacgguucaaagaaaagcaacaguuugcagcuugcaauuacaagcguacaauaaucaaggagauuagggauuaucugaaggaaaauaacucagugguucuuuccaugaaaagaaauuuagguggaaccuaaugugauaaaacucuaagcaugcuggccuugguagcuccggccuauaauccuagcacuuugggaagcagaggcgggaggauugcuugaguccaggaguuggagaucagccugggcaacauaaggagaccucaucucuucaaaaauuaaaaaaauuagcugagcaugguggcucacagguguagucccagcuacucaggaggcugaggugggagcauugcuugagccugggagguuaagacugcagggagcugugaucaugccacugcaaucuagccugggcaacagagcaagacccuaucucaaaaaauaaauaaauaaaaagguaucuaaaugucauggucccuuuaaaacauuaaauuuguucacugccacuuuuuuaaaaaacucccccucuacauaucuaaaccacguacugagcucacucugguauuuaaccuucuuucuaggaguuucuaauauccacgcugccuucucuuguccacugcucuaaggcuguaucaacuaucuaaaauccuuacuauuuugcuaauaucuacaaugugcagcaaaaaaaugcauuuuuuuuuuuuuuuugagaaggggucucgcucuguuacucaggcuggagugcaguggcgcaaucuuggcucauugcaaccuccgccuuccaggaucaagcaauucuccugccuaagcuucccaaguagcugggacuacaggcaugcuccaccaugcucagcuaauuuuuguauuuuuaguagggacgggguuucaccauguuggccgggcuggucucaaacuccucaccucaagugauccauccgccucggccucccuaagugcugggauuacaggcauaagccacugcgcccagcccauauaaaaauauuauagccauuuuggggguuagcuuucuuugcacaaauccaaccauguaagucuaucagaggcaaauuuaaguuuuguaaaaggaaaccaaggugcucauuaagaauaccuacucuaggguuacagacuuaaguagguccacugacuaugagcaucaacuccuguuuguuuuguugccauauuuuuguuuaaaaauugcuaaguugaagaugaaacccugacuacagaauugcucagauuuacacaaaacauucauggcuaacuuuacgcuuuuagguuuuucaguacguuugaugacaauuacugcaacugcuuauuacugugcauuuauaggaaaccacuguauaaucaaaaacaacaagccugcccaacaagcagcugcaggacuuuaggaaguuuucuauguucucaagaaaugaacguaccgacuuccuuccagagcccuggcuuggugguaauaacauuagcauaugagaaaucaacacucugaauagaaauacaagcuuaacaaaagguaaucuacugcaaauaugaauuuaugugcaaagaaaugccccgagggaauacgaaauggaagaugucagagcuucaaccucucugcauuaauaagacuucuucugugaucaggagaacuggacaauugcacacgaagcuagaauguaaaauauuucccuauuccugucacaaacacagguaaaucuagaagacuguuguuuuucuuaaaugauaagagguauuaccuacugucagacaacggcaaaaaaaaaaaaaaaaauaguaauugcccucuaccggauccuuaaauaagcaccuauuacuguuuaaaaggugacaucaacacccacugcccgauccugcauuccaggggccugaaacaaccacauuucuccuuccaaugcaaggaaagacacauccuacagucccuucugcuacagcucacuguaauacacccaaauacauggcaggucgaagggcacacagcccccagcaggggcuaaacucucagccaugucgcuuccuuugccaauuccgaguaaaacucugucucggaagcucugcuuuuaaguuucgcugagaaaaaaaaacaucccauuggcauaucagggucaaaaaagcccacucucuauuucuaagcuuugaaugaauaucucauuuucucaccacguagagcugccuccagaugguggaccacucucggagugucguggugacuuccuggaugagggggaggucacccgggaugacuguuucauguugccugggaggaaagaaggaaagagcagcugaguccacgguuucacugccugcuaugaguaguaccugguaaauuucacaucuaggccauagcguucaguauuaagcaaaugggaagaaaaucuacaaauaagacugcaugcacacauauaaauacauacgucucuacgaaugacaaguuauauuuguacagagcuugggaagguucauacauuacccugcacguaagccauccaccucauacgucaaaguaagaugaaagaggcaaauaauauuccauuaaaagucuacagaaugucaaggucuggcaaaaggaaaguauauucauaauauguguacccaucuaucuuaaagaugccauaaauuacagccgguccauguggcauuaaaaugcagguuuggguuaagauuacuuuuacauuuuccaucacgcauaaaacucauuacaugauaauacaggaagcaguuauccuuggcgaaauaugagagagguuacagcuuccaaauguccaugguuacucuaucugaugccaacucugauuaaacucuguauccucuuucuuauccuuuuuccuccgccccaaaaguuuaaccuuugacuuacucuucuuuuuugaaacggugucucgcucugucacacaggcuggagugcaguggugcaaucucggcucacugcaaucucugccucccagguucaagcgauucuccugcuucagccucccaagcagcugggacuacaggugcccaccaccaugcccggcuaauuuuuguauuuuuaguagagaugagguuucaccauauuggccaggcuggucuugaacgccugacuucaggugauacucccaccucagccucccaaagugcugggauuacaggcaugagccaccgcgcccagccccuugacuuauucuuaacucauuaccuauuuaugcgcucguuuucaucaaaucaaccacugcuuccugggcaugugcucugggucaggcacuaugcuaaguaagacucagacuacugaggguuagggggagagagugaauuuguggcugguguaguuaggcuagcuggccccacagguugucuguguguccugaacaggcaagaauguggccagcaugggaugccgagggaugcuacaauaguucccaccuacaacccuugaugugcacagagcccagaccuguggaaggaacccugacuggcucacgauuggagaucaggccugugaugacuuauugacaguggaggggaggaucccaaagcaacagacaacggggacccuggaagaacgguggucucauggauaguuccagaaccagacaucagagggaagggugcaggcaaaaccauccccuagaaaacugcuaugaagaaugacccuuugggcugggugugguggcucacgccuguaaucucagcacuuugggaggccgagguggguggaucaggaguucgagaccagccuggccaacauggugaaaccccgucucuacuaaaaauaaauaaauacaaaaaaucagccgggcaugguggugcgggccuguaaucccagcuacucaggaggcugaagcaggagaaucacuugaacccgggagacggaaguugcagugagccaagauuguaccauugcacuccagccugggcaacaaagcgagacaccaucucaaaaacaacaacaacaaaaugacccuuucaugggccaccaucagugucuacugaagaacaugacuauuaaaacagcccugccaaggauguccccaaguuucccaguaaggaugcugauggaaaugcgguucauuacaugcuacggugucaucccuauaaagucugcagggagaaauuuccuuccacucacaguaugaggaucugcaacaacgacugggcuguuuucaucuuacggauccuggguugagugcacuggugcuccucacacuggcuaugagaagccuggagcucaacgaccucccuuccaccaugugaauagggccucagugcaugcaccauguccugcuguugguucugguuccaccuuagguuccucccuucugguaggcccaguggaucccugggauuaaugugccagcuggcauuaacacauuugaucuggcuuuauugucuuaccuuuguuaccaccuuguuaccugccaguguucaagaauauguaaccccaauaaugccugccucauagggcugcugguaagacugagggaaagugcaucaaggcagagcaucuuuaagaaugaauggggcuccacgcgguggcucacgccuguaaucacaacacuucgggaggcuaaagcggguagagcacgugaggucagggguucaaagccagcuuggccaacguggugaaacccugucucuacuaaaaauacaaaaauuagccaggcaugguggcgugcgccuguaaucccagcuacuugggaggcugagacaggagaaucgcuugaacgcaggaggcagagguugcagugagcggagaucaugcuacugcacuccagccugggcgacagagcaagacuucgucucaaaaaaaaaaaaaaaaaaaaaaaagaaugggacauaggggaguggggagaugaugggucaaagggacaccgaguuucuguuagacagaaggaauaaguucaacaggccuccuauccuacaccaaggugacuacaauagcuauguauuguauacucgaaauugcugagaguagauuuuaaguguucucacuacaaacaaaugauaaguauguaagguaaugcacacauaguuugauuuagccaucccacaauguauacauacuucaaaacaucauguugcacaccauaaauacauacaauuuuuauuugucaaaucuaaaaauaauuuuuuggccgggugcgguggcucacaucuguaaucccagcacuuugggaggccaaggcaggcagaucacuuaaggucagaaguucaagaccagccuggccaccauggugaaaccccaucucuacugaaaaaaaaaaaacacacacacacacacacaaaaauuagcugggcaugguggugaaugccuguagucccagccacuggggaggcuaaggcaggagaaucacuugaaccuggaggcagagguugcagugagccaagaucucgccacugcacuucaaccugggugacagagcaagacuccaucucauaaaauaaaaauacacaauacaaaauaaaaauaauaauaauuuuuuuugaaaagagaaugaaugggacauagcagaugcucacccaacaguggggaugauucucauuaguuacuuggcugccuaacugaaugaggggucaagagacaaaucagggcugguggucccgaugugagcaucacccacagagacagaucagcugaagagggaaacgcaacagaggccaugucaaucagggaggggcaacaaagaaauaggagaaggcuaggacagcacccucagaguagcggacacaggacagaggagacggugacaugccugagcaguaggucagcauaauaagaagaggauaagagcaucggcguuaagaggggcuuucagugaagcaaggaccaacguguccaaggcugcaguggagcuccagaggcagaggaugagaagacacugugagguccagacauaaggaggcauugcuaaccaugucaguacugggaaaagcauggaggacaaaaugggaauugcuuugguuaugggggaauagguacagaaucagugguaacaggcauagaguaaucauuugggaugucugagaaugaaugaagucagcguccagagagaagagagacaaagcaaaagagauccuucacgagagucaaugcaagcaagauacugugagagagaucacaugagagagagccuugcaagagaaagacagagccuguaaaagaaagacagagccugcaagagaaagacagagccugcaagagacagaucaugcaagagagagcucaugcaagaaagagaggcuuacaaggcagccugcaagacagaggccauaugagaacgaucaugcaagagaccagcaagagacagauccugaaagagacagacucugcaagagagacaggacaauaaacuuggagagcaagaaggcaggcagaggugggaugaaagcguggcccacauuggcacuagaaaggggaaaggaccaggagaagaagggaagguggaagucuacaacaaccuggaggaaaagaagagggaugagaucaccugucaagccugaaggccgggguucuucagggaaggagcuguugggcagcuaggcuugaguggccguggcaagggagacagauagagccaggaaaacaguguggagaacaaucacagggaacccaaagcaaaggcagggaaauuguuucuaaacuguucauuucaccauagcucuaugcauuugcccacaguggggcaccuuggaccagaaggcccaggaacaggaaccaaaugugucucugucugccugucugguuaggugugacucuacuuauugagacucagaauaaccuguuguucacuuuauuaucaugcuucauaauuacauuuuacauauauucuuuuguauacaucaaagugcuuuuuaaauaaucauacacagucugcccuguauaaggauucuaaugcagauauaaaguacacuaaaugcacacuugauccaguuacuuccacagaguaaaagucucaacuuucuuuuucuucccuuuaaaacuuugcauacaaaacacuuuaucugucuaaaaaguaccauauugcaggucaucaucauucaugccucuaaauuauuuucuucauuuuaaguaugcaucauggaacuauggaacccgaacgguucuuuucauauguuaaaaguacagugcuuggaaaggcaauuuuguaaucagccaaagagaugucauuaugcaguaaucauaugauuaguaauuuuauaauuuacauauuuaacugagugugaagauguagcagagacaaaaaaagaaaacauuuuaauguuccuucuuccaaguucacaccugguuauucaucugccauuccugccuaauggguuccuguucuagaaauguccuuuuaaugaucuuauacaucaguuuuaugaccucuaggaaacauacaucacaauuagacaaaauguaaacuccugcaugucccaauuuaacaacuguugcuucacccuaaacuccauuuauaucacagccugcaaugucuucccaaaaaaaaggggacucagagcuggggggcuuuggagucucugccaaaugaagucaguagcucacagaggaagcacagagcaccagggcgaaugcuuuccaauagugaccccagguucaaggacaguaacugccaaguauggugcugacuucagacuccauaaaggauaaaagccauguuaaacacaacucugaaucacaaguccccuuucucuccccaaaacuccugucccccaggagucaaucacacccauugucuugacccucucauauuacgccaucguacaaaagagcagcaaggccaaauauaguacuugcaauucuucauuuaaacaucaagaccagacucacccuuuuccuucaacuaucgcuucuuuaagaugaauauaugaagcaggaaauauacccuuugggaggaaaaaaaaaacaguagcuuuuauuaucaauaggauugcugaauguaaaucaaacaauaguucccaaaaagguggggugagggguggcuagaucgcucuuaauuuuuuaagucuuaacauaucaaagaaaacacaaagaaguagaaaagacggcaacucauuuggcuuguauugcagucugccgaugucuuagaagcaaacaggcaacacacuugcaaaggaaaaaguccacaaagauacaggcaauuugcaggcugcuccauagaucacaccuuuuuggccucaaugcaggcagaacaaaggccaacugaugucucaaaagcaauuuuugaugauggucuccucuuucaaaaugaugaaaguugguuuacaccaccaauugucccuugugcacugaccacguacccagacccacagagacuuucucagagacuuccccaacaggggggcccucugguaaaauacagaaagacaggccgaauuucgcccaaucugcacaacaccuggggguacacccuagcuuccgcugauaagcuggucggccucccucaagugcaaugcacaugugagcccaagagaaugaagccuggggagaguuucucaacaggacauucagccucaggcacauucugugaagugccagaaagagcuuuaucaagaguuuggguccgaggccaggcacgauguaaucccagcacuuugggaggcucagguguguggaucaccugaggucaggaguucaagaccagccuggccaacauggugaaaccccaucucuacuaaaaauacaaaaauuagccgggugugguggcgggcaccuguagucccagcuacucaggaggcugaggcaggagaaucgcuugaacccgggaaguggagguugcagugagcagagaucccgccacugcgcuccagccugggcgacagagcgagacuccgccucaggaaaaaaaaaaaaaaaaacguaggguccugcuuucugagcaagcaaaauaacucccuuacuggaauaaagcaaagguaagaaaagaggcaacgggguuggggucuugggcagugcaacgcagcccagcuaccgcuuccugcaugagauuuagugcaugcagcagaaauugauaaaguggcaccccuguggcuucaaggcaccuguugugggaauggaagcuucugcauggguuuccccggcauucagcccugaaugaugcagaaaacaagcuacuaaucaaguuugggaagggcagggggugggcagggggcaggcagggggcugaacuggucuagcaggcaccaaugauucauguugcuucugccaacaaggaaaguggccaaauuccauauaaagaagaauuaucacagagagggaaggcgucaggcagagagucagaggcugagcaacaaacaaggcugggccaggcucagaggugcacaccugcaaccggcacuucgggaagccaaggugagaggaucacuucagccuaggagccuaggagcucaccaacagccagggcaagauggugagacccuuucacugccgaaauuuuuuuuacaaauuaguuaggcaugguggugugcaccuguagucccagcuacuugggaggcugagggaggagaauaccuugagcccaggaagucgcgguggcagugaucuaugaucgugccaccgcacucagucugagccacaaagugagacccugucuccaaaaaaauaaaacauuaacuuaaaaaaaacagaagucugaagggacccaacgcuggguugcuguguucagguccugguuauccgggacaccuccaaaucccagguacacccuccuggguuucuuuccaugauagcaauagguguccacccagaugggggagaaaaacaaaaaaccagucccagucuuguccauguccacagguggagacaacccucaaucucagcaaacccacuggagaaucaugaagccacaggaaggauaaugacugagugaggcuggacacaccugcagguuugaaaugcgcaacuuccgcugggccugcucagcaccaccccaaucaacugcacacuuauaacuacaggaaaguuguuuacagacacguggugccaggauuccuagggcccacaucccuuuucugcuacugccuaggaggccccuuacaaauuuauaaucucuguaaagcuuggauuuauucaucuaccaguggagaucuuagauggaaaaauagcuaugcccuacccagcgcuacuguguugaugaguuaugaaugaguuaugaugucuaggugcccagguguagugcagaaauacugugguuucaggaggcauugugggaauggaagagaucucaaauuggggaaggugauaacaaauaccaaguaagauucaaagaaaaaggaacagcuugccuggggcacauccagcccaggauguggcaguuguguccuauguaggaaugugaugggggaggggcauauuaguccaugaucuuaaucucuuauuacuaaagguuucaacugcagcuuuccuaaauucagagcuucaucugcagauacacacuauuuuuuuagggauagaucucacucauuaugaccagcagaggcuggucucaaucuccugagcucaagcaauccucccacuucagucucucaaguagcugggccuacaggugcauaucuuugggccuggcuggaauucacucuugauuggggaagggaaaaccaaugugaaaauagaacuuuccuuggagaaaucuauuccaccauccacuggauugaaaucgaucuugugcaaacuucaaggcuauaggucacugauguguagagaccuguagcccagucugagguuggcaagguggagguaagagguccuggucccaauuugcagaucuggcucacugauuuccuaacacugucucucacauuagacaugacugugccagaggauggcugccauagggaccacccuggauccuucccaagugcugguguugcgagaggaugacccauucugaccugcucagcaaagccuggguuaggggcucuggggaaggcagaguggaaggacccuggcacuugggccacuagacuuuggaggacuuauuacaggcucaggaccacaauccagaguccagcccaauaaggagauaaugagagguaaauuuaggacacaaaaguaaaaugaaccauccgucaaacauaauuagauauuaaaacacaucgggucaaacauaauuagauauuaaaacauauuggguaacguggacagcccaaccacagcuuagaauagagguuacuucaaaaucuuaacaucguagaaugaaacagaagagccauaauuagguuccaugaagcuaagaauguuaaagccacaacagaauuguguaugggagugcccaccacaaugauccgagguguaauuacaugucuuaguuucagaaauucaaacaaccacucaugcaaacugcucuaggagagcagaacuccuuuuuucacagcuugacuuaggcagaguaaaaacaguuauaugcaagagggaaacagcaugcaugagcuugcaaauuugcuaaucuauuauuaaggacaacauaagauugacaacugugagaaauaauuuuuuuccugaagucgcuuuacucggaucauucucugacacacacagaccuaaaaaggacacaaaauucaugaacagaagacaacaggccaacacuauaucacaaacuagcaauucacucacggagaugaagcuacaauuucuauguacacauauuguucagaagaaaacaauccaagcucguucacauuccuacccauauauuuuuuuaaauucagagaaagagauauagaaguaaaacccucagacacaaaugagauggaauugauuuccucucaaggugugauuuaugaagagacaugcacuguguuuaagaagaaggacuuaccuucuuagacuuuuuucguaacguguaaccucgguaccacccuaaacaaacacaaaguugaaacaguuaguacaaagagacauguuaggguccucacaauacauucaugauguguagaacucacuguuuggcagaaccagugaggucaguuugucaccagcauuuuucagugaaccuaaggcuuuggagauauacuacgugguuucccagagagcauuucaacagcgcacccggagcccagcuggcaaccuucacacaugggccuccauaccuucaccuccgucaucucaugugguucggaagcagcaguuugaaguucagaugcacaguuccaagagcaggacuuguccuuucaaccacuggcccugaguaggcuccuuguguaugcauuuucuucacucucccucugccugauuuagaccaagaucucuccaagggcacaugucagcaucucgcugccccaaaacagaaaacccauugagagagaacuuccucccacuucaagacagggcacuuuuuccuggagcagccacgaccucacaaaguacuucuguagcaacaauacagcccucaacccacaggaagcuccagggccaagcacaggacacaccugcccuuuggguuuggcccaggcuccacuucucgcuccuuccaaguggcgagagaaagaaaauagugagagcagaaagaaagacacacucgaaccauccgcaugccauggaugccacacagaagagucccuucaacaagggaccagacccagccacaccccuggcaccccucucaggcugaggacaggaacugccccugcaaaggccuaggggucuaccgucaguauccagccuccaagcaccccaccauuugugaguucagauggaugauuuuuuacucccaaacauucugaagucacuccaggccaucuaguuucuggaaagcuaaucaaaagcucaaagaggccaggcacaguggcucacgccuauaauccuggcauuuugggaggccaaggcagguggaucacuugaggucaggaguucaagaccagccuggccaacauggugaaagcccaucucuaauaaaaaauacaaaaauuagccaagcauggugguaagccccuaugaucacagcuacucaggaggcugaggcaggagaauugcuuaaacccgagaggcagagguugcagugagcuaagaucaugccacugcacuccagccuggaugagagagcaagacucuaucucaaaaaaaaaaagcuuaaagacaaaucccaacucugccccauaggaacaaaggacccugucagagagugacagagggcacuuggaaaacgugagcuggguaaauucccagagaauaaccaaauacuggguuucuuuacacuauuaaaaaggcaaaccucagaaccaaagaucagacagaugugaaaacgggccauugucacagcaacuggccuccaccucucucaaaaggugaaaauuuucacaaccagggaugaaaaggaugauugugaaccagaaagugaugguguuaagaugagcagaauccccaagggaugacuaaccagcuguuuucugcauauccagaaaagaggacagaaacugccaggacucuggcaaagguuuugcuaagacccaguuaugaugaacugaacucauuucacucucuugacuggagacucaacagacugauugggggaaccucagauacaaaaugccuagacuucagccacacauuugaaggauuaucuccugauagccauauugucaaguucagugguuuugauaagcuggcccaguaucagcgcccaucuaugacacagugcucauauaucaaagcccaucuaugacacagugcucauauaucaaaaaggaaaaagaaaggucaguugaaugaguuaugcaaagcuguguacucaguuucaacaacuguccuuuauccuauuauagucuuccugcauuuucaacauuaauauguccuuucuuuucugaaacugacaaagauuaacgucuuagaauacauaaggaaauaauacagagacacaaaaagacagcaacuaaguauaguaagaaaaugaggccaagagugguggcuuacuccugucauccugguauuuugggcagccgaagagggcagauaacuugaggucuggaguuccaagacuagccuggccaacauggcaaaaccccgucucuacuaaaaaaaaaaaaauuggcugggcgugguggcgugcaccuguaauaccagguacucgggaagcugagaaucaccugaaccagggaggcagagguugcagugagcugagaucaugccacugcacuccagccugggcaauagagcaagacuccaucucaaaaaaaaaaaaaagaaaagaaagaaaaugagcaaaguuuauaaacuauguauagaagaaacccauaagaccucaacauguaugaagagaugcuucaguuuaauaauagucagagaaaugaaaaguacacaguuaagagugguagaaggcagaacacugcaggaugcaggaagccccuggucaccguggguggcaguguccacugcggcaaccagccugggagaagcaggcccugcuuauccaaagucuacaucuccacacccaagacccagcaacccccuccugggaacgcagcccaaagacaucugugugcccugcagagugagauggacaugggaugcucagggcagcuugaucuuggguggugggaagcggggacaaccuaagugcucauacccggggaggcaggcaguuaguaaaacaugaaaugugcacacgaugcaguuagagccauggacuaaagggacacagagaacacagugcauuuuaaauggagcacgagggaaaauaaaaaacagaacaagacuauaaugacacacuuacaucuguuaaaaacagaugcacaccaaacagcacgagaacacaggcaaacgagaggccacuucacacacaguagaaagguuuucuaugggaggcaggaggaggaagggccaagcaguaggcaugaaaggcaaggaguuuugugucuuuauuuaauguucauaggcagucgauuccucuucuaauggccuuccuaagcaaaaugaaaaccaugguuuuccuccccacgauuuuuggcaugcacuauuucuucaacaaagugagcccgcacaccauguaccagagaccacacugggugccacaaauacagaaagagauuagacccaaucucuguccuccaugagcucagaaacuggaagugcccuaagacaaguaggggucacaccacaaacccugcugcaugacagaguucggcaugaaggagagaggaugucccggcagagguuuugcaccggagaguaagagaacagaacggaacgauuaccuggcugcucuggggcacagcaaagaggggaugaggcuggaaggagaaagauucacagcuguuacagaauuaacuucucccuggcacggcuugcaaguggccuccacguagucaaccaaccugcuccaaaaaaagagacauccacccagggaacaggcaaauacaggcaagacacaggucccaaacucggggaggacacaguccagcacaggaaaauggcggucuagucauuuuagaagaaaaugcaucacuaucccuuuuaaagaguugaauaaauuaaguuugaauguggcugaaucaaaaggacaauuuccucaacuuugggcaaugccugcagcuugccucuggugcagcaucucacccuggggacgcuauggaagcccuggggacccuauggaaacgagucgacagcaggauuggcacgcccuugaccagacaagagucacucaaucaacacuggggccuggccucaccucuccuaucuggagguaggacauuguuuaaaggcaggggucugcacgaaugagcucucaaagcucuuuccacuuccaccaugagcuagaaagcucauuuucuuuguucuaugcuguaagccuucgugagcucaagaaagagaaauuaaccacaacuugaagguaaauuuagucuuugaacccuaaaauaaagauuuaucaucuagaaauuauagccucuggagcaagcucuguaauauccuggaaaggaucauagaaaaaaagaaaaucaaacuugcuaaaccaaaaagucaucuuagaggaaaaggagagccaaggaaagaaaaagaaaaugccagacucuaauacaagccaugaaauuuagauaaaacaagaggaagauauuggaaaacaaauggaaguacauuauucucuuuuuauuuaaugacaaaaagucaccacacuccccaaagucaaaacuauuaauacuucuccaaaugcauuucucugauuagauucagauuaaaaccaaaaaguuaguugucaaggaacggaaauucauuuuaugcuaaagagucuuuacaaagacugaaauauuuucaucagaaucuagaaagaaugacuagcccagaaaauuaauguucacuguagaucucuuaucaugaugucagccaaaaagucaaaugccugcaaucagauauuuuugaaguuacacguauuacaaggaccacugacaugcccgaggaguccacuguuuaaaaaacacauuccucagcugggcaugguggugggcaccugcaaucccagguacucaggaugcugaggcaggagaaucccuugaacccaggaggcagagguugcagugagcugaaauugcaccaccauacuccagcccgggcgacagagcgagccuccaucucaaaaaaaaaaaaaccaccaccacacacgcauuccucuuaugaagcaaagaacaaaaaugcagucuccacaggcccaggggccacaggaaaucauuaacuauucaggaaugacaucauugcccaguguuuauuaaccaggauuucaacuucaacugaccggcagcaaaaguaaaacaagauacaagagcauuucccuucaaaucagaaaagugucugagaugagcgguuugauccuuaaccucuacuuaauuucucucugucuccucucagacacaugcaguauauacugagaggagauaagggaacacagcugucagcuguaaacacggaaaacaagcagaagaccccaucacaacuacucauccgcuuaaggacuggggcugguuuuugcagagcugcacuggcuuccacgcagaggccacuaaagucgauuuuuuuuuucagacaggacuuuuuuagggaagguacagcaugcaucagauggggaaauaagggccaugaacauggaucuguuaguaggucuguguuucucagaggagucuaccaggagcuggucacaguuugccucgagcaggaagcugggcauacuucauuccuuguaaaguggauuucaaguuggaaguucaauuugcugauuacuacgggaugucuucaauuuccccucucacccccaaccucccauguggaaggguuuugcuaaaaaaccucugugaaaaagcaguuuuucuacugaaauuauccuuuuuauucauaugcuauaugggaaccacccuuucaagcaggaaauuaagccgacaacaauaagaaaacacaaucucaccaaaaccuccagaucugaacagucuuuaaaaaaucaagcccaucauuucuucccuucugugcaacaauaaccacagcauaaaaugaaauauggcaugcucaaauuauuugcaaacacaaaauauaaaaacaaauugucugaaaagccaaggacauuggaaaaccacugucaccaauaguuuauuuauuggauaauuauaacaauugcuucaggacgggcacgguggcucaugccuguaauccuagcacuuugggaggccgaggcgggcaaaucaccugagguugggaguucaagaccagccugaccaacaaggagaaaccccgucacuacuaaaaauacaaaauuagguggguacagugacacaugccuguaaucccagcuacucaggaggcugaggcaggagaaucgcuugaaccugggaggcagaggcuguggugggccaaaaucgcgccauugcacuccagccugggcaacaagagcaaaacuccgucucaaaaaaaacaaaaaaaaauauugcuucauuggacggcaucccauauaacuaugauaaaucucuguucaucccaagaaaauggggauuacagguuuaaaaaaaaaggaaaggaugaaaauugggguuccucugagacauauacugcuaacaaaucuaagugaggacauuaaaagaagaaaucuuaguucacaucaaacacaucaaaacaaugaagcaggcuaggcacaguggcucacgccuguaauuccagcauucugagaggcugaggcaggcaaaucacuugagcucaggaguucaggaccagccugggcaacauggugaaauccugucucuacaaaaaauauaaauaauuagcugaguguggcagcaugcaccuguagucccagcuacuugggagccugagguggcaagacugcuugagcccaagauggggaggcugccugcggugagcucugauugugccacugcacuccaaccugcacgauggagcaagacccugucucaaaacaacgaaguaaacuaucuuaaaccuauuuuuuaucaaguggucaacuguuaacaaucaagauuuauacacacuuggccaggcagaguggaccacaccuguaaucccaguacuuugggaggcugaggugggcagaucauuugaggucaggaguucgagaccagccugaccaacagggugaaaugcagucucuacuaaaaauacaaaaaaauuugccaggcaugguggcgggcaccuguaaucccagcuacucgggaggcuaaagcaugagagucacuuguaccugggaggcagagguugcagugagcugagauuacaccaccucacuccagccugugcgacagagcaagacucugucucaaaaggaaaaaaaaaaaaaagauuuacacaugcuugaaaauaaggagccaaggaguuuaaaaaugggaauuucaguuuuaaguucaccuucagaaaguauuaaacaacagccucacuacuacccuuaccugaaacaguauccaucugcaagaaaagggagccugagaaggaagcaugacugucuuaugugucuguaacagaggaaugcuuugcccagcaggcacugagaaggugugccaucugcccaaaauguaagagaaaagauaccaagaugcauacgcaccuucauauguuucuaagaugugcacagugucuccgaucuguaaagaaaguucauccgcuccucuggcaucauaguuauaaaaagcugugaugaaaaaaggggaaauauauuaguaauaguaaagauagaagugaccaugcugagucguguuggcuuguuuuaauguuguuguuuuuaauauugaaauacauucagucgcugccugcaucauccucucugauacccacagaagugaccuuuucuuucagacaaauauaaagggucaauaguuuaaggaggagaaauucauaacuacccaugacaccagaugaccauaagugacauaagaagacauuguuaacaguauuuugauugacacuucaauacuaucuuuuauuuccacuaauagauuuuuaucugccuaugaaucaauugcacauggagugaauauucuuuggaaaccaaauuaauaaaaaaauuaucauauagcaauguugauauuaagccaauagauuuuacaaucacaguagacaaaaauauguccuguguuagaagaaauccuuaaaacugacaaugauaagcaagaaaugucugaaaucccauguuuauccugacauaaagcugcuccuauuuugcaaaaggaucauagugcuccuacauaagccccuaaaaagucacaccauuaaauuccaaccacacuuuugcucaugcauuauggaauaaaggcagcagucacagguguaaaaaggaugcuacaaaguguuuaaggcccaaaaaguauucaacuagcccacucucaauuuaaaaaaauauauauuaauguuccuccuacccaacagccucuaccuaauaggauauagcauucaauauaaaacucaucuucaaaaucgcggaucaaagcucucauccauccauccugcacagcccagccaggcgaggcuaugcacaaaaggcaccugcauuguggcacaccucuaaaauucucuaaaauuaaaccaugucaugugcaaacuccucuggcaagcacgggccaccguaccuucccaccacacacucccuucccugggcccuugcuucuacugaaggaaagaagccaguccagcccacaucuuuggguaccaacuucucccucgccagcugggccuucccacugggugcaccucaucacgaaagccagacccaagucuguguuugaucuuuuaacuccgcuccuccaaacagcccuggcaccacgcaaagcuucccaucucuuguucugcaugagccagucuuauuucagauguguguguuaagacauccccaacuaaagaaaagccaccagagggcagagccacccaccuuucaacauuuccugcccacaccuccaaggacaggaaggugcuuagccguacaaggaauggccuccauaaaccugagcugccugagcugcaccucaggcuguaaaguccagaauuucaggcgcacgcagccuccugguguucacguucauggucucuacagacagcuaaaguggguagggcagcaccccuccccgagccccugggugccugcccucuggcaaacgaucugcucuaucuucagguuuucaauggccaaaauaaggaccggauacugaccucguagaauugcguguguguuuugugucuuagagaaaaugaugccccuguuggaucuggcacaaugggguccauggugaacacucagguaacggugaaggccuuccuuuugguuguauuuuuuuuacugcuaucaagaugucuaccgcuaccugaauucuuuuuagaaagccaaagcaagcacauugccacaugugcacaaaaauucuguaauaucaaaagcuagaccuaugauauugaaaauucuauuuccucagguaucuuccuauauuuuccccaaaauucauaaaauguaaguguccucaacugacaaagaugguuauuaguuaguuauuaaguuuauuuggcauuuuacagugaaucuuuaacaagaaauaacugcaucaggugaaggaagcccagggcagaggcuggacuuccccagcucagcaugaccguauucguaaaccuucaggaaccauaaauacaucuaucacaguuccuaacagcaucccugccagcacaccuauucuguucuagacgugggaaaaauaaacacgucaaaaaucauagaaaugaaauaaaaugagcacaucaaggguaaauacauucaagcacaugugaauuuguaaagcacauacacauaauuccuuucuuccuguuucaccucuaaauacccuacuccccaaucccuaaagcagacaguggaaagcagugauugaaaucucauacauggauauggaaacuucacauuuaacugugaaaugagccagacaacccaugauuuuguagguaagaaaaaaaagagccucagggguuaugcacauggccccaaaucaugcaacccagucaagaucacaaccccagaugcccagccccuagcccuuuguucauuuuaggacuaaugauuaaauaaucccauauaugaagacaaauuaaaagccagccuugcaaggguauuugacaagggaguaggagagaggagcggaaggaugcagauagaguaacagcccuccaaagacgacuccaaaagcuuucacggccacaggggcacugcgagggugaugaaauucagcaucuuggccggguguggcagcucaugccuguaaucucaacacuuuggggggauuacuuuugggaggcugaggcaggcagaucacuugaggccaggaguucgagaccagccuagcuaucaaggcaaaaccccgucucuacuaaaauuacaagaaaaauagccgggcgugguggugcgcaccuguaaucccagcuacucgggaggcugaggcaagagaaucgcuugaacccaggaggcagagguugcaaugagccgugaucgcaccacugcacuccagccugggcaacagagcgagacuccgucucaaaaacaaaaagaaaaaauuaggaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccacugcacuccagccugagcgacagagugagacccugucucaaaaaaaaaagaaugagacaguaacucacggacauccucuuuggaaagaaaggaagagaucaucagcucggccucuaacuccaaaguucacugcuccaggggaaucuggaaugcacauuucaaugccuagucccucuggacggaaggcaguuaauucucuccugcucaccuccaguucuggucaacaacauucacaucaaauccaaacugaaagaaaaagcagaucagagacggaaaucugcuaucauggucacacaccuggcgugguagucaccaccgcacucucuaggcaguuuucuucuaaaaagacgacgcaaaauacaccggagcacaauuguucugagccuuauuuccucaaugacuggagauaagacaagaugcagggcgccaauggucugaagugagcacuaaaagccuacaagucucuccuucucaauugcccacuaacagaaauacuuuuuccccugugucucaacugcauuucuacgacugugucaguaucccggggcugccacacaaaguaccaaagcuugguggcuucuaauaacagauauuuauuuucucacaguuucagaggccagaugucagaaauuaaggugccuacagggccaugcucccuccaaacccucugggggagacuuccuccuugccucuuccagcuccagggagcccuacgggcugcuggacacuccuuggcuugcggccguguaacgcccacuucugccuccauccucacuuggcugaguucucacgugucccuccucuucuuaacaaggacaccaggcauauuggauuaaacgcccaccuuaauccaguaugaccacaucuuaacgaauuacaucugugaugaccccauuuccaaguaaggucacacucugaggcacuaaggguuaggacuucaaccugucuuuucaggggacucaacccauaaccuccucuggcauagaauguuuauuaagugauacagucguaaaacugcaagauaaguaguuguguuuucccuuaaguugacauguaaauauaugaaaauacuuacgggaaaauguuguucaaaguucuuuuuuuucuuuugucuacuuuuccuggaaaucucaauucacacugacguuuguaccuauuuucgagcugagagcaaacaucaaguguuuuauguggaaaucugaugauucuuaacagcucucuaguauuuaaaaaaaaaaaagaaagaaagaaaagaaaacagaagacaaaacacuucgguggcucugucaccggaucaauuuucaggcuuacauggugccccgaugguacucccauguagcagguggcuaccaggugucgggcacgaugcugaacauuuuaccccuaucacaucacucuuuucuccagucacaggaagcaaguacuauuuauccccacccuacagaugugcaaacugaggcucagagcgguuaacuaacugggccaaagucaaacaggaauuaaggaguuugcacccagcuaggcaccucccucacggguucaguuuauggagcucagggccaaagauucucaguguuaccagcucaacccaucccacuccaaccccacccaacacacauagcaggcacaccccacaucacacccuacugugacauaagcccauccuggagauucuccagcuauagccuggaguuguagaccuauuucugcagaugcaccuaggcgcacacacacacacacacacacacacacacacacacacacacacacagacucugcaauguguguguauguguuuagacauguucacauaaggccggccaggguggcucacgccuguaaucccagcacuuugggaggccgaggcaggcggaucacgagaucaagagaucgagaccauccuggccaacauggugaaaucccgucucuauuaaaaacacaaaaauuagcugggcgugguggugggcgccuguaaucccagcuacuuggcaggcugaggcaagauaauugcuugaacccgagaggcagaguuugcagugagcugagaucgugccacugcccugcagccuggaaacagagcgagacuccgucucaaaaaacaaaacaaaacaaaaauguucacaugaguacccugaguaguaagagaagacaccaagagaucugauggauaaaaugaaaaagcaggucugguuacuggcaggacuucacccagcucuaacuacauguauaugugugugugcauaaauaaaaguguuuuagaaaaucagccuaugguauguuaggcuuauugcccagaaaggugggcuguaugaaacaggaaauacuaauaaaaacugaaaacaagacucaacaccaccguucaguuucuccaggcuagugaugcuuucccagccauaagaugaaucaugacuagaucagugauagaggcgggaagcccagugagaauuuucuaaaccaguuuuuaaaaacguggguugacacauuuaaaaagaaucugcaaagcugaugcaccuaugugcagguaagcaguagacuuuggcagguaagucaaauacugaguuuguacaauggaaguacuaaugcuacaguauguaugccacaauuauuaaaaguuuguccuuaagaaacacuuucauccaauccuucauuuccagggacuuagauccuucacucugaaggcucuuuacacauuaaucccaccuuuaagugccugucuauaaaucacagagaucaaagagggaaacugugcagacaaacguucuagagcccuugaccacaccuggcccuccaugguaacugcuggucagacgaaaacugcaaaaugagauuucauuuucuguucuucuggaggcaacacgguggaagaagcaagaauccugaagaguuggauuucuguuaaauugcuuuuuaaccuuuuggucaacucuccccacccugccguuucaagggccguuugccuuuuuuaaggcuccagacagggcuccccagagacaguuccagcacucacagccucccccuacugaguuccagcaugcacagccucccgcuacugaguuccagcacucacagccucccccuacugaguuccagcacucacagccucccccuacugaguuccagcacucacagccucccacuacugaguuccagcacucacagccucccccuacugaguuccagcacucacagccucccccuacugaguuccagcacucacagccucccccuacugaguuccagcacucaguucccccugcucaguuccagcauucaguucccccugcucaguuccagcauucaguucccccugcucaguuccagcacucaaguccccccgcucaguuccagcacucacagccuccauuuccucaacuagaaaucaaggagggugggguacccuucaacucuccuauuucucugccuguuucucucuacacaugguaucuaccucuguucgggcugccauaucaaaauaucauaaaccaggcagcuuacaaacaauggaaauucauuucccacaguuguggaggcugggaaaguccaagacugaggggcagguggauuuggugucuggcaagggccuguuuccuggcucauagaaggcaccuucucacuguguccucacaggguagaaggaacaagcucuccggggccucuuuuagaaggacccucagcccucaugaccuaaucaccucccaaaggcuccauauccuaaucccaucaccuuggugauuagguuucuguguaugaaguggggagggggaggguacggaccaucgcacauggagagagaugccgagaauggcgcuccuuucuccguggcagauugcuuggagaaugccuaggauuuuuauuguuuuuguuguuguuuugaaacagagucuugcucugucacccaggcuggagugcaguggugccaucucggcucacugcaaccuccgccucccggguucaagcgauucuccugccucagccucccgaguaccugggauuacaggcaccugccaccacacccggcuaauuuuuguauuuuuaguaguuaugggguuucaccauguuggccaggcuggucucaaacuccucaccucaggugauccauccaccucggccucccaaagugcugggauuacaggcaugagccaccacacccagccaugccuaaguuuuuuacauccuuuuaacuuuaauauaguuugcaaucuuuuaauaacuagcauacaauauuauuacaaaaauaauggucauuauucuaaaacuaaaagauucuaagacucuagaccagaggucagcaaacuacagccuaugggccaaauguggcccacagcuuagcuuuauacugcccauaagcuaagaaugguucccaucuuuuauucuauuuuauuuuuuuagauggaguuucguucuuguugcccagacuggagugcaauggcacaaucucggcucaacgcaaccuccgccucccgggcugaagcaauucuccugccucagccucccgaguagcugggauuacaagcaugcacugccacauccagcuaauuuguauuuuuaguagagaugggguuucuccauguuggucaggcuggucucaaacucccaaccucaggugcuccgcccaccucagccuuccaaagugcuggaauuauaggcgugagccaccguacccgguccucaucuuuuuuuuuaaaggagguaaaacuaacauaacagaaaauuaaccauuuuaaaguauacaauuuaguaguguguaauauuuaguacauuccuaauguugugcaaccaccaccucugucuaguucuuaaguauuuucaucacugcauaaggaaaccccaaagucacugauaccauuuggaugucuguccccuccaaaucucuuguggaaaugugauccccaauguugaagaugggccuugugggagggauuuggaucauggcgccucccuccggaauggcuucgcaccauccucuuggugaggaccaaguucuuacucagugaguucccgagacacugguuguuacaaaaauaauggucauuauucuaaaacuaaaagauucuaagacucuagaccaguguguggucuagacuggacuagaguguggcagcuccuccccucucuugcuccugcucuuguccugugaugcauuggcucucccuuccccuucugccaugauuggaaguuuccggaugccucuccagaagcagaugccagcaccaugacuccuguacagcuuacagaaacaugagccaauuauaacucuuuccuuuuuuuuuuuuuuuuuuuuuuuuugauacagggucguacucugucacccaggcugaaaugcagugaugcaaucucugcaaccuccacuuccugggcuccagggacauaauccucccaccucagccuuuugaauagcugggacuacaggugugugccaccacgccuggcuaauuuuuaaauuuucuguagagaugggguuuugucauguugucuaggcuggucuccaacuucugggcucaaaggaucagccugccuaggccucccaagguuuuggggccacaggcaugaaccacuguguccagccuuauaccucuuuucuuauaaauuaccuagccuuguggaucaccugaggucaggaguuugagaccagccuggccgacauggcaaaaccccaucucuacuaaaaauacaaaaauuaaccaggcagguggugcaugccuauagucccagcuacucgggaggcugaggcaggagaaucgcuugaacccaggagguggaggcugcagugaguugagaucgcgccacugcacuccagccuggggaacagagcgagacuccaucucaaauaaacaaacaaacaaaucucugucucucucucucucacccguccucaaguauuccuuuauaguaaugcaaacagacugacacucccacuaagaggccacuccccaucacgcccuccccuagucccgggcaaccacuaaucugcuuucugugccuacagauuugccuauucuggacauuucauauaaacagaaucacauuuccuauuaauagaaucauguaugucccucugugacuggcuucuugcccuuagcauguuuucaagguucacccaugcuguagcaugaucgguguuucauuccuuuucauggcugaauaauauuccauuauagggacauaccauguuuuguuuauccauucauccaaugauggacauuugaauuguuuccaccuuuuaaguauugugacuaaugcugcuacgaacaauuguaaauaacuacuuguuugaacuuuuuuuuuuuuuuuuuuuugagauagagucuuacucuucugcucagacuggagugcaauggugcgaccucggcucacugcaaccucugccucccagauucaagugauucuccugccucagccuccccaguagcugguauuacaggugcgaaccaccacgcccaacuaauuguuuuuguauuuuuaguagagacgggguuucaccauguugcccaggcuagucucaaacuccugaccucaggugaucugcccgccucggccucccaacgugcugggauuacaggugugagccaccgugcccggccugaacuuuuuguaaaggcaagugaagcagugggaguggagaaggaacaaugacaucaguaacugguugugaucagcuaguuguaaacaccacugcacucggaccagccuaugugaacuguuucuacuucuucugggugcacaccuaagagaagaaucacugggucagaugguaguucuagguuuaaugucuuaacauaguauccuccauuuugccucuuggccugcaaaaccuaaaguauuuauuuucuagaucucugcagaaaaagcuugccaaucugugcucugaacagaauuuauuauuccuuuuagcuguuuaaugcuuuauaauuacaaaguacuuuagcauauauauuauauacuuugauuucauuggcuuuucauuacugcauuugggagcagaaaagacugguggcaggacccucauuuuacagaugaucaagacccgaaagcucuggggagccccacuggggucccacaaugacuaggagcuggaagcgugacucaagcacaaucucccuucaaaauccacuuuucuucuauucucccgccagcuaauccagucacugcagacaaacguaucaacaaggggacuaggaaaguguuuuacuggaacauuuuauuaagaaggaacuuuaauuuaauuuaauugccuuguagcaaugucaaugggggaaauucuagaacuuauuaaaauaacagugauauccccaaaucaucugaagaacauacagagucguguaacugacuugcccaacccaccaacaucgccacauauuuauccagcauggacaaagcacccauuuuagcucaggaagcccaucgggauggagcccccagugggugcuucccacagccgggguggagggaguuuuagggcugcugaccccgucacccacugcauucucgagcugagccgacacugccuuaguccuggaaguggugcccccuccaagacguaacuccccaccaacagaaaacucaugguucuccaggcaguucaugacauuuugcuaugaugaaaucucucccuuugccuucauucaauguacggcaaggugugccagggaccacagcaggugcugggaagagagaaagcaacaggauuaaggccucacccucgagggcccuccgucuagcaggggacacggagccaccaccugcccccagggggacuggaggggaagcaugucgcagaacugcagagagcaacgcgggaucggggggucauccagccuggguugggauaagaaagcuuuugucccucagagcaacgggcugacggccacagagccugaguauggaaauagcacagaccgucaucggggucaccuaagucucaggccuccugcacacacccccaccuccccuuccccuuggccucacugggcugauucucaaagcaacaacccccaagaauaaugugaagaaaucuggccacuuggccacggugccuggaggaacaggacgauuccugccuuugaaaaauugucaggaaaacacuuaugacguuaggaggacuugaaaacaaaucuugugaaguuaauagaagcacagcaauuagaaaggaaaauaaucacauuuccuuccugcuaaaucgguauuugccucuggugaagucaauuauguuaaagaaaauaaguuauuauuuucgaaaaauaaaaaagagguugauaagugccuuuauuccagcaaauaaaacuccaagaagcaaaugcuugaguuccugcguuuaggaaggucucuaagcagccugcaugggguuucuuaaaggacauguugggaugagccacacaauucguguucaucugcacaucacuccuggccucaagagaaacucauguuugucucucagaaggagaaugaaacacagccagcuccuaaugaucuuuagacagccaagaagcuuggccgaagggcccccacacucccucucggcuuucuccuccuccaaauccucugugcccaucugcaccuugacuuucuccuccuccaaauccuccgugcccaccuguccgaauccuccgugcccaccugcacacccugccagaccaagucguugggguuucuagcuuuucuucccaaauauacagaagugacuucgcugacuuugcugcuaauaacacaguaucauuaguaacaguaagcagcuguugaguguuuaccaugaguuaggccaucccgccccacuuacccccgggacaguuggcaauggcugagacauccuggcuugacauccuggcaaugucaaugggggaaauucuagaacuuauuaaaauaccagugauauccccaaaucaucugaagaacauacagagcuggagggggauccugcuaccgggaucuacugggcaggcccugcuaaguauccagcaagguacaggacagcuccccagggugaaaaauuauccugcccagaaugucaacagugcagggacugagaaacugugcugacaugacccaggucauucaacucuccagcaacucugugcaauaaaaaguaccgucaucaccuuggacaagcacaccagcugggcacaggcggcuaccgccacgcaccaguaggcagcggcagcggcaugcaagcccaggcaucagcagagcccccgcugcacgcugguggauaccgggcaucagcggagcccccgcugcaugcuggcaaucaaucccaggcaucaguggaguccccgcugcaugcuggcaaucaaucccaggcaucaguggaguccccgcugcacgcuggugauccugagcaucagcggagccccacugcacuggcaaucccgggcagccuccccuggaagucccuucuuuguguugaagccacuuaauauucacagggaccaggcaaugagccucaggcaggucacuuugcaggcagcacaagcucucaaugggcacagcugagucucucucguccagaugcaggcccaagcuccuaacuaugccuggcuaacaagaacucauacccagaguuccaucaccccagaaucugcuuuagggguucugccuaaggaacugaagaaggaaaacucacagcuuuaugcgccugggggagacaggccucuaauguccucgacccugaccucuuaaacuggcccugggugcgcuuaguccucacaucuccuccccacucuccuccuccuccuucccacuuccaccuagggcucccaggcccuaaggacucaagaccauucucacugggcccucagcucucgcaaaaucuuguccccacagcccgggguggaacaaagggauaagucucuuccagaagggguccggaggccaaugugaugaggccagcagugcccagggccugacucggaucagccacagacccugugaagcugaggcaggggagugggaauugcagacugugaccggggaccagccaggcacccagcuggacaggaguggaucugggaaugaggccaggauggccacgaagggcauuuuaaagggcuuccgggcuggcugcaggcacccacagucugaggaaaucugaucagagaaccagaaugaaugacaggcccugagaagacaaaaccugaauauguugguugagcugugaaaaaauacaacaucgacaguucauuacccacaagcccgaaauacccacaaaguucccaaacccaaagagauuucuguaauucauuuaacugcaaaagucuaaccugagcggagaggagcuaauuacggauggcuucccucgugcugugaauguucacacgcucauggcagcagaaucaauaugcucgacuccaggguguugcccagagcugcucggggugucuggcacaggagccacaagcacagcucccaccugucucucugcacugugacaaacuggaauucugaaacaccgcuggccucgcacagcucccaccugucucucugcacugugacaaacuggaauucugaaacaccgcuggccucgcacagcucccaccugucucucugcacugugacaaacuggaauucugaaacaccgcuggccucacacagcucccaccugucucucugcacugugacaaacuggaauucugaaacaccacuggccucgagaguuucagauauggaagaguuggcuguaucagacuauaaaccccaugagggcagcuccagauaccaaugucuaagaacagggcuggcaagcaaacaggaaggaaggaagaaagaagggaaggaaggaaaggagggguagaaggaaggaggggaggaaaggaaggaggaaaggaaggaggggaggaagaaaggacagaaggaaugagggaagaaggggagaagggagggaagaaaugaguuauuucgaggcagagucuucuuuaacuuuucuguggcuuaggacagaagguuuccuaaccgaggcugaaacauacaggcuucaucaccauucgucucuauacauagguuacacagcagcccaggcuagcugcuuaugcaagauguucaucuacucacaacauaaucaauuacuagaaaacuugucuacuaguaaguaaaauaaaaaucauaaaacuuugaggaaagugaaacucacaaugccacacuguccuuuuccaauuuaaaacaaucaccagaaaucauauauuuucucuauaagaaguuaauauugacuguauaauaguuuaacaugaauaacccaacacuaaguaguacuuucucuucucaaagcucuuccacacacacgguccugcucucuccccugggcagagcugagaugcacagaugugcuaggauaugcccuaacuccagguaaggggccuggggcucagggagggcagagguggcagcaguuaagugcuguacccaggaauaccagacccuauuauucaggcugucaauccagugcucuaaacuccacaccauagugucccaacgccuaacuuuuaagucacuguugcucuccuugauuuaacuuuauagccuuucucauugcauacauacucauagacaagaguuauuucagaauauagagauuccauucuauaaagacaaaaaacacuuaaaaacaaagacacgguucucauuagcaagcuuuaguacacagccuucugaggccaaaagaauuaaacagcacaggaaaggggccuggggugugcauguguuuuuggauggugggaacaggaacagccagacagauaugaaaaggacaggacacacugaggccaggcacgguggcucacgccuguaaucccagcacuuugggaggccaaggugggcagaucacgaggucaggagaucgagaccauccuggcuaacacagugaaaccccguguuacuaacccguguuaguaacuaaaccccguguuacuacuaaaaauacaaaaaauuaccagaugcgguggugcacaccuguaaucccagcuacuugggaggcugaggcaggaaaacugcuugaauccaggaggcggagguugcagugggccaagauugugccccugcacuccagccugggcaacagagcaagacuccaucccccccccgcccccaaaaaagaaaaagacacauugagaaagcagcacugcucucgggcuugguauacccugaagaauauccugaaaucuauaggacauaaguagcaaaauacaccccaaggaaaaaggcggcgucuguccuuggcaucacuuccgucuuuauagggacaugaacaucuguucugccaagugacuuucagggugaaaguccugaggauguacaaccucuaugcucaacgccaaugaagcugaagaguccagacuaacauucuuccugguaauggaaaauaagcaucaauaggaacacguggaggagaccaccaaauccacauucuccucuuccugcgaggcacacagucagauuacauuucccaccccacuugcugcaggucugaccagagacucaggucacggugagaaaaugugagcagaagggaugggcaccacccccagaccaggccagaaagaaaaucuaugcaccauccucaucucuuucuuuccccaucuacagguugaauggggaagggcaguggagggcagacuggcagggucaaaggagccagagacucugaauggcugggcagagcagagccccugcucacccuccccaccgcccacuuugacacaaaugaaaaacaaacuuguauuguaugaagccagcaaaauguuggggcuguuuguuacagcagcuagcuaacagucagaaaggaaaucaugacuguuacauaaauacaccuaaguuuaccuaguguaaccaauuaaguuaaaucacuccccugggugugguggcucacaucucuaaucccugcacuuuggucaagaguuugagaccagggcaacauaacaagacccucucccaaucuccuuaaaaaaguuuuuuuuaauuagcuagaccuguagucccagcuacucagaaggccaggguuggaggaucacuugagccugggaguucaaggcugcagugagcuaugaucgcaucacugcacucuggucuggccaguagaccaagagccugucuauaaaaauaaauaaauaaaauaaaauuuaaaacugaaacaaaucacucaggauggcauaaaaaucuugcaucacacuccucaggagaugcagcaacaaaucauaggucuaaacagcaacugcaucuagauaaagacucaagguaacauuucugaugagagauguagagaucugccuucauccugucccuucaggaccccccagcaaucaauaagaacuacagucccugaucuaaccucagagcuaacauuaaaauucugaccagcacuuugcaacaggcaggggcuacagaagcaauggggcccaugcagcagggcuggggagagccugaauuaagcuagagauucagucccaagcaacacagccuucuacuuacaaagcaaucaauaaaggaugaaagaaacuaacauuaucaagcacagaccaugggcccgguuugggcuagguuaucucuuucuccucagaagggcccaaagagguugguguuaucaccaguuuuacaaaggagaaacucaggcuuaagguaaauaacccccaaggugacaugccuaauaagacaccaggcugauauucaaagacggaucucuaugaccccuaaccugagcuguuuugacagcacacacuauaugccaagagaaagcaucuuuuucuccucaaggcacccaaaugaaaauucaacgaacugacagacaucugucuggggugaaaccaucugccuuuugaagacagggagugccugcguggauacucaguuucccacgugcaugugggcauguggauaacugcagaguggcaggccaaaacugagcuuguaagucaucaucaagaagcccggugucauuuauuugucacgagccaagcccccucccuugccccaugagcuccugauauuaaagcgcuuuucugacggcccaaggccacggagggccacgcaaggugcgaguggaggacagaagccagccucgugggcuguggagaagaacagugcccccuggaguugugugggacagcccugggucaccaagugugugacaccagcaccaaagcccggguuuugccaucacuguccaacugggauuccagagccaauaugaggcugcccuacucaugcuacaaaaacauaaaugguaagaaacuggaauuaaguccaagcaggaugugugaauauccuaaugcuaaaugcagcuuaagcccagguagguugagcucagagacugagccacacucacaggagaaugaucacacuuaaagaacugcucugaaguuccuguuuggaucucaaacuaccugauugcauuguucugucacuaauuugauuacaaggaauuuccagaucugaacagaaacaaauuggagucccauuagaaagcuccuuaccucccucgaguccaguagcaccagggacccaugggcuugcaggaaaaaaaaaaaaaaauucaaaggccacuaaagacagagggaaacuguagaugaaaagucuuauguuaucaaaaucauacuguuaugggcuacacugugucccuccaaauccauaugucaguguucuaaccucagaaauucagcauccuggaugugugacuguauuuggaggcagggaauuuaaagaggugacuaagucaaaguguggucuuuacgguaggguaggcccuuauccagcaugacuaguguccuuucuuucuuuuuuuuuuuuuuuuuccgagauggagucucacucugucacccaggcuggaguacgguggcgcgaucucggcucacugcaagcuccgccucccggguucacgccauucuccugccucagccucccgaguagcugggaccacaggcgcccgccaccacgcccggcuaguuuuuuguauuuuuaguagagacaggguuucaccguguuagccgggagggucucgaucuacugaccucgugaucuccccgccuuggccucccaaagugcuaggauuacaggcgugagccaccgcgcccggucucuuuuuuuuuuuugagauggaguuuugcucuuguugcccaggcugaaguacaauggcgcaaucuuggcucacugcaaccuccgccuccgagguuccagugauucuccugccucagccuccccaguagcugggauuacaggcgcccgccaccauaccagguuaauuuuuuguauuuuuacuagagaugggguuucaccauauuggccaggcuggucucuaaccccugaccucaggugacccgcccaccucagccucccaaaaugcugggauuacaggugugagccaccgaggcuggccauaguggccuuguaagaagaggaaaugaggacacugacacacaccgaaggaagacccuaugaagacagggugaagacagcugucuguaacccaaggagagaggucucagaagaaaccaaccaccaaaacaccuugacuccggcauuacagaauugugaagaaacacaguccuguugguuaagccacccugucuugugguccuuuguuaugguagcuccagucaacuaacacacaaauuccacacugugauuucaacgucagcuccaaagcacuucccaucauaucaauaaaagcaaauugaggaacaguggcugauggcaaaugcaauccauuugcauaacaauguuuccaaacugccuuaagauacauuaauuaguuccugucaacucccaucagcccaaccucagugaagcaaagcccacaguaccauccagaacaucgcugcuuaaaaacgcagaaaccaggcuggaagagguucaaacacucacccugggucauaugcaugaacaguggccuugucagggcuaaaacucaaacucugaccccuccucgggcgccuccucauuuccucccugaaggccuuccggaugcacugaaggguuugaaaagugaacaucuugacaaccgcaucuugacaagcgaccaccugguguuaaccguggucuccacacuggugcaugugcccggucagccuuccacuccaugaugucucuucaaacuggaucaaaguccuucccugaauacacuggacaauuucacagcucaguggacccgcucauacagcgcucccaccagcacccccugggugggcugccuucuccuguaccgcagcagcacagggagcugcacgcuggcucccaaaugaaaccaaggcaaaugcaaacuccaaccacaaugacagacaacuacacaccuacacaagcaauaaggacggugacaaaugauggcaaggauuccgagaaaucuacaaucacauauacacugcuggugagaaugugaacuggcacaguuacuccaggaaaguuuggcaguuucuuaaaaagcuaaacauccaacuaccagacgacucagccucugcacuccugggcauuuaucccagaaaaugaagacuuagguucacacuaaaaccuguaugugcuuguugacagcagcuguauuugucacagccaaacucagauguccuucgacaggugaacaguuaaucuggggcauauccagaccaugaaaugauacucagcaaagaaaagaagcaacacccggaugaauauccagagagagauacugagugaaaaaagccaaucccgaaagcuuaccuccuaugcaauuucacuaacggaacacucuuuaaaggacaauauuauaaaaacacagaacaggcaaaggguggccaggauuugaggggagaaaggcguggagggagguaggcguggugcuuguggugcuggaaauguucuguaccuugacuaucgaugucaauaucccagucgugaugcuguacuacagcuuuacaagacguaaccuuaggugaaacuaguaauggcuacucaugaucucccugaauuauauuuuacacccgcauuuggcuauaauuaucugaaaauacaaaguuuaaugcaaucaucugaaaauacaaaguacagagaggaagaaaagaaagaagggaaaagggagggagggaaggagggugggaacagcguacaagugugcgcuugcuacagcgauggcccuggggcgucagcgccacacccagcaaaggacaccacguggccuauuucuuccuccccauuucacuaccugcauccacagaggugauaaagagacagaacuauugacacacacuaagacaauccugaucagaugucugguauccuaggcaaacaauggcauagaaauaaauuuaaauuucuuauguuuccaaaguaaaaucagguuuguagaaauauaauaugcccugauuugguuuugcugcaauuccagugaaugaaaaugccugcauuucuauuuacuuaugaucaaaucuaauuuuucuuccccaaaguagcagcuugcuugcuacucuagauaacaaaagagaucucucaucaacucccacgcucccaaauuuauuuggauaucacacuauuccuagcaauuaucauugcuuagagcuaaugugaaggcacgcaagucaggcuccucacacugagcaaaugugacuucuaccccaauuaggaagcaaaacacacuaucaagaaaccaacuuuugaagaaaggcauuuuuccagcaacccguuaaccgcacacagaagucacuugucacuauguuucuaaacuuuaugcuuuauuaaauaaaaaguuaacaaaagcaacgcuucguugaguacuuggcauaucuuaaacgcagggcuaaauucucugccaacaucaucucagcgaguccucacgacucggcagcaagcaggcuugguuccacuucacagaugagaaaaccaaggcuaagaaaguaugaguaauuugcucaagggucccauuaugaguaagagcagugccaaugccccaucccauuugagagcugcacuuggaaguggccaaagugaagagcacacuuggguucacuaccuucaaugaacuuaguaacagaucucaagggugcaagagagccucacccugcaagcuucucucccaucaucuguauuaguuuuccacugcugccguaacaaauucccacaacccagccagcuuaaaaccacacaaauguauuaucucaguuccacaggccacacgcccagcagcucagggucucaaaaucaagguguuggcuggcugggcucuuagcaggaggcccuggggaggaaaucuguuuccaagcucauucaggguguuggcaggauccaauucuuuguaacugccgaucauuagcuaggggccucccguagcucccugaggccucucucugguccuugcaagugagccccuacaucucagggccagcaacugugcuuccaaacauaggaucuucugacugccuguuucacaacuuugacagccaaaguucucugugcccacguggaugguccugaauaaucucccaucuacgaauuccaaguaaccugaaucacaucugccaagucccuuuugccauguaacauauugaauucacagagucuggggauuagggcguggaccuuuuuggggaccauuauucugccuucaacaccauuguugagaugugagugagugagcacaugguccucacgugugauucuagaacauacugcaucuuuucaccuaaucuuaggaacaggauccauggcaacauaauuuuauugacgucgggacauaaaacugccuacugggcugugagagaaaagaucaucuggccagugugacagcugagucaagguuuaugccuguuaauaugccaggcccguaaacaugacccaccaacucaaaaccaagggggaaacgcgggcugguaaauuucacaggcagcccccaguggaaugaauugggaggaaccagcauuuccugccuuugcagaaggaaccccagaucagcuguuuacuccuuucccaauuuuacaaaauaaauauacaacugaaguaucucauuuacaaacaaugcuucuaacagauuccaaguacuugcaaacaauaagcugugauucauguuuccaaaugagauggaguuuuaucauuuucuuaccccucgugauucguucaugggccaaguggccagaguggaagugugguccacccacagagccaccagagcgccuccagggaaacacagcccuguuguuaagcuccgaaaaaugcuggaguugguaaggaugguggagggguccuccaguaauuuucccuuagguggaaacagccaaucaccuacuggcaauaaaucccuacaucccagcaccuacauccuucccagucagcauccuucgugagaaccacuaaaauccucccacugcacacuugcagacaaguggggagccugggauggccccauugcgcucaugcucagcuccccucccacccucccugaugggggacucugguuaaagugccucuggaugccgauggaguggugcugucucauuacugucuacccagcaagcugucaucugcacccagugagaggaagcacagcagccacucucuucucuaccuucagcccuucacaucuuuccuagcauuuccuggcaaaaccaucccagauacuuuucgccuuuuaaaauuuuccaacaguuuucuauuuuuucuuuuuuuaacuuuuuuaaauuuauuuuuucuuaauaaucaaacauggaguuuucuuaaaaccaaaguauuagcaagaggugugauguuagaagucaccaccaugagcgcuggugaagcuucuggaaggugugagacucaagcgcaccgcccuguucuggcccucagccuccuccccagcaaggagaccccguucucccaucuacgaacauucuuuucagucuucuccagaccauccagcuacacuauaggauccuaacugacaccauccaggucucucugggggcagacgaaggguaacaaggucucuuaaaauguggcgucccaaagagaagcccuccccaucugcaggcaagcacaggacacuguggcagcugaacccagggcggccacacuucacacccaggaggcaccacuuacuggugaugugaccucaggcaagcaauccaccucuuccuugccucuguagaaugggagcagugauggcccccacugcaccccgauggcccccacuacacccccaauggccacuacugcacccuggccaugggcaccuaaguugcuuccucagcagggccagggcuaugggaugccugcuccucugccagccuccugccucuccugccuauccaccucuuccucucucucugcgugugcuggugcuagguucccugggagucaguccucagcucucuccucuacacacuacccccgcagggacccccacugucgccacaacccaagcauucucagguggaauauccaccccgaaccucucgccucugaugcagacugaaggcccgugccaagugccccagacugaauccauuagguggugcacagggugcagguuacacacugagucugcagucagaugagcucuccugcacuuuugugaaugugucugggccucaguuuccucaucugcaaaauggggagauggggaggaagcucagucauaaugguccugaagcaaggaggcccccuaugccucccagcauguggaacaagcuaagugcaggcccgguaggacccagggcugucccaggacuguccccgugaccacuguccagcuggcuccguggucagggcauacuguaagucauugacagcagagagaagcaacuguucacagaaaggagagcgcuccggggacaagggcugccagggcgcuucccaaaagucagagagccaggauucgaaccacaccagcagagggucgggcagguccagcacgggccaggcacagaaugggcgcggggcugcugcugagacggugcccuuggaggacacagccugggcugugggaggcgagaccaccaaaggucuucccagucgggucgaguggccuggaugaggcaggcggucaaggaugucuguggauggugggacggggaauagcaagcccgaaaaccaacugggaagaucccggacccgggagagcaggagaguagccacggcccagucccgacaccaggcgcgcagaucacgaagaggugggcguccgcaggccucggcgaccggcugcggguccccggggcgcaaggaugcgggucccacgcggacgggcccgucuauucagccgcaagggaaagccucccucucaggaaugcgcacucggguccgaaauguaaacuugcaacccgacuccuuccauccccccucggaagcgacaaagagccgcggagcaaaaacaggcccccgcucucccggaagggucuccaggccuggggccacuggggcgcucggccgcucgccuucucuccaaggucccacacgguccccagcgagaccgccgaggggcaaggggcgcuggccacccaggucgcgcccccuccuccccgccgggaaagggcggaauuauccgcugggaccgcgccgaccugagcccgcccacccagagcccggacgcgggacgcaaguucauccaagaagcagaagccgccgcgagacagugaccccugggcuucccugacgggcccagccgcgcagauagcagcggccggggccggggaguuggggguagcccggggggcuccacggcagagguccagaggagcgggcgucggaggggacacccuagggagggacgcgcccgcccccauucccaccccacccccucguguucccgacccgcauccccggggcuggagcugacgccgccgggggcgcggggcggccggggucgccgggcauugcgagcggggcggcggcgcgggcgcgggcggaagcgccucuccccggcccggcggccgcucggggcggcggcaacaggcgcccggcacacccgccccgccggagccugggcuuggggcgagaggcgcggcggcggcggcgcugcucacccacgccguacuucuccucgcgcuuggugggcacccagcgcgucauggcgccgccggagccgccgcgggucgggcaggaaacuccgcgucuaggccgccauuuuccauuc
